United States Patent 7,314,974 (EXPRESSION OF MICROBIAL PROTEINS IN PLANTS FOR PRODUCTION OF PLANTS WITH IMPROVED PROPERTIES) - sequence listing, part 6

SEQ ID NO: 20906 - protein, 441 aa, SYNECHOCOCCUS SP. WH 8102
SGPMSQRFETLQLHAGQSPDSATNARAVPIYQTSSYVFNDAEHGANLFGLKEFGNIYTRLMNPTTDVFEKRVAALEGGVAALATASGQSAQFLAITNCMQAGDNFVSTSFLYGGTYNQFKVQFPRLGIDVRFADGDDVESFAAQIDDKTKGLYVEAMGNPRFNIPDFEGLSALAKERGIPLIVDNTLGACGALMRPIDHGADVVVESATKWIGGHGTSLGGVIVDAGTFNWGNGKFPLLSQPSAAYHGLVHWDAFGFGSDVCKMLGVPDNRNVAFALRARVEGLRDWGPAVSPFNSFLLLQGLETLSLRVERHTENAMALATWLATHPNVEHVSYPGLSSDPYHAAAKKYLTGRGMGCMLMFSLKGGYDDAVRFINSLQLASHLANVGDAKTLVIHPASTTHQQLSEDEQASAGVTPTMVRVSVGLEHIDDIKADFEQALA

SEQ ID NO: 20907 - protein, 511 aa, SYNECHOCOCCUS SP. WH 8102
MSDQQHWDAVVIGSGIGGLVTASQLAAKGARTLVLERYLIPGGSGGAFKREGYTFDVGASMIFGFGEKGYTNLLTRALADVGEHCETIPDQAQLEYHMPGGLNIAVDRDYETFIADLSARFPHEATGVRRFYDTCWQVFNCLDAMPLLSLEDPAYLTKVFFKAPLACLGLARWLPFNVGAVARQHINDEQLLKFIDIECFCWSVMPADRTPMINAGMVFSDRHAGGINYPRGGVGVIAEKLVHGLERHGGAIRYKARVTKVLLENGEAVGVKLADGETIRAKRVISNATRWDTFSGQDDGSTRAGQALVDEANTPKKEAFWRRRYVPSPSFLSLHLGVRADLIPAGTHCHHLLLEDWNRMEDEQGVIFVSMPSLLDPDLAPAGHHIVHTFTPSSMEAWQGLSPTDYRAKKEADAARLIQRLEAILPGLSEAITHKEIGTPRSHRRFLGRFQGSYGPIPAMQLPGLLPMPFNRTGVPNLYCVGDSCFPGQGLNAVAFSGFACAHRVGADLGL

SEQ ID NO: 20908 - protein, 549 aa, SYNECHOCOCCUS SP. WH 8102
FDGFGFSEALLKTLADKGYSEPSPIQKAAFPELMLGRDLVGQAQTGTGKTAAFALPLLERLASGQKTPQALVLAPTRELAMQVADSFKAYSAGHPHLKVLAVYGGTDFRSQINTLRRGVDVVVGTPGRVMDHMRQGTLDTSGLRSLVLDEADEMLRMGFIDDVEWILEQLPQERQVVLFSATMPPEIRRLSKRYLKDPAEVTIRTKDQEGKRIRQRSITVPMPHKLEALQRVLDACGGEGVIIFARTKAITLTVAETLEAGGHQVAVLNGDVPQNQRERTVERLRSGSVDILVATDVAARGLDVDRIGLVINYDMPFDSEAYVHRIGRTGRAGRTGEAVLFVTPRERRFINNLERATGQPIEAMEVPGNSAINQGRLDRLHKRLSEAAHNERSYEEEAALLKELLQRIGTELELSPEQLAYAALSMAIGPDPLLRQKGDDEWIHNNQRRDRDRDRDRGGERRERRSDRPARAPEENMQRYRVEVGHRDRVKPGNLVGAIAGETGLQGRAIGRIQIFDNHSFVDLPKGMPEDVFNSLRRLRVMNRELQIT

SEQ ID NO: 20909 - protein, 583 aa, SYNECHOCOCCUS SP. WH 8102
PLVRLLRHLAPQRRLVITAVICSLLNKLFDLAPPALIGLAVDVVVRGQQSLLASFGIQSVSQQLWVLALLTFVIWAAESLFEYLYDVLWRNLAQTTQHRLRLEAYDHLQRLELAFFEQDSSGRLMAVLNDDINQLERFLDRGANQILQLITTVLIVGIGMAVVAPEVALFAYLPIPVILLGSLRFQRQLAPRYREVRARAGDLASRLANNLGGMLTIKSFTAEPLEAQRLEAESLAYLESNGRAIRLSAAFIPLIRFAILFAFVAILLVGGFQALSGQLAVGTYSVLVFITQRLLWPLTALGRTLDEYQRSMASTQRVLDLIDTPVTIRSGQTPLDRRLVRGEIRFEQVDFAYPGRASLLQGFDLVVPSGATVGIVGSTGSGKSTVVKLLLRLYERQGGRILLDGRPIEQLQLPDLRGAIALVSQDVYLFHGTVAENIAYSVANPDPLAIEQAARLAEAAGFIEALPDRYDTLVGERGQRLSGGQRQRIALARAILKDAPVLVLDEATAAVDNDTEAAIQRSLDQITRNRTTVVIAHRLSTVRHADRIVVMEQGRIVEQGRHDQLLAHGGVYANLWQVQAGER

SEQ ID NO: 20910 - protein, 439 aa, SYNECHOCOCCUS SP. WH 8102
TASPNRNLAPVTTCLDERDRLMVGGCLLSDLAQRYGTPLYVLDEDTVRGTCRAYRDALKQHYPGPSLPIYASKANSSLLVSSIAASEGLGLDAVSAGELLTAFQGGMPGERMVLHGNNKNDEELLLAYNNDVTIVVDNQHDLERLAELVPAGGAPARLMLRFTPGIECHTHEYIQTGHLDSKFGFDPDLLESVLRQLVGKPWAKLTGLHAHIGSQIFELEPHRDLAAVMADALKLARSLGHPVEDLNVGGGLGIRYVASDDPPTIEQWVKVVADAVTAACRDRQLELPRLLCEPGRSLVATAGVTLYAVGSRKTIPGVRTYVAIDGGMSDNPRPITYQSLYTCCLADRPLAPAEETVNLVGKHCESGDVLLKDLPLPTTQSGDIVAVFATGAYNASMSSNYNRIPRPAAVVVQSGSSELFQKREQPDDLLRYDVLPERF

SEQ ID NO: 20911 - protein, 829 aa, SYNECHOCOCCUS SP. WH 8102
MFERFTEKAIKVIMLAQEEARRLGHNFVGTEQILLGLIGEGTGVAAKVLKSMGVNLKDARVEVEKIIGRGSGFVAVEIPFTPRAKRVLELSLEEARQLGHNYIGTEHLLLGLIREGEGVAARVLENLGVDLAKVRTQVIRMLGETAEVSGGGGGGGAKGSTKTPTLDEFGSNLTQMANEAKLDPVVGRHNEIERVIQILGRRTKNNPVLIGEPGVGKTAIAEGLAQRIQQGEIPDILEDKRVLTLDIGLLVAGTKYRGEFEERLKKIMEEIKAAGNVILVIDEVHTLIGAGAAEGAIDAANILKPALARGELQCIGATTLDEYRKHIERDAALERRFQPVNVGEPSIDDTIEILRGLRERYEQHHRLKITDDALVAAATLGDRYISDRFLPDKAIDLIDEAGSRVRLLNSKLPPEAKEVDKELRGVQKQKEDAVRDQDFTKAGELREKEVELRDQIRSLLQANRTDATAVAEASADQSDAPAAESAESSPMVNEEDIAQIVASWTGVPVQKLTESESVKLLNMEETLHQRLIGQDEAVKAVSKAIRRARVGLKNPNRPIASFIFSGPTGVGKTELTKALATYFFGSEEAMIRLDMSEFMERHTVSKLIGSPPGYVGFNEGGQLTEAVRRRPYTVVLFDEIEKAHPDVFNLLLQLLEDGRLTDSKGRTVDFKNTLVIMTSNIGSKVIEKGGGGLGFEFSGESAEESQYTRIRSLVNEELKQYFRPEFLNRLDEIIVFRQLSRDEVKEIAEIMLKEVFGRMGEKGITLTVSDAFKERLVEEGYNPAYGARPLRRAVMRLLEDSLAEEVLSGRIKDGDHAEVDVDDDKKVVV

SEQ ID NO: 20912 - protein, 350 aa, SYNECHOCOCCUS SP. WH 8102
SHAIAPAVVLRGEGAWAEALSKISALCSRPLLLGRSQATVSLRSALVSDLVHSCLTPQPAELSYDCCEEDLQRLAAEAADCDAVLAAGGGKVLDAGKLLAHRLQLPCITVPLSAATCAGWTALSNLYSMHGAFEGDVALTRCPELLVFDHGLVRQAPARTLASGIADALAKWYEASVSSGDSSDGLVQQAVQMARVLRDQLMIDGPLALQDPHSAAWARTAEACALTAGVIGGLGGARCRTVAAHAVHNGLTQLQACQDVLHGEKVGFGILVQLRLEERLGGNRLAGQAHRQLLPLLRQLQLPVSLQDLGLSNASLSDLQQVCAFACREGSDLHNLPFAVTPGALLEALV

SEQ ID NO: 20913 - protein, 991 aa, SYNECHOCOCCUS SP. WH 8102
PFSKLSTEQKAKLAETIQPLRLRPGQKLYDFSDLPPGIALIAEGQMRLLALDEREEPFTLYRLAPGDQAGHIGILRGVTGYALAASQPSLLWLLPQTGFLQVIAENAEFANEFLEPNIEELYGVSILTNSPLNNTKNEIKDWASNKIAESKGDHKILLLPPGEHFVDSKWGPWLVSSSNISGCKPGEELLGPMKLIVQGKVPARLISKSGATPPINVPQVLVVSPDSSEAAPLQIEAEVVEPDWQESSTAIVAVEKQQEALEDWYGKLGDDGSFPQLDGSGPVGIPMAALRMLARYFDIPFRKDVIQRIIEDQLMRNELSETGERSMGLIQLAATADLIGLRATQINVTENQIGRLQLPAIAIRKNKPIILWSADMVGQALISAPEEGQIKVSTKDLGARNDDGTIQVLTIQRSKVSPKKRLGWGWFIPALKEHKAVLIQVLVASFFVQLFGLLNPLLIQQIIDAVISQGNVSSLNVLGTLLIGMSLAQAVLSSLRTYLFADTTNRIDISLGSSIIDHLLRLPLGYFSDRPVGEVSSRINELQKIRQFLTGTALTVVLDAIFAIIYIAVMLLYSVQLTVWSLVVVPLFVGLTLVSAPIIRKQLREQAEANARVQSHLVETVGGMETIKGQSMEIHSRWRWQQLYGGQITSGFRNTVTSTAAGSASQFLEQLSGLIVLWIGASLVLKGELTLGQLIAFRILASYVTSPLLRMANLWQNFQETALSLERLADIVDHPQELEITGEQKPPIPPIVGTVEYKGVNFRFGKEGALNLSNINFKIEQGSFIGVVGSSGSGKSTMLKMLTRLYEINDGQILIDDNDISKVDLYSLRSQIGVVPQDSLLFDGSVMSNIALARPDASFEEVVVAAQIACAHEFIQAMPAGYNSSVGERGAGMSGGQRQRMAIARMIIRRPRLLVLDEATSALDVDTERRLTANLIELYKDSTVFFITHRLASLKFADVILVMDQGALVEKGTHEELMALDGRYATLYHQQ

SEQ ID NO: 20914 - protein, 315 aa, SYNECHOCOCCUS SP. WH 8102
PDTRRLRLFSGTSNPGLAREIAAYLGVPDGPRVCKRFADGELYVQIQESIRGCDVFLIQPTCAPVNDHLMELLIMVDACRRASARQITAVVPYYGYARADRKTAGRESITAKLTANLLVKSGVDRVLAMDLHSAQIQGYFDIPCDHIYGSPVLVDYLSTQNLDDIVVVSPDVGGVARARAFAKQMNDAPLAIIDKRRTGHNLAESLTVIGDVSGRTAILIDDMIDTGGTICAGARLLRQQGAKRVIACATHAVFSPPASERLSADGLFEQVVVTNSIPIQQERTFPQLQVLSVANMLGEAIWRIHEESSVSSMFR

SEQ ID NO: 20915 - protein, 362 aa, SYNECHOCOCCUS SP. WH 8102
  unsure (1)..(362): unsure at all Xaa locations
SSXTMPLILHGIGTAVPSRRLSQADAVQVAHRINAETPEQVRLMTRIYQKTKVLSRGSVLLEKDGDDGTIQERLSFYGEESPGTAERMQAFEDHAGELALEAAAKALSDSDISATAITHLVTVSCTGFQSPGVDLFLIEKLDLSPSVQRTHIGFMGCHAALNGLRVAHAFAEMDPKAVVLLCAVELCSLHMAYGWHPEQVVANALFADGAAAVVASVNPSPTHQTLALRRSGSMVIPNSSDLMHWEIGDHGFAMGLSPLVPETVGAALLPWLRDWLKEQAIDLEAVTSWAVHPGGPKILSTCAEVLSLDPGLLHESRGILQDHGNMSSATILFILERLRRRECSGPCLALAFGPGLSAEVAL

SEQ ID NO: 20916 - protein, 461 aa, SYNECHOCOCCUS SP. WH 8102
MRILFAAAECAPMIKVGGMGDVVGSLPPALAKLGHDVRLIMPGYSKLWTKLTISDEPIWRAQTMGTEFAVYETKHPGNGMTIYLVGHPVFDPERIYGGEDEDWRFTFFASAAAEFAWNVWKPNVLHCHDWHTGMIPVWMHQDPEISTVFTIHNLKYQGPWRWKLDRITWCPWYMQGDHTMAAALLYADRVNAVSPTYAEEIRTAEYGEKLDGLLNFVSGKLRGILNGIDLEAWNPQTDGALPATFSADDLSGKAVCKRVLQERMGLEVRDDAFVLGMVSRLVDQKGVDLLLQVADRLLAYTDTQIVVLGTGDRGLESGLWQLASRHAGRCAVFLTYDDDLSRLIYAGSDAFLMPSRFEPCGISQLYAMRYGSVPVVRKVGGLVDTVPPHSPADASGTGFCFDRFEPVDFYTALVRAWEAYRHRDSWQELQKRGMQQDYSWDRSAIDYDVMYRDVCGLKEPT

SEQ ID NO: 20917 - protein, 424 aa, SYNECHOCOCCUS SP. WH 8102
GGSLSGHVKVPGDKSISHRSLLFGAIAEGTTTIDGLLPAEDPISTAACLRAMGVLISPIEAAGLVTVEGVGLDGLQEPAEILDCGNSGTTMRLMLGLLAGRAGRHFVLDGDASLRRRPMRRVGQPLASMGADVRGRDGGNLAPLAVQGQSLRGTVIGTPVASAQVKSALLLAALTADGTTTVIEPAQSRDHSERMLRAFGADLQVGGEMGRHITVRPGNTLKGQQVVVPGDISSAAFWLVAGALVPGADLTIENVGLNPTRTGILEVLEQMNAQIEVLNRRDVAGEPVGDLRITHGPLQPFSIGEEIMPRLVDEVPILSVAACFCDGESRISGASELRVKETDRLAVMARQLKAMGAEIEEHEDGMTIHGGRPLKGAALDSETDHRVAMSLAVASLLASGDSTLQRSDAAAVSYPSFWDDLDRL

SEQ ID NO: 20918 - protein, 323 aa, SYNECHOCOCCUS SP. WH 8102
MITVTELLQPVETDLETLLGDLRSLIGAGHPILQAAAEHLFSAGGKRLRPGIVLLLSRALSADGQLTPRHRRLAEITEMIHTASLVHDDVVDEASTRRGVDTVHSRFDARVAVLAGDFLFAQASWHLANLDDLEVVKLLSRVIMDLADGEVKQGLFRFDTAQSFETYLEKSYCKTASLIANSARAAGVLSDCSPSELDGLYRFGRQLGLAFQVVDDILDFTGSDQQLGKPAASDLASGYLTAPTFYAMEEQPGLQALIAREFAEPGDLDQALEMVRSSRAIPRTRELAETFARESRDAISWMSDSPCKRALLELPDFVLSRLY

SEQ ID NO: 20919 - protein, 192 aa, SYNECHOCOCCUS SP. WH 8102
LFDLDGVLLDTEPLHSRGWSEAASHFGAAAQQRPVAATQGASSSRLRRPGEQLAAASCGIRRLAGSSAADRAGALPNAKAMPFAQELLEHCDHRGIPMALVTSSSLEAVSFKAAPHPWLKRIQLRVHGDDPDLKAGKPDPAPFLLAASRLGLDPKTCWALEDSQAGTAAAVTAGCHVWVLNEHGPTQTMEMN

SEQ ID NO: 20920 - protein, 657 aa, SYNECHOCOCCUS SP. WH 8102
VTESNTSIESVLQEQRVFQPPAEMAAAARIGSLESYRAMAAAATKDPDGFWGEAARRELHWFEPFHTVLDWSEPPFARWFEGGTTNLSYNCLDRHLEGAKAEKTALIWEGEPGDVRRFSYRELHAEVCKAANALKAMGIGKGDLVALYMPMIPEAAIAMLACARIGAPHSVVFGGFSAEALRDRLKDGEAKAVITADGGFRKDKPVSLKPAVDAALAEGACPSVTGVLVVQRTKQPVEMVAGRDQWWHDLVDAQGSDCPAEPMASEDRLFVLYTSGSTGKPKGVVHTTAGYNLWAHLTFQWIFDIRDNDVYWCTADVGWITGHSYIVYGPLSNGATTVMYEGAPRPSKPGAFWELIQKHGITIFYTAPTAIRAFMKSGRQVPDQFDMSSLRLLGTVGEPINPEAWMWYRDVIGGNRCPIVDTWWQTETGGVMISPLPGATPTKPGSATLPLPGIQADIVDGEGNSCGPDEGGYLAVRAPWPGMMRTVHGNPQRFRESYWEHIRPADGSYLYFAGDGARRDADGYFWVMGRVDDVINVSGHRLGTMEIESALVSHPAVAEAAVVGRPDDLKGEGIVAFVTLESGRESSDDLIKQLRAHVGTEIGPIARPDEIRCSDALPKTRSGKIMRRILRALAAGQEVSGDTSTLEDRSVLDRLRA

SEQ ID NO: 20921 - protein, 172 aa, SYNECHOCOCCUS SP. WH 8102
HAVLGTPLRAPLMSDQEEALFACGCFWGAEKGFWRLPGVVSTAVGYAGGQRTNPTYQEVCTGTTGHTEVVRVVWSTPAVDFSDLLKLFWECHDPTQGNRQGNDTGTQYRSAIYTTTNQQMSLAQASRTSYQDALNQRGYGPITTEILADQAFTFAEPYHQQYLAKPGSRPYC

SEQ ID NO: 20922 - protein, 574 aa, SYNECHOCOCCUS SP. WH 8102
MAAMRLDLIGRYLRPHRKTVIFGAIALVVVNVLSVTIPMEVRRVIDELQVGFAYDRVLSQAAWIVLLATTMGAVRLLSRQLVFGVGRQVEVELRQSLFDHMLRQEPAWVQTTGSGDVNNRATSDVENIRRLLGFAILSLTNTLLAYSLTLPAMLTIDPSLTLAAIGPYPVMLTVVRLFGGRMMKQQRRQQEDLSGLSDLIQEDLSGIGAIKIYGQEASEQQAFSQRNRSYRNSAIRLARTRSTLFPLLEGLSSISLLLLLALGSGKLSDGSLTTGGLVALVFYVQQLVFPTALLGFTLNTFQTGQVSLERVEELLQRQPAIRDGNDPINVEQPRRGRLEARGLRIRYDGAERDTLNGLDFCIEPGELVAVVGAVGCGKTTLARAFGRMVPVPDGQLFLDGVDINRLPLKDLRGEVAMVPQEGFLFTSTLADNLRYGEPRAGDDRVEQAAERARLSDDVKGFPDGFSTIVGERGITLSGGQRQRTALGRALLVSAPVLVLDDALASVDNNTAAAILNSIRSQEGRTIVMISHQLSAAAACDRILVMDNGRIVQQGHHNALIATAGVYRRLWERQQ

SEQ ID NO: 20923 - protein, 416 aa, SYNECHOCOCCUS SP. WH 8102
  unsure (1)..(416): unsure at all Xaa locations
RRSPGQGLPWTRLETLRQHLASXNGQMKGDDRQLFGLMPHPSSRQAHLVLADGTVLTGDAFGHRGSVVGEVVFNTGMTGYQEVLTDPSYAGQLVTFTYPELGNTGVNGDDQEADHPHARGVIARQLAPCASNWRCSESLDNWMERHGLVGICGVDTRALVRRLRDGGAINGVISSDGRSPADLLAEVRHAPSMEGLNLASQVSTTEPYEWSSPCRVGFDQRLKQHPDLPYRVVAIDFGIKRAILDRLVAHGCAVTVLPSDADLDTVMSHQPEGVFLSNGPGDPAAVDSGIDLARSLLERANLPLFGICLGHQILGLALGGKTFKLGYGHRGLNHPCGTSGQVEITSQNHGFAISADSLPEPMVEVTHLNLNDRTVAAFQHRHQPVFGIQYHPEASPGPHDADHHFGRFVALMADRR

SEQ ID NO: 20924 - protein, 323 aa, SYNECHOCOCCUS SP. WH 8102
VAGTLLFNALREAIDEEMARDPYVCVMGEDVGHYGGSYKVTKDLCEKYGDLRVLDTPIAENGFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLSEELPEGEFTCALDQADLVQEGSDVTILTYSRMRHHCLKAVEQLEADGISVELIDLISLKPFDMETIGRSIRKTHRVIVVEECMKTGGIGAELIALITEQCFDDLDARPVRLSSQDIPTPYNGSLENLTIIQPHQIVEAAQQMV

SEQ ID NO: 20925 - protein, 455 aa, SYNECHOCOCCUS SP. WH 8102
LHRLDPFASPDQADPVLRDFLHRASDLLCDWIGTASKGVPLPTVRPQPAVAPTAAGLGMDRLLKDLQLVMEGAYQPSHPGALAHLDPPPLTASIAADLICAGLNNNLLAEELSPGLTDLEQQLCSWFCQRLGLPDQSGGVLASGGTLSNLMGLVVARTHAGVRDGVVLCSRDAHVSLQKAATVMGLPDQALQQLPVDSDGGLDLAALDAALSALRRDGRCCLAVVATAGTTVRGAVDPLDAIARLCRRERVWLHVDAAIGGVFALWEPLAPLMEGLHQADSITLNPQKLLGITKTSSMLLLRDRSKLRDAFSTGLPYMESPCSVDHGGEVGLQGTRPAEVLKLWLGLRQLGIEGIGAVLESALERKAVLKRLLADDRLLVLDGGLHLLALRPRQDDPAGSASWTEQTRQLLMREGFLLSRPSYDGHYWLKVVLGNPHTTSSHLQQLAGLISQQLQ

SEQ ID NO: 20926 - protein, 223 aa, SYNECHOCOCCUS SP. WH 8102
VGFSKPMRPWSDRPIHDNGEPLVALPPTLLRLEPHPYVAAGAPYGPSADPFQLRSGVVDRLLAAQQDLQARQSDLLLAIFDAWRPLAVQAYMVEQAVTAEINRRGIDRADREQVAAVRQAVGRFWAPPSPDPSTPPPRSTGAAVDLTLASQSDGGPLAMGGEIDAVDVISEPDHYAAAAPDSEEALWHQRRKLLASVMQSAGFAQHPNEWWHFSHGDQLWAWR

SEQ ID NO: 20927 - protein, 565 aa, SYNECHOCOCCUS SP. WH 8102
LPKAEQRKLDSDYLREPLLSELANDLPNFSEDALQILKFHGSYQQDDRDKREKGKDKTWQMMLRLRSPGGRIPAQLFLALDELSDRLGDGTLRATTRQAFQMHGIPKADLKEVIGTIVRNLGSTLAACGDINRNVMAPAAPFEKGGYPAARRLADEIADLLSPEAAEGSYLDLWVDGDLSYRFSPPAAVRRARKRQLEPGVFSGSEAEPLYGDTYLPRKFKVAVTVPGDNSVDLLTQDIGLVAFTDPSGDLRGCNVYVGGGMGRTHNKEETFARIADPLGYVDAADVFDLLQAIVALQRDHGDRRIRRHARMKYLLEDRGIAWFRNELKANYFSRPLKGFRNEAKPKLLDYLGWHRQKAGLWFVGLPLLCGRLKGTMKQGLRAIVDTYQLEIRLTANQDLLLCNIGTAQRATIKAELAALGFDLPDAPPPLARHAIACPALPTCGLAITESERILPSVLERLDAQLRRLEIDKSVLIRMTGCPNGCARPYMAELALVGSGVNQYQLWLGGSANLQRLAQPFLQRMPLDELEQTIEPLLISWKQAGGRRSLGDHVEKLGDQAVSEL

SEQ ID NO: 20928 - protein, 410 aa, SYNECHOCOCCUS SP. WH 8102
MLRVAVIGGGPSGSCAAEILAKAGIQTWLFERKLDNAKPCGGAIPLCMVEEFDLPDDIIDRKVRNMKMISPSNREVDIKLDPLGYDDNAYIGMCRREVFDAYLRNRAADLGTTLVNGLVQKIDTGSNRQGPYTLHYADYSGGGPTGDQKTLDVDLIIGADGANSRVAKAMDAGDYNVAIAFQERIKLPAEEMTYYEDLAEMYVGTDVSPDFYAWVFPKYDHVAVGTGTMQQNQSLIKGLQKGIRERANKRLFKGEVIKVEAHPIPEHPRPRRVVGRMALVGDAAGYVTKSSGEGIYFAAKSGRMCAEAIVEISKNGTVIPTEKQIKSTYLKRWDRKYGATYAVLDILQRIFYRNDAAREAFVEMCDDRDVQKLTFDSYLYKRVVLMNPWQQMKLTLRTLGSLLRGEALAP

SEQ ID NO: 20929 - protein, 228 aa, SYNECHOCOCCUS SP. WH 8102
RQLVNRVSLDLSAGEVVGLLGPNGAGKTTTFNLVIGLLRPDAGVISLDGQVVSTLSMPKRARLGLGYLPQEPSVFRQLTVRQNLEIALDQTDLSPQHRRDRRDQLIEDFHLVAFVDRCGYQLSGGERRRCEVARALAVGAEGPRYLLLDEPFAGVDPLAVADLQDLIQALRSRGMGILVTDHNVRETLAITDRAYILNDGAILASGQSQTVADDPLVRRYYLGEAFQL

SEQ ID NO: 20930 - protein, 429 aa, SYNECHOCOCCUS SP. WH 8102
MHIAVVGLSHRTAPVEIRERLSIPEQTMETSLQSLRGHEQVLEASILSTCNRLEIYTLVRHPDLGVSAVSEFLSGHSGLATGELTPHLFNYHHEDAVDHLMRVAAGLDSLVLGEGQILSQVKKMMRLGQEHKSLGPILNRLLTQAVSTGKRVRSETNLGTGAVSISSAAVELAQLKLGQSRGLDQLVTLESEQIAVVGAGRMSRLLLQHLQAKGASGVVLLNRTVQRAELLAADFPDLPVQCRPLTDLDQCLSTCSLVFTSTAADDPIIDAARLEPLNRRSKLRLIDIGVPRNIAADAAAVDGVESHDVDDLQEVVARNQEARQAMAREAEQLLQQEAQQFLEWWDSLEAVPTINRLRSSMETIRVEELQKALSRMGPDFSARERKVVEALSKGIINKILHTPVTSLRAPQGRQERQQALRTVERLFSL

SEQ ID NO: 20931 - protein, 431 aa, SYNECHOCOCCUS SP. WH 8102
MKRVLAIILGGGAGTRLYPLTKMRAKPAVPLAGKYRLIDIPISNCINSNINKMYVMTQFNSASLNRHLSQTFNLSASFGQGFVEVLAAQQTPDSPSWFEGTADAVRKYQWLFQEWDVDEYLILSGDQLYRMDYSLFVEHHRSTGADLTVAALPVDPKQAEAFGLMRTDGDGDIKEFREKPKGDSLLEMAVDTSRFGLSANSAKERPYLASMGIYVFSRDTLFDLLDSNPGYKDFGKEVIPEALKRGDKLKSYVFDDYWEDIGTIGAFYEANLALTQQPTPPFSFYDEKFPIYTRPRYLPPSKLVDAQITNSIVGEGSILKSCSIHHCVLGVRSRIETDVVLQDTLVMGADFFESSDERAVLRERGGIPVGVGQGTTVKRAILDKNARIGSNVTIVNKDHVEEADRSDQGFYIRNGIVVVVKNATIQDGTVI

SEQ ID NO: 20932 - protein, 471 aa, SYNECHOCOCCUS SP. WH 8102
MSQSHFGLIGLGVMGENLVLNAERNGFSSVVYNRTYAKTEEFLNGRGQGRNIQGATDLQDFVGKLERPRRILMMVKAGPAVDAVVDQISPYLEEGDLLIDGGNSDYHDTERRVKELESKSFGFIGMGVSGGAKGALEGPSMMPGGTKASYDAIESLVNKMAAQVDDGPCVTYIGPGGSGHLVKTVHNGIEYGIEQILAEGYDLMKRVKGMNGEQMADVLAQWNATEELSSYLVEITEVCLRTKDPEDGADLVEKIMDQAGQKGTGLWTVVTALQMGASVPTIYASLNGRVMSSLKPERVAAESILKGPVIKDFDLGTPDDAMAPLMDATVLSCIASYAQGMELLRIASRDLDYSLQMPSIAQIWKGGCIIRARLLQRIQDAFAANPDLTNLMLDPWFADQINRRLPGLAKVVAGAAESGIPVPCFSSTLDYINSYRTGRLPQNLVQAMRDCFGSHTYQRVDKEGAFHTEWL

SEQ ID NO: 20933 - protein, 303 aa, SYNECHOCOCCUS SP. WH 8102
LITGASSGIGRLAAERLQQQGHRLTVICRSQQRADQTLGWLTGESRVLLADLADLDQVQAIGHALLEKDEALDGLLLNAGLQYAGHRQVRWSAQGLELTIAVNHLAHQRLVMDLLPLLLRSHAPRLVITASEVHNPASGGGRVGRPAGLGDLSGLKKHSEMVNGERPFDADKAYKDSKLCNLLMGRHLAERHPQLPVICWSPGLVIPRGRDGFFRNSREANPLGQALFGFVARDLLRLTEHPQRAAELLERLVLDPAMPSGFSYWSNTLLAPGRHRFERAETSAEAADEAKAARLWQVSEQLV

SEQ ID NO: 20934 - protein, 383 aa, SYNECHOCOCCUS SP. WH 8102
LSARAVGLKPSLTLAIGAQAKALQQAGRDICSLSAGEPDFDTPDFIVEATRQALRDGITRYGPAAGDPELRAAVAEKLSSGNGIAITPEQVLITNGGKQAIYNLFQVLLNPDDEVLLPAPYWLSYPEMAALAGAKVKLIPTQAEEGFRLDLAAVEAAISPRSRLLLLNSPGNPTGRVMKRQELEDVAELVRRHPQLLVMSDEIYEFLLAEGEQHHSFAAIAPDLADRCFTVNGFAKGWAMTGWRLGYLAGHQDVIKAAAALQSQSTSNVCSFAQRGALAAIQGPRACVSAMAESYNRRRQLLTEGLQAIEGITLVEPRGAFYAFPQLPESAGGSMDFCSRALEQAGLAVVPGLAFGNDRCIRLSCAVSRETIRDGLSRLTQLL

SEQ ID NO: 20935 - protein, 568 aa, SYNECHOCOCCUS SP. WH 8102
KPKSVSYSSLLEQIRNGDVSTLELVPARREVRVTYPDGTKSTVSIFVNDQQILRAAEASATPLTVRDIRGEQAMAGLLGNLGLVLLLVVGLSFLLRRSAQMANRALGFGRSQPRLKPQEDLQVRFEDVAGINDAKEELEEVVTFLKQPESFTGLGAKIPRGVLLVGPPGTGKTLLARAIAGEAEVPFFSMAASEFVELFVGVGASRVRDLFRQAKEKSPCIVFIDEIDAVGRQRGAGIGGGNDEREQTLNQLLTEMDGFADNSGVILLAATNRADVLDAALTRPGRFDRRIDVSLPDRRGREEILGVHARTRPLDPEIDLTAWARRTPGFSGAELANLINEAAILTAREQQPFISDRQLEGALERITMGLSAKPLQDSAKKRLIAYHEVGHALVAALLPAANKLDKVTILPRGAAGGYTRFMPDEEKLDSGLITRASCLADLVVSLGGRAAELVVFGPLEITQGASGDLQMVSQLAREMVTRFGFSSLGPVALEGPGTEVFLGRDWFSQRPGYAESTGQAIDTRVRDLAKQSLDQAVALLESRRDVMDRLVDALMEEETLHHDRFMEL

SEQ ID NO: 20936 - protein, 193 aa, SYNECHOCOCCUS SP. WH 8102
CLRVGQQAPDFTATAVVDQEFKEISLSQYRGKYVVLFFYPLDFTFVCPTEITAFSDRYADFSSKNTEVLGVSVDSQFSHLAWIQTPRNQGGLGDINYPLVADLKKEIATAYNVLDDAEGVALRGLFIIDPDGVIMHSTINNLPVGRNVDETLRVLQAFQYVQSNPDEVCPANWTPGEKTMKPDPKGSKEYFSA

SEQ ID NO: 20937 - protein, 1214 aa, SYNECHOCOCCUS SP. WH 8102
MHRLASCPGIDPPEDLVLVEQPPADVLLLSSAGTDLSCLEAVVQASPDWNSRIRALHLDNLSHPAQLDHYLASTATQARLIVVRLLGSRGHWSYGLEQLQRWSEEVADRQLLVLAGTVDQQGDLRGIGTVVPALADRLAALLREGGETNMARLLDAIQALLDGTPPDSEEIEVAPLADPFPWDWQDDPGATVGVVLYRAQLQAGDTALAQHLNQALRERGLRPRLIWVSSLRDPAVQAGVLDLLRSQGAQVVISGTAFASVTTEQAGLGSALWDSLDRPVLQLLTAGTSRERWQQSSRGLEPLDLSLQVVMPELDARVTTRPCAFRQARPPLSGLATAITTQQPDRDGINWLVEHAACWIDLQDTPAKHRRMAMVLANYPVRDGRVANGVGLDTPASVVNIIGWLADAGYQLGEHPIPSNGDRLIASLLAGRTNSAEGRYRPPLDHLPLETYQAWWDTIPSEAKARIVSRWGEPQQACDLDGERGFAIHGLRYGHLVVLLQPDRGYDPDQIADLHSPDLPPPHRYLAQYLWLREVHGSQVMVHVGKHGSAEWLPGKGVGLSAACGPNLALGALPHLYPFIVNDPGEGSQAKRRGHAVVLDHLTPPLGRAGLHGGLQKLEGLLDELVEARQLGGERTQVLETQVLSTLQDLDWPEIPSRRELKKNPDRLNSCLDQAETYLCELKESQIRTGLHRYGQCPDDAAMTELLMALARPPLQGQPGLTQLMAREAGLEFDPWSQDDGESLDPADRARLAALGCQRCRRVGDGSAWLEQQGLLILRQLVLHEQAVDLATPFRSLVETSAPLRQRCLELWKRLQACDEAERQGLMRGLEGRRIAAGPSGAPSRGRPDVLPTGRNFYSVDLRGLPTEAAWDLGRRSAERLLDLHLQDEGEPLRHLALSVWGTATMRNGGEDIAQLLALIGVRPVWDGPSRRLVDLEVIPADLLGRPRVDVVLRISGLFRDAFPQLVSWVNQAQQMVALLEEPEEINPLASLTRRDGPQGRIYGSAPGAYGAGLQALIDSGAWESRRDLGEAFLCWSQWRYDGSAEPVADRSGLEQALSSVQVVLHNQDNREHDLLDSDDYYQFHGGLSAAAEQVSGQRPQLWFGDHSRRERPRLHRLEKELDKVMRSRMLNPRWIEGMQQHGYKGAFEMGASLDYLFAYDAATDRVPDWCYGAVCDRWLADPVNQTFLSDRNPWVLRDMSERLLEASNRGLWT

SEQ ID NO: 20938 - protein, 277 aa, SYNECHOCOCCUS SP. WH 8102
LQFSKYQGLGNDFLILEGRQGQLPQSVVEPDPVWVRQLCDRRFGIGGDGVILALPPQGQGDLRMRIFNADGSEAEMCGNGIRCLARFLADSDGDAPGKRWAIETPAGLIRPELQSDGQLRVDMGAPFLEPSSIPTTLPLVDGLARGSADLADRALEVAAVGMGNPHVVVPVEDLNAIPFDAWGAALEVHHLFPAKTNVHFLQVHARNRLEIRVWERGAGPTLACGTGACATLVAAVLLGLADDHAEVMLPGGPLQIAWPGRHGAVLMTGPAVAVFDG

SEQ ID NO: 20939 - protein, 519 aa, SYNECHOCOCCUS SP. WH 8102
DAQIQWQRFCDLLWYHEDLGIWLDISRMHVNPSHLEQLQPGFDKAFAAMAELEAGAIANPDEQRQVGHYWLRTPQLAPNEAVRDQIATEIDQIDQFGRDVISGVIKAPGGQPFTDVLWIGIGGSGLGPLLMIRALQGHGSGLPFHFFDNVDPNGMSAVLAELDDRLATTLVVTVSKSGGTPEPHLGMEQARHRVESRGGRWADQAVAITMVDSKLDREAQQDGWLKSFSMFDWVGGRTSITSAVGLLPGALIGADIRDFLAGAAQMDDATRLADLRRNPAALMAASWFVAGDGKGRRDMVVLPYRDRLEVFSRYLQQLVMESLGKRLDRDGNEVNQGIAVYGNKGSTDQHAYVQQLRDGVDNFFATFIEVLEDVSDIPVIKDECPGDFLDGFLQGTRSALTEGGRQSLSISMRRFDARRLGALIALFERAVGFYGDLVNINAYHQPGVEAGKKAAAAILDLQSRVEAVLKDGAPRTVSEIRQAVGDGSDEAIFWIMRHLAGNDRGYRAEGDWANPASIR

SEQ ID NO: 20940 - protein, 357 aa, SYNECHOCOCCUS SP. WH 8102
MAGGGQGRVAVIGASGYGGLQTIRLLQDHPSLTVTFLGGERSAGRRWSSICSFLPLPEDPVVQSADAERIAAAADYAVLSLPNGLACQLAPELLQRGVRVVDLSADFRYRSLEQWSQVYAQEANRLSREDSELCQQAVYGLPEWHGPAIAEARLVAAPGCFPTASLLPLLPFLKQGLIDTDGIVIDAKTGTSGGGRVPKEAMLLAEASESIAPYGVIGHRHTSEIEQMAREVAGQDVRLQFTPHLVPMVRGLLSTVYARLRDPGLTAEDCTTVLEAVYRHHPCVSVLPVGTYPATKWARHTNRALVSVQVDTRTGQMILMSAIDNLIKGQAGQGVQCLNLMHGLPPETGLPLQSFYP

SEQ ID NO: 20941 - protein, 772 aa, SYNECHOCOCCUS SP. WH 8102
  unsure (1)..(772): unsure at all Xaa locations
MGRIVGIDLGTTNSVVAVLEAGRPHVIANAEGGRTTPSVVGYSKDQELLVGQLARRQLVLSPRNTFSNLKRFVGRDWEELEDSSLAVPYTVRANDRGQVRVPCPVTEREYAPEELVASIIRKLVDDASTYLGESVEAAVVTVPAYFNDAQRQATRDAGRLAGIAVERILNEPTAAALAYGFDRSAVRRVLVFDLGGGTFDVSLLRIANGVFDVKATNGDTQLGGNDFDQRIVDWIADAFQAEHGVDLRRDRQALQRLTEAAEKAKQELSGVLTTPISLPFIATGENGPLHVETNLDRSTFEGLCPDLLDRLLMPVQSALRDSGWAADDIDDVVLVGGATRMPMVQQLVRTLVPLDPCQSVNPDEVVAIGAAVQAGILTGELRDLLLNDVTPLSLGLETVGGLMRVLIPRNTPIPVRQSDVFSTSEPNQSSVEIHVWQGERQMASDNKSLGRFRLSGIPPAPRGVPQVQVAFDIDANGLLQVSATDRTTGRKQSVSIQGGSNLNEDEVTALLAEAEARADEDRRKRNQIERRNRAQTLVAQAERRLRDAALELGPYGAERQQRAVEMAMRDVQDCLAQDDLQELDLCLSGLEEALFGLNRRLSAERQSDGRPLQGLRNTLGSLKDELFADDWDDDPWAAPSGPPRGRSLNRRDRDPWDDDFYRXSXLLVAAWFRSGGGCRPVETGLPSGSAPLASGPQRQRSRCRGAVQAGQXGLCGAQXSPPPPGWEHGDREGRRDRDPFEQGFPDFEDYLEVVLGESSRRSESPPPERNDP

SEQ ID NO: 20942 - protein, 627 aa, SYNECHOCOCCUS SP. WH 8102
EQGQIQIHTENIFPIIKKAVYSGHEVFLRELVSNGVDAISKRRMAAMAGDCSEGEDGVIRITVDREAKTLTIADNGIGMTADEVKRYINQVAFSSAEDFLEKYKQEGDAIIGHFGLGFYSSFMVAEQVELVTRSARPDSEAVRWSCDGSPNFSLSSAERDQPGTDVILTLMEEELEYIEPARIRTLINTYCDFMAVPVQLEGETVNKMNAPWRKSARELTDKDYIDLYNYLYPFQGDPLLWVHLNTDYPYNLQGILFFPKQTGRADWEKGEIKLYCNQVFVSDSIKEVVPRYLLPLRGVLDSPDIPLNVSRSALQTDRRVRSIGNFVAKKVADRLRNVKKDDPTAYAEAWESLAPFVKIGAMEDDKFADQVAELILFATSASAADGDTPDPISTGDRAFTTLEGYRSRLDSNNDKRILYSTDDVAQAGALNLWTSQGMEVLKLETVIDTQFIPWLEQRHEDLTFQRVDAELDDSLKDIDAEITDQDGTTESDRLRDLIKTALSNDKVTVQVQALKAEGAPPAMILLPEQMRRLNDMGALMEQRLPGLPDHHVLLVNKRHPLVEGMLKLKAGSVLIGDAQSSPTEALAQDIARHVYDMARLGVGGLEPNELSGFQTRSAELMGTLMQR

SEQ ID NO: 20943 - protein, 482 aa, SYNECHOCOCCUS SP. WH 8102
SSFVILYHRTPFDEAKDAQGNQVWVDQKSPNGIIPTLRNLFRSRNDGTWIAWRHVDHPEEMDVERLEMTNPSPFALCRIPLADEQISSFYHITSKECFWPILHTFPTHFNVNNANWGIFEEVNKRFADAACNEAAEGATVWVHDYNLWLAPGYIRQQRPDLKIAFFHHTPFPGNDVFAILPWREQILESLLCCDVVGFHIPRYTENFARAASTLVGAKRGPKISVDQKFISVGTALSEGTVTSHLDHNGRRIQLLSSPVGTSPDVIQELSWSASVESYGEMIVQDTKKGRKLILSASRVDYTKGNEELLLAFERLLERREDLHGEVVLMLACVAAASGMKIYEETQRSIEEMAGRINGRFSQVDWIPVRFSTRRIPYEEMVAWFCHADVCWITPLRDGLNLVAKEYAAARRHRGGVLVLSEFTGASVVLEGAVLTNPYSNRRMDEAIEAALAMPEHEQRQRMETMSAAVEAYTVQDWAEEQL

SEQ ID NO: 20944 - protein, 380 aa, SYNECHOCOCCUS SP. WH 8102
VLIAGAGPAGASLAVQLAEVGWEVTLADALPSPERNAYSSAALPLADADRLGIPGACRSASWWGWQLLDPDGLEHQWWAADPQGVVLDFAVFRRHLWDQARQTGVELLNGCQVQLDRLEARSADLILTSTDQQQHRTVDLVVDATGPGRHLLKQAGVPVETTDDPLLKGDGVEWLLQGDRGNTARWRERVSFMLGREWMPHGYGWVFPMAQDRLKVGVCRLAPPDQPKVPLGTSLRRLLKRCDLDRLPVLDRHGGRVASTIRQQQPHGTGALWAVGDAAGTANLLGGEGIRHAIDSASVLSECLLLGRSHRGYQAALRQRYGWRWAVSNRLARRTWWGLNTPKADHRMQRLIHGLSGQASAEDLSELFFGYRFERYGWRL

SEQ ID NO: 20945 - protein, 637 aa, SYNECHOCOCCUS SP. WH 8102
MHLGDLTHPNELHGLKLSELEDVARQIRDRHLQVVSTSGGHLGPGLGVVELTLALYQTLDLDRDRVIWDVGHQAYPHKLITGRFNDFHTLRQQNGVAGYLKRSESNFDHFGAGHASTSISAALGMAMARDNRGEDFKCVAVIGDGALTGGMALEAINHAGHLPETPLLVVLNDNDMSISPPVGALSNVLNRARLSPPMQFLSGSVEESVRHLPFMGGELPAELNRLKGSMRRLAVPKVGAVFEELGFTYMGPIDGHDIGEMMRTFQAAHRDGGPVLVHVVTKKGKGYPYAEADQVGYHAQSAFDLTTGKAIPSKKPKPASYSKVFGQTLVKLCEQNSRVVGITAAMATGTGLDLLQKAVPNQYVDVGIAEQHAVTLAAGMACEGLRPVVAIYSTFLQRAYDQLIHDVGIQNLPVTFVLDRAGIVGADGPTHQGQYDISYMRSIPNFTVMAPKDEAELQRMLVTCLNHDGPTALRIPRGSGVGMPLMEEGWEALPIGRGELLREGDDLLIVAYGSMVHPALDTATLLEEAGLSTTVINARFLRPLDQALIHPLARRIRRVVTMEEGALAGGFGAAVLESLSDQDISIPLLRIGIPDKMVDHATPQQSKESLEMIPVQMAERIRRRFDLGGRDFAGAAS

SEQ ID NO: 20946 - protein, 469 aa, SYNECHOCOCCUS SP. WH 8102
RRTKIVATIGPATESSERIKELVQAGATTFRLNFSHGDHSEHAARISTIRQVSEELGINIGILQDLQGPKIRLGRFAEGPITLANGDSFSLTSRPVSCNQSIATVTYDKLADEVTAGSRILLDDGRVEMKVEQVDQAEQTLHCTVTVGGVLSNNKGVNFPDVQLSVRALTDKDKVDLEFGLSQGVDWVALSFVRNPSDMEEIRGLIREHGHETPVVAKIEKFEAIDQIDAILPLCDGVMVARGDLGVEMPAEEVPLLQKELIRKANSLGIPIITATQMLDSMASSPRPTRAEVSDVANAILDGTDAVMLSNETAVGDFPVEAVQTMATIACRIEKDYPQRSVDSHLASTVPNALSGAVSTIASQLNASAILPLTKSGATAKNVSKFRPASPILAITPDPTVACRLQLVWGVKPLVIPQHELTTHTFLAAMTQAKTMGLLKEGDLVVQTAGTHTGVSGSTDLVKVGIVSS

SEQ ID NO: 20947 - protein, 622 aa, SYNECHOCOCCUS SP. WH 8102
MNQRWRLVALWLLPIGVVLLIGWQVISNGGLNSQNAGGTTVAPRNAAVARMSYGRFLDYVEAGRVTAVDIYDGGRNAVIEAVDPDLDNRVQRLRVDLPGLAPELVNTLKEEGISFDIHPPRTAPPALGLLGNLLFPLLLIGSLIFLARRNSGMPGGPGQAMQFGKSKARFMMEAETGVMFDDVAGVAEAKQELQEVVTFLKQPERFTSVGAQIPRGLLLVGPPGTGKTLLAKAIAGEAGVPFFSLSGSEFVEMFVGVGASRVRDLFKKAKENSPCLIFIDEIDAVGRQRGAGIGGGNDEREQTLNQLLTEMDGFEGNSGIIIIAATNRPDVLDSALMRPGRFDRQVTVDAPDIKGRLSILEVHCRNKKLEEELSLESIARRTPGFTGADLANLMNEAAILTARRRKEAIGLSEIDDAVDRIIAGMEGRPLTDGRSKRLIAYHEVGHALIGTLVKDHDPVQKVTLIPRGQAQGLTWFSPDEEQTLVTRSQLKARIMGALGGRAAEDVVFGHEEVTTGAGGDIQQVASMARQMVTRLGMSDLGPVALEGGGQEVFLGRDLMSRNDISESISQQIDAQVRQMVKRCYEETVDIVAANREAMDRLVELLIEKETMDGGEFAAVVAE

SEQ ID NO: 20948 - protein, 354 aa, SYNECHOCOCCUS SP. WH 8102
IAVALERNPYEVVIGAGGLSRLGDELLKAGIQPGRRILVVSNPDVAAPYGEGCLQSLRQQGFHADLLVIDAGEERKTPATVAAIHDSAFEQRLERSSLMLALGGGVVGDMTGFAAATWLRGIQVIQVPTTLLAMVDAAIGGKTGVNHPGGKNLIGAFHQPSLVLIDPETLNTLPEREFRAGMAEVIKYGILGDPALFQCLEEGPEPNSAAGLGNSRLETILERSAAAKARVVAADEREGGLRAVLNYGHTFGHVVETLCGYGTWLHGEAVAIGMVAVGQLAVNRGSWTADEAGRQTQLIQRCGLPTAWPDLDPDAVLRTLQGDKKVKDGRLRFVLPMAIGRVEIRDDISRDEIL

SEQ ID NO: 20949 - protein, 381 aa, SYNECHOCOCCUS SP. WH 8102
PSEGTQALEKERKLPLTGWQQEVDQAKRLGLEAAESIVDRNISTFSRGELPHFAGINTFMKAPYLEDVNQVGNYDVAIVGVPHDCGTTYRPGTRFGPQGIRRISALYTPYNYEMGVDLREQITLCDVGDIFTIPANNEKSFDQISKGIAHVFASGAFPIILGGDHSIGFPTVRGVCRHLGDKKVGIIHFDRHVDTQEIDLDERMHTCPWFHATNMANAPAENLVQLGIGGWQVPREGVKVCHERGTNVLTVTDITEMGLEAAAQYAIERATDGTDCVYISFDIDCIDAGFVPGTGWPEPGGLLPREALKLLELIVRNVPVCGLEIVEVSPPYDISDMTSLMATRVICDAMAHLVVSGQLPRKDKPAWISDVCNMNVDQKWR

SEQ ID NO: 20950 - protein, 433 aa, SYNECHOCOCCUS SP. WH 8102
MTTVPEPSAELLQRAGAVRLAAVDLGQTDDQQRADALQAMADALAERAEVIVAANREDLERSAAEGLAPALMARLKLDAGKLRGAIDGVRKLASLPDPLGRRQLHRELDQGLVLERISVPLGVVGVIFEARPDAVVQIASLAIRSGNGAMLKGGSEARCTNEAVMEALKLGLGRSAVAPDALTLLTTRQESLALLRLDGLVDLIIPRGSNELVRFIQDNTRIPVLGHADGICHLYVDAAADVDQAVRIAIDSKTQYPAACNAIETLLVHASIAPAFLASAVPAFQAAGVTLRGDEHSRQHGISDAATDEDWRTEYLDMILAVRVVPSMDAALEHIRRHGSRHTEAIATTDDQAAERFLGAVDSAGVYLNCSTRFADGFRYGFGAEVGISTQTLPPRGPVGLDGLVTYRYRLRGDGHIAADFADGTRSFTHTDL

SEQ ID NO: 20951 - protein, 756 aa, SYNECHOCOCCUS SP. WH 8102
SRPLHSSSMGGAAVLDWMVQDGERLANCRHDHPLAILGPQPSDAGWTVRVWMPEAHSVTLLEGGREALMTAPNHPWVFETTLSHDPGSNYKVRVERGGITHEQHDPWAFRDEWMGDMDRHLFAQGNHHHIWQRMGAHLTQRDGISGVMFCLWAPHALSVSILGDLNSWDGRHHPMQQRLGGIWELFIPGLAEGSLYKYEIRTQDGHCYQKADPYGFQHEVRPDNSSVVARLDGFQWSDGSWMQRRDSSNPLEQPISVYEMHLGSWIHASAEEPWIQPDGSPRAPVPAADMKPGARLLTYAELAARLIPYVKERGFTHIELMPITEHPFDGSWGYQVTGWYAPTSRYGTPDEFRAFVDRCHAEGIGVIIDWVPGHFPKDAHGLAFFDGTHLYEHGDPRIGEHKEWGTLIFNYSRNEVRNFLVANLVFWFEQFHIDGIRVDAVASMLYRDYLRPDGEWLANEHGGRENTEAVQFLQQANHVLFQHFPGALSIAEESTTWPMVTQPTEIGGLGFNLKWNMGWMHDMLDYFELDPWFRQFHQNNITFSIWYTYTENFMLALSHDEVVHGKSHLLHKMPGDDWQKYANTRALLAYMWTHPGKKTIFMGMEFGQRAEWNVWGDLQWDLLNYEPHKGIQLLVDDLNTLYKAEPALWRDDFDQFGFQWIDCNDNRHSVISFMRRESSSGTWLVVVANFTPQSHSHYRVGVPLAGFYEEIFNTDAARYGGSNLGNMGGKPTDEWSIHGYENSLDLCLPPLSLLVF

SEQ ID NO: 20952 - protein, 343 aa, SYNECHOCOCCUS SP. WH 8102
SDTLPLLLRAARGEAVERPPVWMMRQAGRYMKIYRDLRDKYPSFRERSENPDLSYEISMQPFHAFKPDGVILFSDILTPLPGMGIDFDIIESKGPQIGDPIRSMDQVNALRPLNPSESMPFVGEVLGRLRESVGNEAAVLGFVGAPWTLAAYVVEGKSSKNYAVIKAMAFREPELLHKLLDHFAESIANYLRFQIDSGAQVVQMFDSWAGQLSPADYDTFAAPYQKKVVDLVKQTHPDTPFILYISGSAGVLERMATTGVDIISLDWTVDMGEALARLPEHIGVQGNVDPGLLFGTPDAIEARIDDCVRKARGRKHILNLGHGILPGTPEENGAAFFRSGKSV

SEQ ID NO: 20953 - protein, 862 aa, SYNECHOCOCCUS SP. WH 8102
MQPTAEQFTEQAWAAIVAAQQLAQASRHQQLETEHLLLALLRQNGLAGRILSKTGVDVTTFEASVEGHLQRLPSLGSAPDSVFLGRSLNKALDRAEQRRDGFGDSFIAIEHLLLALAEDDRCGRQLLSQAGVTTNTLKEAITAVRGNQTVTDQNPEATYESLAKYGRDLTAAARDGQLDPVIGRDEEIRRTIQILSRRTKNNPVLIGEPGVGKTAIVEGLAQRIVNGDVPQALQNRQLITLDMGALIAGAKYRGEFEERLKAVLKEVTTSDGQIVLFIDEIHTVVGAGASGGAMDASNLLKPMLARGELRCIGATTLDEHRQHIEKDPALERRFQQVLVDQPTVPDTISILRGLKERYEVHHGVRIADSALVAAAMLSSRYITDRFLPDKAIDLVDESAARLKMEITSKPEQIDEIDRKILQLEMEKLSLGRESDSASQERLQRIERELAELGEQQSSLNAQWQSEKGAIDQLSALKEEIERVQLQVEQAKRNYDLNKAAELEYGTLATLQRQLQEQEDLLEDEDGTDKTLLREEVTEDDIAEVIAKWTGIPVARLVQSEMEKLLQLEDDLHQRVIGQNQAVTAVADAIQRSRAGLSDPNRPIASFLFLGPTGVGKTELSKALANRLFDSDDAMVRIDMSEYMEKHTVSRLIGAPPGYVGYEAGGQLTEAVRRRPYAVILFDEVEKAHPDVFNVMLQILDDGRVTDGQGRTVDFTNTVLILTSNIGSQSILELAGDPEQHTAMEQRVNEALKAKFRPEFLNRLDDQIIFRSLEKEELRRIVSLQVERLRSRLEQRKLDLQLSDIAADWLATIGFDPVYGARPLKRAIQRELETPIAKAILAGQLSEGQTVQVDAGDDKLSIS

SEQ ID NO: 20954 - protein, 214 aa, SYNECHOCOCCUS SP. WH 8102
PLSPAFIDQLRFNEAGLIPAIAQDWLDGAVLMVAWMNRESIQQTLNSGEAHYWSRSRQELWHKGATSGHTQTLRSIRYDCDADVLLLTIEQRGDIACHTGARSCFYEGGDQRSDGGSNALSPPADACTELFRVIESRRDNPEEGSYTNKLLEGGDNKILKKIGEESAEFVMACKDDNPEEIAGEAADILFHMQVALAHHGVSWRQVQEVLAARR

SEQ ID NO: 20955 - protein, 601 aa, SYNECHOCOCCUS SP. WH 8102
  unsure (1)..(601): unsure at all Xaa locations
RRSARLQPLPEPPDERHQXWKRVRRLGRYLVHDRRRLLLTLVLLVPLAVAGAIQPLLVGQAISVLRNEPSLPWLEGLTTGAAIRLIVSLLLVSVLLRLALQGVQLFNIQAVGQRLTARIRDDLFRHALSLSLRFHDGMPVGKLLTRLTSDVDALSEVFGSGAVGVLGDLVSLVVIASSMLLIEWRLGLLLLCTQIPVTLMVIWLQGRYRKANYRVREELSQLNADFQENLQGLEVVQMFRREQVNGERFQRTGSAYRRAVNGTIFFDSSISAFLEWVSLGAVALVLALGGWMVTSGSMGLGILTTFILYSQRLFDPLRQLAERFTQIQGGLTAVERIGELMEQPLEIVEDPNATPLRSAGLGEVIFENVSFSYRPDEPILRNLSFRIAPGEHVALVGPTGSGKTTVIRLLCRLYEPQQGRILLDGRDIRSISIADLRRQLGVVLQDTFLFSGNVADNLRLNAEISDQELAGICRDLGLNDLLQRLPNGLETELRERGGNLSSGERQLLAVARVAIRNPTVLVMDEATAFMDPSTEATLQRDLDRLLQKRTAVVIAHRLATVEASDRILVLRRGELIEQGTHLELRARGGLYAQLAELQEKG

SEQ ID NO: 20956 - protein, 305 aa, SYNECHOCOCCUS SP. WH 8102
LSPLSGRDYLSSADCSAEETSAVLDLAAQLKSGDRRIDLGNRVLGLIFTKASTRTRVSFQVAMARLGGQTVDLNPKVTQLGRGEPLEDTARVLSRYCDVLAVRTFAQQELVDYAHWATVPVINALTDLEHPCQSLADFLTMREAHGDLPGQTLAYIGDGNNVAHSLMLCGALLGVNVRIGCPQGFEPLPGVLEQARSLAVQGASIEVIHDPREAVRGAQAVYTDVWASMGQEDEQSEREQAFAGFCVDEALMEAADTEAIVLHCLPAHRGEEISPGVMESSASRIFDQAENRLHAQQALLAALMG

SEQ ID NO: 20957 - protein, 614 aa, SYNECHOCOCCUS SP. WH 8102
RPNRRFGIINLVLIGFGVLLLLSSFVPNNAMQQVPKVPYSLFLDQVNDGAVKRAYITQEQIRYELSDPDEGTPPVLATTPIFDMDLPQRLETKGVEFAAAPPKKPNIFTTILSWVVPPLIFILVLQFFARRSMGGGAQGALSFTKSKAKVYVPDEESRVTFADVAGVDEAKQELTEIVDFLKTPERYAEIGARIPKGVLLVGPPGTGKTLLSKAVAGEAGVPFFIISGSEFVELFVGAGAARVRDLFEEAKKKAPCIIFIDELDAIGKSRSGSMGVVGGNDEREQTLNQLLTEMDGFTAQDKPVIVLAATNQPEVLDAALLRPGRFDRQVLVDRPDLSGRKTILEIYAKKVKLADAVDLDSVAQATSGFAGADLANLVNEAALLAARAYRTKVEQQDLGEAIERVVAGLEKKSRVLQDDEKKVVAYHEVGHAIVGHLMPGGSKVAKISIVPRGMSALGYTLQLPTEERFLNSKEELQGQIATLLGGRSAEEIVFGKITTGAANDLQRATDLAEQMVGTYGMSDTLGPLAYDKQGGGRFLGGNNNPRRSVSDATAQAIDKEVRGLVDRAHDDALAILRQNMALLETIAQKILEKEVIEGDDLKQMLEASVLPETV

SEQ ID NO: 20958 - protein, 326 aa, SYNECHOCOCCUS SP. WH 8102
LTDQLDALEQQATTEISEASDAAALEQLRVGLLGKKGRISGVLWAMGKLPGSERPLVGQRANVLKTQVQSLLAERLAAVKQAAMAERIARESIDVTAPASGIPMGHRHPLITTTEEIVDLFLGLGYSVAEGPEVEKDYYNFTALNIPEDHPARDMQDTFYLQGDLLLRTHTSPVQIRHLEQNPPPVRIVAPGRVYRRDAVDATHSPVFHQVEVLAIDEGLDFSHLRGTVMAFLKAFFGDLPVRFRASYFPFTEPSAEVDVQWRGRWLEVMGCGMVDPAVLEGLGLDPERYSGFAAGLGVERFCMVRHGIDDIRRLYTSDLRFLEQF

SEQ ID NO: 20959 - protein, 324 aa, SYNECHOCOCCUS SP. WH 8102
VDRETGLELFRDMTLGRRFEDKCAEMYYRGKMFGFVHLYNGQEAVSTGVIGAMKRQHDWFCSTYRDHVHALSAGVPAREVMSELFGKETGCSKGRGGSMHLFSKEHHLLGGFAFIAEGIPVALGSAFTSRYKRDALGDASSNAVTAAFFGDGTCNNGQFFECMNMAQLWKLPILFVVENNKWAIGMAHDRATSDPEIWRKAASFGMAGEEVDGMDVLAVRAAAQRAVERARAGEGPTLLECLTYRFRGHSLADPDELRAEQEKQFWAQRDPLKALERDLCEANLVSSDELRSIEKEIDAIVQDCVEFALSAPEPDPTELTRYIW

SEQ ID NO: 20960 - protein, 460 aa, SYNECHOCOCCUS SP. WH 8102
DFDVIVIGAGYGGFDAAKHAAEHGLKTAIIESRDMGGTCVNRGCVPSKALLAASGKVRELADDQHLASFGIHAAPVRFERQKIADHANQLVQTIRTNLTKTLERAGVTILRGHGRLEGSQRVGLREPSGVDRVLSARDVIVATGSDPFVPPGIETDGRTVFTSDEAINLEWLPRWIAIVGSGYIGLEFADVYTALGCEVTMIEALDRVMPTFDPDIAKIAGRHLIDGRDIDARSGVLASKVTPGCPVRIDLADFNSRELVETLEVDAVLVATGRVPSSKGLNLESLNIETNRGFVPIDDSMRVLVNGQPVPHLWAVGDVTGKLMLAHTAAAQGTVAVDNILGQNRTIDYRSIPAATFTHPEISSVGLTEAEAKQLAETDGFQLGSVRSYFKANSKALAELESDGLMKLLFNKSSGEVLGAHIYGLHAADLIQEVANAVARRQSVRQLSTEVHTHPTLSEV

SEQ ID NO: 20961 - protein, 415 aa, SYNECHOCOCCUS SP. WH 8102
LAIEGQRRLQGVLKVSGAKNSALVLMTASLLTEELVELINVPNLTDIAGMGRILSALGVQVEHSGNGVALNAGNLTSHEPPYELVNSLRASFFCIGSLLGRLGHARVPLPGGCRIGARPVVEHIRGLKALGAHVSVEHGIVSACVKGSKKRLTGAPIVLDCPSVGATETLLMAAVLATGTTTIENAAHEPEVQDLANLLIQMGADISGAGGPVITIHGVERLAGVSNYPVIPDRIEAGTFLIAAAITRSPLRVEPVIPEHLSAVLQKLRDCGCQLEIDQTGISITPGDIQAVDITTQPFPGFPTDLQAPFMALMATAQGTSVISEKIYENRLQHVAELQRMGASIRVDGSTAIVEGVAQLSAAPVTGSDLRAAAAMVLAGLAANGTTKVSGLKHLYRGYDKVEAKLNAVGAQLER

SEQ ID NO: 20962 - protein, 394 aa, SYNECHOCOCCUS SP. WH 8102
VMNTYNRFPLTLVRGRGCWVWDDQGRRHLDAVAGIATDTLGHSDRALRRSLGRQLRRLQHVSNLYRIPEQDALATWLVQHSCADSVFFCNSGAEANEAAIKLARKHGHLKRGIDRPRILTASASFHGRTLAAVSATGQPRYHQGFEPMVEGFDYFPYNDIHAFESLLERHEANGPAVAAVLLEPLQGEGGVHPGDAGFFQRLRHLCSERNILLILDEVQVGMGRSGRLWGYEQLGIEPDAFTLAKGLGGGHAIGALLVNAKADVFEPGDHASTFGGNPFACTAGLTVAQEIQRRGLLRNVEERGQQLQQGIQGLVARYPQLLQGVRGWGLLQGLVLHQDCGVTAPQLAKAAIEQRLLLVAAGATVLRMVPPLVISANEVRQLLRRLDATLAELV

SEQ ID NO: 20963 - protein, 254 aa, SYNECHOCOCCUS SP. WH 8102
VALRLIPCLDVARGRVVKGVNFVGLRDAGDPVELACRYSGAGADELVFLDIAASHEGRGTLIDMVHRTAESVTIPFTVGGGISTVEGITDLLRAGADKVSLNSSAVRRPELVREGAERFGCQCIVVAIDARRRDGDGWDVFVKGGRENTGLDAVDWARRVAELGAGEILLTSMDGDGTQAGYDLALTRAVADAVPVPVIASGGAGCIDHIAQALETGPDGGHASAALLASLLHDGVLTVEEIKQDLLARGLSIR

SEQ ID NO: 20964 - protein, 308 aa, SYNECHOCOCCUS SP. WH 8102
ARQLLGMKGASGTSNIWKLRLQLMKPVTWIPLIWGVICGAAASGNYQWKLDHVLAAFACMLMSGPLLAGFTQTINDYYDRDIDAINEPYRPIPSGAIPLGQVKLQIWLLLIAGLAVSYGLDIWANHSTPVVFLLALGGSFVSYIYSAPPLKLKQNGWLGNYALGASYIALPWWAGQALFGQLTWSTALLTLAYSLAGLGIAVVNDFKSVEGDRELGLQSLPVVFGIKTASWISAGMIDIFQLAMVAVLIAIGQHFAAVLLVLLIVPQITFQDIWLLRDPVEFDVKYQASAQPFLVLGMLVTALAVGHS

SEQ ID NO: 20965 - protein, 407 aa, SYNECHOCOCCUS SP. WH 8102
PTLLKESGPREVFCGLTSIVWLHRRMPDAFFLVVGSRTCAHLIQSAAGVMIFAEPRFGTAILSERDLAGLADAHEELDRVARELLQRRPEIRTLFLVGSCPSEVIKLDLARAAERLNDELQGRVRVVNYSGSGIETTFTQGEDGALAALVPLLPSSAERQLLLVGTLADAVEDRLIHLFGRLGIDRVRSLPPRQSTALPPVGPGTTVLLTQPFLTDTARLLRNRGATVLTAPFPLGAEGSRRWMEAAAQAFEVAPSHVATVLDPLMERARIALEPHREVLAGKRIFLLPESQLELPLARFLQRECGMELVEVGTPYLNREQMAEELALLPEGTPVMEGQHVELQLDRVRDSAPDLVVCGMGLANPLEAEGIATKWSIELVFSPIHGIDQAGDLAELFSRPLRRRQLI

SEQ ID NO: 20966 - protein, 524 aa, SYNECHOCOCCUS SP. WH 8102
MDLTLWTYEGPPHVGAMRIAASMQGVHYVLHAPQGDTYADLLFTMIERRGQRPPVTYTTFQARDLGGDTAELVKRHVREAVDRFQPDALLVGESCTAELIQDQPGALAQGMGLTMPVVSLELPAYSKKENWGAAETLYQLVRGLLKQQVPAEPKHDPKRWQQQGRRPRVNLLGPSLLGFRCRDDVLEVQTLLTMHGIDVAVVAPLGAGVEDVHRLPEADLNICLYPEVAESTCLWLERNFGMPFSRTVPIGVGATHDFLVEVHTALGLEPPSPQEGYRRSRLPWYSESVDSTYLTGKRVFIFGDGSHAIAAARICSEELGFQVVGLGTYSREMARPVRAAAKGLGLEALICDDYLAVEAAMAEAAPELVLGTQMERHSAKRLGIPCAVISTPMHVQDVPARMSPQMGWEGANVIFDSWVHPLMMGLEEHLIGMFRHDFEFVDGHQSHLGHAGGSGASQESALSDVPEADEGYVVWTADGEAELKKIPFFVRGKVRRNAEAYARQVGCREISSETLYDAKAHFKA

SEQ ID NO: 20967 - protein, 311 aa, SYNECHOCOCCUS SP. WH 8102
TVLITGTTSGVGLNATCALVKRGWTVITANRSPQRAAAAADDMDLPKERLQHVLMDLGDLDSVRRAVDALPDRLDAVVCNAAVYKPKLKQPERSPQGYEISMATNHLGHFLLVQLLLGRLQNSSHPSRRVVILGTVTANSKELGGKIPIPAPADLGDLSGFEAGFKYPVAMASGKPFKPGKAYKDSKLCNMISTQELHRRLHGESGITFTSLYPGCVADTPLFRNTPKAFQTIFPWFQKNITGGYVSQALAGERVADVVAHPDFAESGVHWSWGNRQKKDGQQFSQELSDKATDPDTARRVWDLSMQLVGL

SEQ ID NO: 20968 - protein, 234 aa, SYNECHOCOCCUS SP. WH 8102
PTALITGASRGIGRRTAELLARKGWDLKIVARSGDQLEQLAAELLPMGIQVDVRSIDLTDPHAIQPALTGLLEQGSPPAVLINNAGAAYKGDLLAMPLERWQWLMQLNVTSVMQVCAAVVPAMRATGGLVINVNSHAARNAFPQWGAYCVSKAALASFTRCLAEEERAHGIRACTLTLGAVNTPLWDTETVQSDFDRRAMLSVDQAAEALVNLAEQPVNQVIEDLTLMPAAGAF

SEQ ID NO: 20969 - protein, 391 aa, SYNECHOCOCCUS SP. WH 8102
MSRVGVVLLNLGGPERIQDVGPFLYNLFADPEIIRLPSPALQKPLAWLISTLRSGKSQEAYRSIGGGSPLRRITEQQARELQSLLRQRGLDATTYVAMRYWHPFTESAVADMKADGMDEVVVLPLYPHFSISTSGSSFRELQRLRQGDAAFEQLPIRCIRSWFDHPGYIKAMAELIAEEVRNSDDPEKAHVFFSAHGVPKSYVEEAGDPYQQQIEACTDLIMKSLAEHMGHSNPHTLAYQSRVGPVEWLKPYTEEALEQLGEAKTNDLVVVPISFVSEHIETLEEIDIEYRELATEAGVVNFRRVRALDTYPPFIEGLADLVTTSLEGPEVSLDAAAELPTKVKLYPQEKWEWGWNNSSEVWNGRLAMLGFSAFLLELISGHGPLHALGLL

SEQ ID NO: 20970 - protein, 362 aa, SYNECHOCOCCUS SP. WH 8102
DTLIVGSGAAGGAAAAHLAAAGHNVLVLERDAKPRIKPCGGGMAASVQQWFPFSLEPAVEQVIGRVDFSWCLEDPVVANLPGDAPFWIVRREKLDQLLVDQAIGAGAERLTGVEVVDICRSRDVWEVTASDGRRWQAKAVVIADGSNSPWPQRLGLGAKHPQLATTMSVRLEGQGNVADGSTRFEFGLVKQGFAWAFPIADGVNIGVGSFIGKQDADPDQVLAQLLPDLGFPADAGIRQRGKLRVWSGHHRLDGNGIVVVGDAASLCDPFLAEGLRPALMSGCEAARHLNQWLKGDSKDLQGYSRTMRKRWGESMAWGRRISQVFYRFPGVGYQLGIKRPTAPRRIAQILSGELGYGDIAQR

SEQ ID NO: 20971 - protein, 386 aa, SYNECHOCOCCUS SP. WH 8102
LLDQLSAMTVVVADTGDLEAIRKFTPRDATTNPSLILAAAQIPAYQSLIDEALRSSRKLIGDAAPVEDVVHEALDEISVIFGKEILKIVPRRVSTEVDARLSYDTDATIEKGRKLIRLYNDAGISNDRVLIKIASTWEGIKAAEVLEKEGIHCNLTLLFGFGQAVACAEAGVTLVSPFVGRILDWYKADTGRDSYPGPEDPGVISVTRIFNYYKTYGYKTEVMGASFRNLDEITELAGCDLLTISPKLLDQLRESDASLSQKLDATNPSGGEEQIHVDRERFDAMMAADRMATDKLGEGIKGFSKAIETLEHQLAHRLAELEGGEAFRHAVQEIFMLNDMNGDGCITRDEWLGSDAVFDALDLDHDGRLTPEEVRKGFGAALTLTT

SEQ ID NO: 20972 - protein, 409 aa, SYNECHOCOCCUS SP. WH 8102
VVVRYQGGVNAGHTIVVDDRVLKLHLIPSGILYPETICLIGSGTVVDPKVMLGELDMLIANDIDISGLQLASTAHVTMPYHRLLDLAMEKQRGDRRIGTTGRGIGPTYADKSQRSGIRVIDLLDEARLRERLEGPLQEKNQLLETIYGVEPLDAETVIKEYLGYGKRLAPHVVECTQAIHQAARARKNILFEGAQGTLLDLDHGTYPYVTSSNPVSGGACIGAGVGPTLIDRVIGVAKAYTTRVGEGPFPTELSGRLNDQLTERGGEFGTTTGRRRRCGWFDGVIGRYAVQVNGLDCLAVTKLDVLDELDAIQVCVAYELDGERIEHFPSSAEDFARCNPLFETLPGWQCSTEDCRKLEDLPDAAMAYLRFLADLMEVPIAIVSLGASRDQTIVVEDPIHGPKRALLSA

SEQ ID NO: 20973 - protein, 310 aa, SYNECHOCOCCUS SP. WH 8102
DVVGIGNAIVDVLVQTDDAFLAQHGLQKGGMALIDEQQAETLYTASGPGLETSGGSVANTMVGIAQLGGRAGFIGRVRDDQLGGIFSHDIRAVGARFDTPAATTGATTARCLIYVTPDAERTMCTFLGASTQLEPEDLDLSMVRDTKVLYLEGYLWDSPAAKRAFIAAADVCREAGGQVALSLSDGFCVDRHRESFLELVNGHVDVLFANEVEIKSLYETDDFDTALKKVGGCCSVIAVTRGGEGSVVLSGDQRWDIGIFGLGELVDTTGAGDLYAGGFLHGYTQGESLGRCGQLGALCAGQIVTQLGAR

SEQ ID NO: 20974 - protein, 283 aa, SYNECHOCOCCUS SP. WH 8102
ALRVSVLSEALPYIQRFSGRRIVIKYGGAAMAHAELREAVFRDLALLACVGVQPVVVHGGGPEINQWLKRLEIPAEFRDGLRVTDADTMDVVEMVLVGRVNKQIVNGLNQLGTRAVGLSGSDGSLVEARPWGDGSHGLVGDVARVNPDVLEPLLERGYVPVISSVAATPGDGRAHNINADTVAGELAAALEAEKLILLTDTPGILRDRDNPNSLIRKLRLSEARQLIDDGVVAGGMTPKTECCIRALAQGVSAAHIVDGRVPHALLLEVFTDAGIGTMVVGRG

SEQ ID NO: 20975 - protein, 316 aa, SYNECHOCOCCUS SP. WH 8102
LALSMALTELRIASRRSQLAMVQTNWVKAELEKAHPGLTITVEAMATQGDKILDVALAKIGDKGLFTKELEAQMLVGRAEIAVHSLKDLPTNLPEGLMLGCITEREDPADALVVNAKNANHKLDTLPEGAVVGTSSLRRLAQLRHHYPHLSFKDVRGNVITRLEKLDSGDYDCLILAAAGLERLGFGNRIHQIIPGDISLHAVGQGALGIECVEDKPEVLEIIKVLEHTTTSRRCLAERAFLRELEGGCQVPIGVNSQINNEELTLTGMVASLDGKRLIRDEASGSAADPESIGIELAGKLKHQGAGAILKEIFDE

SEQ ID NO: 20976 - protein, 261 aa, SYNECHOCOCCUS SP. WH 8102
IATWNVNSVRTRLEQVLCWLEQTKPDLLCLQETKVDDPLFPMQAFENAGWQVSIHGQKSYNGVALVSREPLEDVRCGFVGELPDDAEAATLGEQRRVISGLLDGVRVLNLYVPNGSSLSSEKYPYKLTWLGCLKRYLDAQAERGEPLCMVGDFNIALEARDIHDPDRLSGSVMASDAERDALREALGNRLQDAFRMFEPDAGHWSWWDYRTGAWDRDRGWRIDHIYLCEELMGLARSCSIHKQLRGNVQPSDHAPVSVDLD

SEQ ID NO: 20977 - protein, 459 aa, SYNECHOCOCCUS SP. WH 8102
LRRSLPQRAVVTKRQELLSYDCDGLTMDRHAPPLAVLPEDTGQVAAVLRCCHAHGIPFVARGSGTGLSGGALVDQQALLVITSRMRKVLEVDLDNQRLTVQPGVINSWVTRAVAGDGFYYAPDPSSQVVCSIGGNVAESSGGVHCLKYGVTSNHVLGLEVVLPDGTVTQLGNGLAESPELDLRGAFIGSEGTLGIATAITLRLLRAPECVNVLLADFATMAAAGEAVRSITAAGLLPAGMEIMDNVTINAVDDFFGYDEYPRDAAAVLLIELDGQAAEVQESAEQAELLCRQAGARGLRRAEDPGECAVLWKGRKSAFSAVGKITPTYYVQDGVVPRSTLPAVLAEIERLSQEHGLPVANVFHAGDGNLHPLILYSAADPEAERKVKELGAAILRVCLDAGGSISGEHGVGADKRCYLDWMFGPDDLDTMSLLRQAFDPEQRANPGKVLPTPRTCGESA

SEQ ID NO: 20978 - protein, 426 aa, SYNECHOCOCCUS SP. WH 8102
VTAPALNTSRSQAIFGAAQGLMPGGVSSPVRAFKSVGGQPIVFDRVKGPYAWDVDGNKYIDYIGSWGPAICGHAHPEVISALQEAIEKGTSFGAPCALENTLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKALFAENPDAIAGVILEPIVGNAGFIQPEPGFLEGLRELTKEHGALLVFDEVMTGFRISYGGAQAHFGVTPDLTTMGKVIGGGLPVGAYGGRADIMGMVAPAGPMYQAGTLSGNPLAMTAGIKTLELLKQPGSYEKLTATTEKLIAGIKEAATAAGLPFTGGSVSAMFGFFLCEGPVRNFEDAKATDSERFGKLHRAMLERGVYLAPSAFEAGFTSLAHSEADIEATVNAFR

SEQ ID NO: 20979 - protein, 476 aa, SYNECHOCOCCUS SP. WH 8102
VRVRLAPSPTGTLHIGTARTAVFNWLYARRQQGSFLLRIEDTDKERSKPEYTQNILEGLRWLGIDWDEEPLIQSEQVQQHRAAIETLLQKGLAYRCYANEAELDAMREAQKASNQAPRYDNRHRNLTPEQEAAFQSEGREAVIRFRIDDNAEIRWNDMVRGAMSWRGADLGGDMVVARRAPADQIGDPLYNLVVVVDDAAMAISHVIRGEDHIANTAKQLLLYEALDLPAPTFAHAPLILNAEGRKLSKRDGVTSINDFRTMGYTAEAIANYMTLLGWSVPEGMEERFTLPEAAAVFSFDRVNKAGARFDWDKLNWLNGQVLHALPAQQLLDDLRPLWAEQGWTLPDDSSWGLELCELLGPSLTLLKEGVEQATPFFKCPDLEDDGVRQLEADGARTAVAQLLQILEAEPWDGKDTDRAKQLLADAAKGAGVKKGVVMKSLRAALLGRLQGPDLITTWCLLARIGEDLPRLQRCLA

SEQ ID NO: 20980 - protein, 244 aa, SYNECHOCOCCUS SP. WH 8102
SLDGQTALVTGGGRGIGKAIALALAEAGAEVVVNYANSAGAADEVVASINAAGGKAYALKANVSIEEEVDGLIKAVLERSGRLDVLVNNAGITRDGLLMRMKTSDWQAVIDLNLSGVFLCSRAVARPMLKQKSGRIINITSVVGLMGNAGQANYAAAKAGVIGLTKSTAKELASRGITVNAVAPGFIATDMTKDLDADAILKDIPLGQFGTQEQVAGAVRFLAADPAAAYITGQVLQVDGGMVM

SEQ ID NO: 20981 - protein, 444 aa, SYNECHOCOCCUS SP. WH 8102
GDGTTTATVLAQAMVREGLRNTAAGASPVELRRGMEKAVAQVVDGLQQRSQPVAGDAIRQVATVSSGGDDEVGRMIAEAMDRVSADGVITVEESKSLATELEVTEGMAFDRGYSSPYFVTDADRQICEFENPLILLTDRKISAIADLVPVLEAVQKSGSPLLVLAEEVDGEALATLVVNRNRGVLQVAAVRAPSFGERRKAALADIAILTGGTLISEDRALTLDKVQLSDLGKARRVTISKENTTIVATDDHRAAVADRVAAIKRELDATDSDYDREKLNERIAKLAGGVAVIKVGAPTETELKNRKLRIEDALNATRAAIEEGIVPGGGTTLLQLADGLNGLVEQLEGDQRTGVEILQRALVAPVHHIATNAGHNGDVVIEAMRNSGQGFNALTGTYEDLMAAGIVDAAKVVRLAVQDAVSIASLLITTEVVIADKPEPEAPP

SEQ ID NO: 20982 - protein, 314 aa, SYNECHOCOCCUS SP. WH 8102
IELRHLHKAYGSVVALEDLNLEVPEACLYGLLGPNGAGKTSTLRILATLLEPDAGSVQVAGIDALKHPRAVRRHLGYVAQEVAIDKILTGRELLQLQGDLYHLQRADRDQRMADLIELLAMGDWVDRRCGTYSGGMRRRLDLAAGLLHRPRLLVLDEPTVGLDIESRSAIWDLLRRLVSQGTSVLLSSHYLEEVEALADRMAIIDSGRVIAEGTPDGLKQQLGGDRVTLRVREFSDAAEADRVSALLRPLDGVRQVVVNRAQGFSLNLVIDGEAVINSVRQCLDHQGVPVFALAQSRPSLDDVYLQATGRTLMD

SEQ ID NO: 20983 - protein, 159 aa, SYNECHOCOCCUS SP. WH 8102
WDRLIDWNARAEAEGDFFIRLLKEHGARSVLDVATGTGFHSIRLLEEGFDVVSADGSPNMLARAFRNARNRDQLLRTSQADWRFLNRDIHGEFDAVICLGNSFTHLFKERDRRKALAEYYAVLKHNGILILDHRNYDRLLEGGSAVRQGKGNVYCGKDV

SEQ ID NO: 20984 - protein, 327 aa, SYNECHOCOCCUS SP. WH 8102
MELTYRPRRLRRTPALRAMVREHQLSSADFIYPLFVHEGTDVEPIGAMPGASRWSLAALTGEVQRAWNLGVRCIVLFPKVAEGLKTEDGAECFNANGLIPRAIRQIKQEVPGMAIMTDVALDPYSCDGHDGIVSPAGVVLNDETIELLCKQAVVQAEAGADLIGPSDMMDGRVGAIREALDDEGFEHVGIISYTAKYSSAYYGPFREALDSAPRAAGSKPIPTNKDTYQMDPANAREAITEAQLDEQEGADIMMVKPGLAYLDIIHRLRNESELPIAAYNVSGEYSMVKAAAERGWIDERAVVLETLLSFKRAGADLILTYHACDAA

SEQ ID NO: 20985 - protein, 146 aa, SYNECHOCOCCUS SP. WH 8102
  unsure (1)..(146): unsure at all Xaa locations
LLLLNGPNLNLLGQREPGIYGSGTLASIEDGLRQEATAAGAVLECFQSNFEGALVERIHQAIGASQGILINAGAFTHTSIALRDALLGVAIPYVELHLSNTHAREPFRHRSYLADRAVGVVSGFGAMSYSLALQGLIDHLRQNGXP

SEQ ID NO: 20986 - protein, 405 aa, SYNECHOCOCCUS SP. WH 8102
SSTPFHDPPAWVADAVVYQIFPDRFRRSGQVKAQQHLELKPWGSDPREQGFQGGDLYGVIEALDQLQAMGISCLYLTPIFSSAANHRYHAYDYFEVDPLLGGNDALDTLIAALHQRGMRLVLDGVFNHCGRGFWAFHHLVENGQDSPYRDWFNVHRWPVKPYPAEGEDCGYDCWWAVPDLPKFNHANPAVRDHLLEVGRFWLERGIDGWRLDVPAEVPAEFWVDFRRVVREVNPDAWIVGEIWGDAREWLRGEHFDGVMNYRLGWSSLGWVAGDRLRQGYRNPEYPLNPLSSEDLIEIWSTTSGWYRPAVNRAQMNLLDSHDVPRALHSLDGDVKALKLALLLIFLQQGAPCVYYGTESGLCGGPEPACREAFPWGEPWPADLSSTIAALADLRRNQPNLIRGDL

SEQ ID NO: 20987 - protein, 493 aa, SYNECHOCOCCUS SP. WH 8102
LLALDQGTSSSRAAVFDAKGDLVASATAPLPIQYPADGWVEQHPGDIWNSQRQALQDLHQQLDEEQRRAVVSCGITNQRETTVLWRRSSGSPCGPALVWQDGRTADICQAWKADGLESAWCQRTGLLLDPYFSASKIRWMLEHHPEAAAAAAQGDLCFGTVESWLLWNLTGGQRHGSDMSNASRTLLMDLEQRCWMDEFREQTGLPANALPELLPCRGEFGHIAAKLPFAGLPIQALLGDQQAATLGQLCLQPGEAKCTYGTGAFLVINTGDSIRRSSDGLLSTLGWTDASGTPTYCLEGSLFNAGTVVQWLRDGLQIIEQADEVNALAQSVPDSGGVMLVPAFTGWGTPHWDPQARGVLVGLTRDSNRGHIARAALEGIALSVATLVELAGEALGRGLGELAVDGGAAASDPLLQAQADSTGLTVRRPRNLESTARGIALFAGVQCGLIPDLSAIAAHRQDDVQRFEPQINTERRRLQRDRWNDAVNRSLGW

SEQ ID NO: 20988 - protein, 496 aa, SYNECHOCOCCUS SP. WH 8102
DLLVIGAGASGASVAMEAVRRGLTVALLDAGDIGGGTSCRSTKLLHGGVRYLELAFKTFDLAQLQLVREALLERGHWLEQAPFLAHRLELVLPTDTLWGQLYYQAGLGLYDLLAGQQRIGRSRGISRDALQESLPMLKPGRGGVAYSDGQFDDARLNLLLARTAEQGGASLRTRCRVVGFERSADGRLSAAISETDTGMQEHWAAGVIVNATGIQADSIRQLADPQAAPRMLTSRGCHLVLKQNLCPGGQGLLVPSTADGRVLFMLPFHGRTLVGTTDAPCAIDAATTPTNEEEAYLLGYVRQWFPAVSDPTVTSRWAGGRPLLRPAGDSLNSSRVVREHEVEQLPCGLVSVMGGKWTTCRPMADDTLQAVAAQMGRPLGAPQQLNLLGSADTPSETRQLLMEQAGQLKDLLPDGPLRDQQITHLQSNHGLQALPMISRVDPTLRQPLSSVIPLCQGEIDHAIQREHSRSASDVLSRRCRLAMVDLAEARRLQPLV

SEQ ID NO: 20989 - protein, 545 aa, SYNECHOCOCCUS SP. WH 8102
WWTGTVIYQLIVRSFADGNGDGIGDFKGLASRLPYLRWLGVKTLWLTPTYPSPLRDGGYDITDFKDIHPDLGDLASFHRFLTAAHSQGMRVILDLVLNHTSDLHPWFQRARWAPKGSTERDVYVWSDDPSRYSDAPVLFRHFEASNWEWDPVAEQYYLHRFLSHQPDLNYANPWVQEAMLEVVDFWLERGVDGFRLDAVPFLFEEEGTRCEGLPETHAFLRRLRARVDAMGREVLLLGEAIQPVQEAAPYLAKDELHGAFNFVLTAHLFAAVASGSTRQLGDCLNEAEHAVDGPRWALPLRNHDELWLGDGHLIPDEVIQSIRVGLPQGQGHWLNWGINRRLAPLLNGDPRSNRLLHGLIYSLPGMPCLYYGDELGMGDWPGLRDRDPNRTPMAWTPARNGGFSSAPDPLLVLPPITAPGYDYRVVNVEVQKQLPGSLLNWHRRMLTCRRLLPALAHGSLQLLPCSHPGALVYVRATEAMTVLVAGNVTAAGASFSLDLTAWEGLRTREVMWGCEFPLASREWFVNLSPYGINWWLIGEVDTAVP

SEQ ID NO: 20990 - protein, 452 aa, SYNECHOCOCCUS SP. WH 8102
DELRRMQDSVGRGLTRAATWRQEQLQRLSELVEQHEQEVLAALAADLGKPPTEAFFEIVALRQELKLAQRQLRRWMRPRRVTVPLAQRPGRADVIPEPLGCVLIIGPWNYPFSLTLQPLICALAAGNTAVLKPSEHAPAVAALISRLIAEHFEPEVVRVDLGDGAVAAALVALPFDHIFFTGGGAIGRKVLEGAAAHLTPVTLELGGKSPALVLEGADLTVSARRLIWGKGLNAGQTCIAPDHLIVQPGLKAELLKAMDSARTEMYGTAPLASEQLACIVNDRQFQRLEALLDQAQQAGRVLIGGEINRDQRRIAPTVIRVDDRQDPLMADELFGPLLPVLELADLPQTLAEIRQGPKPLALYLFGGNEAQQQQVLETTSSGGVCLNDVVMQAGVPDLPFGGVGGSGMGSYHGQAGFDTFSHAKAVLRRPFRLDFKLRYPPYGIDLNLLRRL

SEQ ID NO: 20991 - protein, 520 aa, SYNECHOCOCCUS SP. WH 8102
WDVVVVGAGAAGLMTCLELPEGLSVLLLNRNTGRRSSSRWAQGGIAAVTRPEDSAGSHADDTLNAGAGLCDGDAVRFLVDAAPRCVDRLQQLGMAFDRDGHGLATTLEAAHSHRRVLHVQDRTGRALVDVLRERVERRPGLLHRRGVRVTRLDVQNGRCCGVQVLDGRHLQHIQARAVVLASGGGGHLFANTTNPAQACGEGIALAWQAGAAVEDLEFVQFHPTALRLDDAPCFLISEAVRGEGGVLVDAQGGSPVDHLLQRDLAPRDQVSRALVQRMWEQGVAQMWLDFSAIPRAQAEARFPTILDRCSEFGLNPLERPIPVAPAAHYWMGGVATDLQAATDLPGLYAVGEVACTGVHGANRLASNSLMECLVFAHRLAEIDLGPAIKPSNPAPPQAYGQALEGAITSAGLMEQIEQLRLFCWQRAGVDRSGRRLNAGLDHLRCELERLDQQPLLNCLQRDALLLDDSSRRDLNLLLDLRHRLVTSKLMLEACLFRQESRGGHFRTDAPSSQPQWQCHS

SEQ ID NO: 20992 - protein, 138 aa, SYNECHOCOCCUS SP. WH 8102
AFLTIRTHFAAAHRLARPELSQEENEAIYGKCARPHGHGHNYLVDVTVRGAIDPRTGMVCDLSALQRLVDDLVVEPFDHTFLNKDVAFFAECVPTAENIALHIADRLSTPVKAIGAHLHKIRLQESPNNAAEVYAETP

SEQ ID NO: 20993 - protein, 125 aa, SYNECHOCOCCUS SP. WH 8102
GQGRGCVITRRACFSASHRYWLPELSADDNAARFGPCAIAPGHGHNYELIVSMAGGLDADGMVLNLSEVKHAIRQEVTGQLDFRFLNEAWPEFDVSGPSGCLPTTEALVRVIWQRLSPHLPITAL

SEQ ID NO: 20994 - protein, 176 aa, SYNECHOCOCCUS SP. WH 8102
LKQRLGGRSLYLVGMMGSGKTSTGRPLAEQLGYGFVDADAVIEQAAGCSIPEIFERDGEAGFRALESQVLNAIGQRHSLVVATGGGVVTQQENWGLLHSGIVVWLDVVPEQLMQRLRADSTVRPLLQTEDPDAALNALLNQRRPLYAEADLTVVINQETPLAVADGILQLLPSLLK

SEQ ID NO: 20995 - protein, 260 aa, SYNECHOCOCCUS SP. WH 8102
QPLQNCTVVVTRAADQLGEARRLLETQGAQVLDLPALVIGPPDDWGPLDDALSELEDFHWLVVSSANGVQAVEQRLQRLGRSLLRRPANLRIAAVGRKTARALEDLGATADFVPPSFVADSLIDHFPVSGYGLRMLLPRVQSGGRTVLAEAFGEAGVRVVEVAAYESRCPDAMPERTAEALEAGTVDAILFSSGKTAAHTAQLLLQRFGPGWEQRLETLKLVSIGPQTSRSCREWFGRIDAEADPHDLEGLVSACRSLLR

SEQ ID NO: 20996 - protein, 476 aa, SYNECHOCOCCUS SP. WH 8102
VRVAIVGSGLAGLSAAVDLVDAGHEVNLYEARPFMGGKVGSWVDDGGNHIEMGLHVFFFNYANLFALMRKVGAFENLLPKQHTHLFVNEGGDLRELDFRFPIGAPFNGLKAFFTTPQLSWIDKLRNALALGTSPIVRGLVDYEGAMRTIRALDSVSFQDWFVGHGGSPESIRRMWNPIAYALGFIDCEAISARCMLTIFMMFAAKTEASKLNLLKGSPHRWLTGPILEYIQQRGGRLHLRHRVKQVEFSDGESPEVTGLHLGTPEGDIRVEADAYLAACDVPGIQKLLPEDWRRFPQFDAIHQLEAVPVATVQLRYDGWVTELGESQDAQRRDVATPTGLNNLLYTADADFSCFADLALASPEDYRKEGEGSLLQCVLTPGDPWIPKSVDEIVAHTDRQVRALFPSARDLKLTWSNVVKLAQSLYREAPGMEPYRPDQRTPIQNFFLAGSYTRQDYIDSMEGATMSGHLAAAAILD

SEQ ID NO: 20997 - protein, 798 aa, SYNECHOCOCCUS SP. WH 8102
  unsure (1)..(798): unsure at all Xaa locations
YCGARRSGGRPPSXREQHPTXPCRNEQAPVSPAVQTVVLDVEGMKCGGCVRAVERTLLEQPGVQRADVNLVSRAAWLDLSEADGDVDAVLGALASRGFPARERSLEPSSARLATGASGLTWWQQWRQLMVALTLLLLSVLGHLSEAGHLSLPLIGSLPFHAALATVALLGPGRPILLGGFAAARAAAPSMDTLVGLGVGSAYLASLVALIWPQVGWPCFFNEPVMLLGFVLLGRFLEERARFRTGQALHQLAQLQPDTARLVLPDGAIRDVRVGALRPGERLQLLAGDRVPVDGVVVEGYSAVDASSLTGEPLPWQAEPGLELSAGSLNLDAPLVLEVTRVGAETALARIIRLVEQAQARRAPIQGLADRVAGRFCYGVIALALATFLFWWLFGASQWPQVMQASAPGMPQGHLMTSGHAMHHGGLGSGATSPVGLALQLSIAVLVVACPCALGLATPTVITVATGLAAQRGWLFRGGDVIETAAGLDHVVFDKTGTLTLGRPLVTSVWAKDAALLLQLAASLEQSSRHPLAHALLQEAQRRDLTLLEPVQVTTVSGQGLVGEVEGWPQPIRVGRPDWLGSFGVALSDEARTWLAQADGSVVAVAHGSALLGLVQIEDQLRADVVPALERLRQQGLALAIFSGDREPAVRALGQQLGFEAADLGWQMLPEQKLQRLEELRQRGRVAMVGDGINDAPALAAADLGIAIGTGTQIAQDTAGMVLMGDRLDNLPEALTLARRTLAKVRQNLFWAFGYNLIALPLAAGALLPSQGVLLSPPLAALLMAISSITVVLNALLLR

SEQ ID NO: 20998 - protein, 325 aa, SYNECHOCOCCUS SP. WH 8102
GVMFRGSGSATPQRSISNTELGQRVETSDDWIRSRTGIAARRVIGADESLGELSGLAAERALAMAGWSADSLDLILLATSTPDDLFGSAPRLQARIGAVNAAAFDLTAACSGFLFAVVTAAQYLRSGAMQRILVVGADQLSRWVDWDDRRSCVLFGDAAGAVVMEASDEQDDLQGFLLRSDGGRGAVLQLPQSSERAPLVGDASHQRGGFEPIQMNGQEVYKFAVREVPAILEALLQKTETQADSLDWLLLHQANQRILDAVAERFSIPNEKVLSNLAHYGNTSAATIPLMLDEAVRDGRIEPGHRIASSGFGAGLSWGAALLRW

SEQ ID NO: 20999 - protein, 296 aa, SYNECHOCOCCUS SP. WH 8102
MAIAWVFPGQGSQKLGMADPVLSLSGASQRFAMASELLGRDLLAICQGNSVGGSGPDDLNDTRNTQPALFVVESLLVDNLIEQGRDAALVAGHSLGELVALYAAGVFDLETGLKLMQTRSELMAAAGGGAMTAVIGFDRSQLEALVNDTERVSIANDNSDAQVVISGQPDAVQSVSEKLKCKRAIPLAVSGAFHSPFMAEAAEAFATTLDGVSFRDARIPVLSNSDPSGCSDAALLKQRLKQQMTTGVRWRETMASMAEHGIDTLVEIGPGNVLSGLAKRSMNGVTTAQIASSGDL

SEQ ID NO: 21000 - protein, 194 aa, SYNECHOCOCCUS SP. WH 8102
NIAWHQASVDRAARAEQRGHRSAILWFTGLSGSGKSTLANAVNAALFQRGLATYVLDGDNVRHGLCKDLGFSDADREENIRRIGEVAKLFLDSGVIVLTAFVSPFRADRDKARALVDDGDFIEIHCAADLEVCESRDPKGLYAKARAGQIKEFTGISSPYEAPQAAELKIDTGSQELAESVDLVIKALQERGVI

SEQ ID NO: 21001 - protein, 335 aa, SYNECHOCOCCUS SP. WH 8102
MLRLDFNENTIGPSPLVAQALRNFSTEEIAVYPEYDGLREALLQNLVETGCRPGLKPAQVGLFNGVDAAIHAVLQAYGDAGETLLTTAPTFGYYSPCAGMQGMTIKAISYEGETFDFPLAAIQEALAARTPRLLLICNPNNPTGTRLPADQVIALAASAPGTLVVVDELYEAFTGDSVLPSADFTATPNLLVFRSLAKTAGLAGLRIGFAIGHADVVDRVSRVTGPYDVNSVAVAAAFAALADQSYVDAYVAEVLRARDWTVEALLQADVRHHCDGGNYLLIWPRRSVEEIDAALRSEGILIRSMAGKPLIDGCFRVSIGTTSQMQRFMEAYLSI

SEQ ID NO: 21002 - protein, 282 aa, SYNECHOCOCCUS SP. WH 8102
IQWYPGHIAKAEQQLSRHLDKVDLVIEVRDARIPLATGHPHLDRWLKGKQHLLVINRRDMVTPAAREAWEAWFKGRGQRTVWCDAKAGTGVKQVQQAAIRAGDQLNERRRNRGMRPRPVRALTLGFPNVGKSALINRLVKQKVVASARRAGVTRTLRWVRLGQDLDLLDAPGVLPPRLDDQQAALHLALCDDIGQAAYDGELVAQAFLQLLIDLQQQQASGVAIPVLESRYGIPVQGETADPPYWLEAAAQRHTSGDTARMAQRLLDDFRKSALGSIALELP

SEQ ID NO: 21003 - protein, 467 aa, SYNECHOCOCCUS SP. WH 8102
  unsure (1)..(467): unsure at all Xaa locations
SGTKSSNLSSTRRLSXTXTSSRALTAVSRAWGLASRGRRTVSNIADQRRENHGLTSSRFPTARHNPMAKRSLASLNAGDLSGKRVLVRVDFNVPLNEAGAITDDTRIRAALPTINDLIGKGAKVILSAHFGRPKGQVNDAMRLTPVAARLSELLGKPVAKTDSCIGPDAEAKVNAMADGDVVLLENVRFFAEEEKNDAGFAEKLAGLAEVYVNDAFGAAHRAHASTEGVTKFLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQDALGDCQTVIWNGPMGVFEFEKFATGTNAIATTLAELSGKGCCTIIGGGDSVAAVEKAGLADKMSHISTGGGASLELLEGKVLPGVAALNDA

SEQ ID NO: 21004 - protein, 318 aa, SYNECHOCOCCUS SP. WH 8102
DLRLEQVLFGCRFPNPVGLAAGFDKNGVAAGLWDRFGFGFAEVGTVTWHGQPGNPRPRLFRLAQEQAALNRMGFNNDGAQALRRTLERQRLAPPGRRPAVLGINVGKSKVTALEQAPEDYASSLELLAPLADYAVINVSSPNTPGLRDLQDSSQLRRLVERLRRLPACPPLLVKIAPDLEDEAIDGIARLAFEEGLAGVIAVNTSLDRLGLEQRRLLQTGRTLAEEAGGLSGAPLRQRALEVIRRLRASAGPALTLIGVGGIDSAEIAWERITAGASLIQLYTGWIFQGPELVPRILEGLQLQLDRHGLRSIAEAVGS

SEQ ID NO: 21005 - protein, 873 aa, SYNECHOCOCCUS SP. WH 8102
EPDRFSDPAWELLLAGQDMARRWRHDQLDVEHLIQVLFSDSSFRRWVEPLPLRSDDLLDRLEDVLADQPPARGDQLFIGEDLEQLLETADQVRGRWGDRSIDVPQLIVAVGADPRIGAELFAAQGLAVDRLESLLRQPSVSPAPAPPPVPTAASAPAPTPRSAPAPRVMAPEPEPMVELEREPSALEAYGRDLTEEAEAGSLDPVIGRDSEIRNLIKVLSRRSKNNPVLIGEPGVGKTAIAELLAQRIVAGEVPDSLQGLRLIALDLGALIAGAKFRGQFEERLRSVLEEVSRSDSGVVLFIDELHTVVGSDRSSTDAGSLLKPALARGDLRCIGATTPEEYRRTVEKDPALNRRFQQVLIREPDLELSLEILRGLRERYELHHGVTITDEAIQTANRLADRYISDRCLPDKAIDLIDEAAAQLKIEVTSKPQVVEEAEADLRRVELALLAAEEAPEEERIQLQRQRLEVSSRLDDLRRRWQEERTQLEELGQLLQQDEDLRHAIAEAEREGALEEAARLQYDQLHTVQQRREALEASQAEAQSAGTALLREQVEAGDIADLVARWTGIPVQRLLAGERRKLLALESHLSERVIGQVEAVAAVAAAIRRARAGMKDPRRPVGSFLFLGPTGVGKTELAKALATSLFDEEEALVRLDMSEFMERNASARLIGAPPGYVGYEEGGQLTEAVRRRPYAVLLLDEVEKAHPDVFNLLLQVLDDGRLTDSQGLTVDFRHTVVVMTSNLASPVILEHARSGSSDDAQLQQQVDAALSSQFRPEFLNRIDEVIRFRPLKVKDLVRIVRLQLADLSTLMAEQGLSLEVDDAVADSLARQGHEPEYGARPLRRVLRRQLENPLATQLLEERFRSAHGIRVRC

SEQ ID NO: 21006 - protein, 427 aa, SYNECHOCOCCUS SP. WH 8102
VIDSLDLVIDTIVAREVLDSRGNPTVEAEVLLEGGAMGRAIVPSGASTGAHEAHELRDGGDRYMGKGVSQAVTHIEERIAPTLCGLSALDQAAVDAAMLELDGSDNKSSLGANAILAVSMATARAAANGLGLPLYRYLGGPMANLLPVPLMNVINGGAHAANSLDFQEFMLVPHGAPSFREALRMGTEVFHTLKGLLKAKGMSTSVGDEGGFAPDLGNVEAGEILVEAITKAGYKPGEQISLALDVASTEFFENGRYAFDGGNYDSAEMVGQLEQLVEKFPIVSIEDGLAEDDWEGWKLLTERLGGKVQLVGDDLFVTNTKRLQQGIDNSTANSILIKVNQIGSLTETLQAIDLAGRSGYTSVISHRSGETEDTTIADLSVATRAGQIKTGSLSRSERVAKYNQLLRIEDELGSQAVYAGAVGQGPR

SEQ ID NO: 21007 - protein, 396 aa, SYNECHOCOCCUS SP. WH 8102
WQLVSGGVTSPQGFQASGIAAGLKPSGKLDMALLLAPEQAVCAGSFTTSVVRAACVDLCAERLAANGGQARAVLINSGQANACTGDRGLIDSQRATQALADQLGLDAEALLICSTGVIGVPIPMPKLLAGLDPLVAALSATGGEAAATAILTTDLVSKQVALEAELGGRRVRIGGIAKGSGMIHPDMATMLGFFSCDAGLDPSIWKAMVGQAVQRSFNAITVDGDTSTNDTVLAFAAGDPLDSVHHAALEQGLTEAMQHLAKAIARDGEGATCLIEVQVEGALDEPSAQRVARTIVGSSLVKTAVHGRDPNWGRIVAAAGRSGVPFDPEQVALWIGPHQLMQSGQPLSFDPEAASRVLRSETVQIRIQLGDGPGNGLAWGCDLSDQYVRINADYTT

SEQ ID NO: 21008 - protein, 148 aa, SYNECHOCOCCUS SP. WH 8102
ERTFIAIKPDGVQRGLVGEILGRFERKGFKLVGLKQITPSRALAEQHYGVHKERPFFAGLVDFITSGPVVAMVWEGDGVIASARKLIGATKPLEAEPGTIRGDLAVNIGRNVIHGSDAPETAEFEIGLWFDAAELNDWTPSDQTWRVE

SEQ ID NO: 21009 - protein, 641 aa, SYNECHOCOCCUS SP. WH 8102
VADSEGWSIQDSAALYGLDRWGEPYFTINGRGHISVQPQGERGGSLDLVELVSELRGRNLGLPLLIRFDDILEDRLERLHAAFERAIAQYSYTGRYQGVFPVKCNQQRHVVEELVICGKRWNFGLEAGSKAELLIALSLLDDPEALLICNGYKDRLYIETAILARRLGRQPVVVIEQPDEVDRIIEASKSLGAAPYIGVRAKLSSRSTGRWGSSVGDKAKFGLSIPELLATVERLRESNLLPDLRLLHFHIGSQINDIAVLKDALQEAGQIYVELTRLGAPMGFLDVGGGLGIDYDGSRTASAASTNYSLQNYANDVVATVRECCEPNAVAVPTLVSESGRAIASHFSLLVFDVLGSSALSASIPNASGDEPLTVRNLRDTLVTIQELSGTADAQLVRLQEAWNDALKFKQDALAAFRLGYMGLPDRASAEQLTWACADAIAQRLPKEQAIPEELAALSKALAGTYYANLSIFRSAPDTWAIDQLFPVVPIQKLNQRPTRLANLADLTCDSDGRLDRFIGDGQPKQLLELHELDDNNPYLIGLFLSGAYQEVMGNLHNLFGTTNAVHIRLSPGGSYRIDHVVRGDTNADVLEAMEHDPRVLLERLRVAAEAAINDGQLRIDESRRLLDHLESSLRQTTYLQ

SEQ ID NO: 21010 - protein, 261 aa, SYNECHOCOCCUS SP. WH 8102
TTSFMVVMHVLATVALLPRFWSWQGLVAFGVLYWVTVLGVTLGLHRLVAHRSLVVPVWVERMLVIMGTLACQSGPIEWVGLHRHHHRFSDQPIDHHDAGRGLWWSHSEWMLHDIPALKELDRYAGDLQVDPFYRWLDRWFLLLQIPLGLGLYWIGEAAQVHGGGIGLVLWAIPLRLVIVYHVTWLVNSATHAFGYRNFDCPDLSRNCWWVALLSFGEGWHNNHHAHPASARHGLRWFEFDLTWQHVRLLKRLGLASRVRTA

SEQ ID NO: 21011 - protein, 300 aa, SYNECHOCOCCUS SP. WH 8102
KQPGLAGTLRHFIRRRTRDVMAVQDVSFRIEPGEMVGFLGANGAGKTTTLKMLCGLIHPSAGEVQVAGFSPQRRQAEFLRRITLVMGQKQQLLWDLPPMDSLRVNAAVYGIPDGVARRRICELADLLELGEELARPVRKLSLGQRMKAELLAALLHEPQVLFLDEPTLGLDVNAQARVRTFLADYNRRTGATLLLTSHYMADITALCPRVLLIHQGRLFHDGPLEALADQLAPEREVRLELEAPIEPGALAGLGRLEQIEGCEVRLLVPRDQLTAVVAQLLERFPVRDLDVTDPPIEELI

SEQ ID NO: 21012 - protein, 303 aa, SYNECHOCOCCUS SP. WH 8102
NPAMVWTVDDIPSQEERVALVTGANSGLGLATARAMSARGATVIMACRCRRKAETARTQLLEAGLTGLDLLDLDLADLNSVRRAAAEVSDRYGHLDLLFNNAGVMAPPRQLTVQGHELQLGVNHLGHMALTLQLLPLMQGRNDARVVTVTSGAQYFGRIRWDDPSWAQGYDRYGAYSQSKLANVMFALELEARQQEQGGGIRSLAAHPGLARTDLQPTAIASGGNRLEAVAYRLMDPLFQSAAMGALPQLHAATAATAQGGEHYGPDQLGGMRGHPTRCRIAPAALDREQRQRLWQLSEELAG

SEQ ID NO: 21013 - protein, 273 aa, SYNECHOCOCCUS SP. WH 8102
GGIFMGSRRDPAGCRVGLFGVPYDGTTSFRPGTRFGPAAIREVSQGLETYCPQLDLDLEDLAYADLGAVDIPFGAPEPVVNAVQQATTAVLDLGLKPLMLGGEHSISSGAVAAVANQHPDLVLVQLDAHADLREEWLGTRHSHACAMRRCLEVLPSGDLLQLAIRSGTRSEFHELHSSGRRMDDVQALRDAMAPWTGRPIYLTVDLDWFDPAVLPGTGTPEPGGFLWGDFAAVVDVLSGHRLVAGDVVELAPQLDSSGVSSVLAAKVTRSLIL

SEQ ID NO: 21014 - protein, 315 aa, SYNECHOCOCCUS SP. WH 8102
QHVVSIQAFRAETLLQLFRLAAKFESNPDRYCRHNTPLTGKILINAFYEPSTRTRLSFDSAWHRLGGDSINITDRSTTGIAKGESLEDVAHMFNNYGDCVVLRDSNPEAVYAMSSTLRIPIINAGNGIDEHPTQAMADLYTMFKWRPSLASKEVSPKDRIRIGVIGLPSRMRTVRSLLRILSKFPQILEEVVVIHAPEMESEAPLFDPGQLEELEASGMSIRCSSDLAAEIPDLDVVYINAIAWVGDSYEVHGGGFRLTRDLPFKPEAIVLHPLARGPELSTCLDDTPHNWYFSQARGAVFVRMALLTCMVNRAE

SEQ ID NO: 21015 - protein, 710 aa, SYNECHOCOCCUS SP. WH 8102
SVRSQCPYCGVGCGLELLPPAVKGQAVKRDAEGNPMWTARGDREHPSSLGQVCIKGATVGETLARGRLRQPLFRSKLTDAFAPISWDDALDKITGQIKASLARRGNADGIAMYGSGQFHTEDYYLAQKLLKGALGTNNFDANSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRDNGQDPAFIDNHTENYDAFFDVAARWTPRRVALFCNIPEKRLRDVAALFHRRQKVLSLWSMGVNQRREGTAVVQGLINLHLLTGQIGNEGAGPFSLTGQPNAMGGREAGGLAHLLPGYRLVANPEHRAEVEQAWKLPAGQIAAKPGLAAWQQVEAMERGDLDLWWVAATNPLVSMPDLDRVKQAMGNCPLVVVSEAYADSETSHYAHLLLPAAQWSEKAGAMTNSERRVTFCPAYRLRFGESRPDWEVFADVGRRLGYTEQFRFDSAAEVYAEFTRLTQGRLCDVSGLSHELLEQAGPQQWPYPMGSIPSTAAKRLYENHLFATPSGRARFSTDQPLGLAEPPCDTYPLVLTVGRYLGQWHTMTRTGKVERLMKQHPEPLLEIHPSDAQELQLRNGELAAISSRRGHLTATVKVTDRIRCGTVFLPMHWGFTQEKACEANTLMHDDACPVSKQPELKACAVIVAP

SEQ ID NO: 21016 - protein, 491 aa, SYNECHOCOCCUS SP. WH 8102
KLNKIEKSKLEKDGLLVGSEIEKFAKIGWENMDETDLKLRLKWYGMFWRPKTPGKFMLRLRIPNGVLTSNQIRVVASIVERYGENGSCDITTRQNLQLRGILLCDLPEILRRLREAGLSSIQSGFDNPRNVTGNPLAGIDPNEIVDTRPYTTKLQNFLTNNCEGNSEYSNLPRKWNTAVAGSKDNFLLHNDIVFHPVENNGVMGFSIWIGGILSPQMNAYAFPMNVWVLPDEICNILDTVIRLWRDNGEREKRTKGRFRMYLDEIGHEEFRSQVEKLYGTLTPDPGSIFENSPRSHFGINQQKQAGLYFAGIHVPVGRLTAEDLQDIATASLKYGNGEIRLTEDQNIIITGLTSEKVEELKTDTLLQRFPLAPSNISAGTVSCTGNTYCSFALTNTKDQALKAAKELDEELNLPEEIKVHWTGCPNTCGQAYMGAIGLTGTKAKNAEGVMGEGYTMTIGGSQGRNPTIGQNLSQAIPAAEIKQPLRKYLFQ

SEQ ID NO: 21017 - protein, 344 aa, SYNECHOCOCCUS SP. WH 8102
DLHVVETRPLVAPALLHGDLPIDAAATETVASARRRIQAILRGDDQRQLVVVGPCSVHDVKAAREYAERLAPIRERLKDQLEVVMRVYFEKPRTTVGWKGLINDPHLDGSYDINTGLRRARGLLLDLSREGMPAATELLDPVVPQYIADLISWTAIGARTTESQTHREMASGLSMPIGYKNSTDGSACIAINAMQAASKPHHFLGINHDGHASIVSTTGNPDGHLVLRGGHQGSNYHLEAVQAAAAELSKAGLKDRLMVDCSHANSNKDFRRQADVLATVADQLKAGSGHVMGVMIESHLVEGNQKLTAGLSQLTYGQSITDACISLETTDALLSQLAAAVADR

SEQ ID NO: 21018 - protein, 637 aa, SYNECHOCOCCUS SP. WH 8102
MGKVVGIDLGTTNSCVSVMEGGKPTVIANAEGFRTTPSVVAYTKNQDQLVGQIAKRQAVMNPDNTFYSVKRFIGRRVDEVNEESKEVSYGVEKAGSNVKVKCPVLDKQFAPEEVSAQVLRKLAEDAGKYLGETVTQAVITVPAYFNDSQRQATKDAGKIAGLEVLRIINEPTAAALAYGLDKKSNERILVFDLGGGTFDVSVLEVGDGVFEVLSTSGDTHLGGDDFDKVIVDHLAETFKSNEGIDLRQDKQALQRLTEAAEKAKIELSSATQSEINLPFITATPEGPKHLDLTLTRAKFEELAANLIDRCRIPVEQALKDAKLSSSELDEIVMVGGSTRIPAVLELVKRTTSKDPNQTVNPDEVVAVGAAIQGGVLAGEVKDILLLDVTPLSLGVETLGGVMTKMITRNTTVPTKKTETYSTAVDGQTNVEIHVLQGEREMASDNKSLGTFRLDGIPPAPRGVPQIEVTFDIDANGILSVTAKDKGSGKEQSISITGASTLSDSEVDKMVKDAEANASADKEKREKIDLKNQAETLVYQAEKQMGELGDKVEADAKAKVDEKRTKLQEAINAEDYDAMKTLLEELQQELYTVGASVYQQEGAAAGGAAPGGDAGASAASGGGDASDDVIDAEFTETK

SEQ ID NO: 21019 - protein, 281 aa, SYNECHOCOCCUS SP. WH 8102
INGSTGLVGLLGNPVQHSLSPAMQNAALQALGLNWRYLALPCEENALPQVMEGLRAVGCHGLNVTIPHKQAVTSLCSQLSTAARRLQAVNTLIPDGENGWCGTNTDVEGFLAPLGGSERWRDQRAVVLGCGGSARAVVAGLQTLGLASIQVIGRRPKALLNFIADLQLEDAPLSSCLETDPAAADLLATADLVVNTTPVGMALHGDASAMPLGSDLWDRLAKQATLYDLIYTPRPTAWLRWGQGRGHRCIDGLEMLVQQGAASLRLWSGFNDVPVDTMRHA

SEQ ID NO: 21020 - protein, 400 aa, SYNECHOCOCCUS SP. WH 8102
MGRANKVVLAYSGGVDTSVCIPYLKQEWGVEEVITFAADLGQGDELEPIRQKALDAGASQSLVGDLIQPFIEEFAFPAIRANALYEGRYPLSTALARPLIARRLVEVAREVGADAVAHGCTGKGNDQVRFDVAIAALAPDLKVLTPAREWGMSREETIAYGERCGIPAPVSKKSPYSIDLNLLGRSIEAGPLEDPMVAPPEEVFAMTSPMSDTPDAAEEIEIAFEAGNPVAINGQVLDPVAMIREANRLAGSHGIGRLDMIENRVVGIKSREIYETPGLLLLIQAHQELESLTLAADVLRSKRQLEMQWADLVYQGLWFGPLKDALDGFMDRTQQHVNGVVRLRLYKGNATVIGRGSTQSSLYVPAMASYGSEDAFDHRAAEGFIYVWGLPTRLWAASQR

SEQ ID NO: 21021 - protein, 700 aa, SYNECHOCOCCUS SP. WH 8102
VLHLHLYGLFRSRDLELGRDADTGGQTLYVLDLVRSLAQRPEVDRVDVVTRLVQDRRVAADYERPLEVIAPGARILRFPFGPKRYLRKEQLWPHLEDLADQLVHHLTQPGHEVDWIHAHYADAGFVGALVSQRLGLPLVFTGHSLGREKQRRLLAGGGDRQQIEQAYAMSRRIEAEEQALTQADLVITSTQQEADLQYARYSQFRRDRVQVIPPGVDAGRFHPVSSAAEGDALDQLLSPFLRDPSKPPLLAISRAVRRKNIPALLEAFGSSSVLRDRHNLVLVLGCREDPRQMEKQQRDVFQQVFDLVDRYDLYGSVAYPKQHRRSQVPAFYRWAVQRGGLFVNPALTEPFGLTLLEAAACGLPMVATDDGGPRDIQARCENGLLVDVIDAGALQEALERAGKDASRWRRWSDNGVEAVSRHFSWDAHVCRYLGLMQAHLHQLPSVGPRPQGSPASSHRPDHLLLLDLDSTLDCPDGPSLTALRSQLERDGQRYGLGILTGRSLAAARQRYGDLHLPSPLVWISRAGSEIHLGEDLQPDHIWAQHIDTDWQRESVEAVMEDLHDLLELQSEEHQGPWKLSYLQRQPDESVLSHVRQRLRREGLSARPQRRCHWYLDVLPRLASRSEAIRHLALHWQLPLERVMVMASQQGDGELLRGLPATVVPADHDPCLVRHPQQKRVLLSGRPSLAAVLDGLSHYRF

SEQ ID NO: 21022 - protein, 349 aa, SYNECHOCOCCUS SP. WH 8102
WPGLIEAYRAWLPVTSTTPVITLREGATPLIPVPAIEERIGKGVKVFVKYDGLNPTGSFKDRGMTMAISKAKEAGCEAVICASTGNTSAAAAAYARRGGMRAFVLIPDGYVAQGKLAQALVYGAEVLAIRGNFDRALDIVREAAEKYPVTLVNSVNPYRLQGQKTAAFEVVDALGDAPDWLCIPMGNAGNITAYWMGFQEYRQAGHSRTLPRMMGFQASGSAPLVNDTTVSDPDTIATAIRIGNPVNRAKAIAARQASNGAFLDVTDAEIIEAYKLLGGQEGIFCEPASAASVAGLLKRKDEVPAGATVVCVLTGNGLKDPDCAINNNDAAFHTDLNPDLATVAGVMGF

SEQ ID NO: 21023 - protein, 456 aa, SYNECHOCOCCUS SP. WH 8102
WSDRFEQGLHPFVEAFNASIGFDLTLLQEDLDGSIAHARMLASCGVIAEEEAVQLVDGLELIRTEAADGRFNPGLEDEDVHFAVERRLIALVGSVGKKLHTGRSRNDQVGTDLRLWLRRRLDEIDGDLQRLQRALLDQADRHQSTMIPGYTHLQRAQPLCLAHHLLAYIEMLQRDRQRLGDVRGRVNICPLGAAALAGTPVPIDRRRTAEDLGFTAIYANSLDAVSDRDFCVEFSAAASLVMAHLSRLAEEVIAWASEEFGFVRLSDRCATGSSLMPQKKNPDVPELVRGKCGRVFGHLQGLLTMIKGLPLAYNKDFQEDKEALFDAYRTTRDCVEAMAILFEEGLEFRIDRLNQAVESDFSNATDVADYLVARGVPFREAYQLVGAVVRRCLEQDCLLRELSLEQWKEIHPAFEADLHEALAPRAVVSARRSEGGTGFDRVHEQVMLWQERLKES

SEQ ID NO: 21024 - protein, 350 aa, SYNECHOCOCCUS SP. WH 8102
DYYDLLGVGRDADADTLKRAYRSKARKYHPDINKEPGAEDRFKEIGRAYEVLSDPQTRARYDQFGEAGLGGAAGASDMGDMGGFADLFETFFQGFGGPGGAAAGRSGRRGPQQGDDLRYDLTIDFEQAVFGQEQEIKIPHLETCDTCGGSGAKAGSGPTTCGTCGGAGQVRRATRTPFGSFTQVAECPNCGGTGQVIADPCNACGGQGVRQVRKKLRINIPAGVDTGTRLRVSGEGNAGQRGGPSGDLYVFLTVKSHPRLRRDGLNILSTVNVSYLQAILGDTIEVETVDGDTVLEIPPGTQPGTVLTLANKGIPKLGNPVARGDQRVQVMVQLPTRLSDPERTLLEELA

SEQ ID NO: 21025 - protein, 381 aa, SYNECHOCOCCUS SP. WH 8102
SGLRRIGSTLRLIQKRKNSIFGQFLYDRRPNPLRGNPAPVMTLRVAINGFGRIGRNVMRGWISRGADTGLEIVGMNSTSDPKTSAHLLTYDSILGKLDPSVKIETTDDTMLVNGKEIKFFADRNPLNCPWKDWGVDLVIESTGVFNTDEKASMHLEAGASKVILTAPGKGDGVGTFVVGVNDDQYRHEDWNILSNASCTTNCLAPIVKVLDQNFGLDWGLMTTIHSYTGDQRILDNSHRDLRRARAAALNMVPTTTGAAKAVALVYPEVKGKLTGFAMRVPTPNVSAVDLTFGPSRATSVDEVKAVIKAASENGMKGIIKYSDLPLVSTDYAGTNESTIFDADLTYAMGDKAVKILAWYDNEWGYSQRVVDLAEVVARNWK

SEQ ID NO: 21026 - protein, 394 aa, SYNECHOCOCCUS SP. WH 8102
VKVLVLGGDGFCGWPCAVNLADQGHDVLIVDNLSRRKIDIDLEVESLTPIVSIGERLKAWEEIGGKPMRFVHMDIAHEYQRLLDLLLEEKPDSIVHFAEQRAAPYSMKSSATKRYTVDNNVNGTHNLLAAIVESGQDIHVVHLGTMGVYGYGSHRGATIPEGYLKVEVPQPDGSRFEEEILHPASPGSVYHMTKTLDQLLFLYYNKNDKVRITDLHQGIVWGTNTDATDRDPRLTNRFDYDGDYGTVLNRFLMQAAIGYPLTVHGTGGQTRAFIHIRDSVRCVQLAMENPPTQGERVKIFNQMTESHQVGELAKKVAALTGAQVNNLPNPRNEAVENDLIVDNRCFIELGLNPTTLDDGLLKEVVEIATRFADRCDRNRILCTSAWTKTQAQAI

SEQ ID NO: 21027 - protein, 275 aa, SYNECHOCOCCUS SP. WH 8102
VNAAAFEGVDLVLASAGGSVSRQWRDAITAAGAVMVDNSSAFRMEEGVPLVVPEVNPDAALAHNGVIANPNCTTILLTLALAPLAARRPMRRVVVSTYQSASGAGARAMEELKTLSQTVLDGGTPQGEVLPYSLAFNLFLHNSPLQANSYCEEEMKMVNETRKIMDLPDLRFTATCVRVPVLRAHSEAVNIEFEQPFPVEEARSLLSAAPGVELIEDPATNRFPMPTDVTGRDPVAVGRIRQDISDPNALELWLCGDQIRKGAALNAVQLAELLL

SEQ ID NO: 21028 - protein, 302 aa, SYNECHOCOCCUS SP. WH 8102
MTSPAALSPTPFGRVVTAMVTPFDDSGAVDLPLAGRLARHLVEQGSDGLVVSGTTGESPTLSWQEQLQLLQAVREAVGSDAQVLAGTGSNCTAEAVEATRQAAAAGADGALVVVPYYNKPPQDGLAAHFRAIAEAAPELPLMLYNIPGRTGCSMAPETVAQLMDCPNVVSFKAASGTTEEVTALRLACSSKLAIYSGDDGLTLPMISVGAVGVVSVASHVVGPQIRAMIDAYMQGDAAVALALHEQLQPVFKALFATTNPIPVKAALQLNGWSVGDPRPPLSPLPDDMRSTLAQTMAALRQT

SEQ ID NO: 21029 - protein, 585 aa, SYNECHOCOCCUS SP. WH 8102
MALLVQKFGGTSVGSVERIQAVAERISRSREEGHDVVVVVSAMGHTTDELTGLAAAITDTPQQREMDMLLASGEQVSIALLAMALNQQGVAAVSMTGPQVGIVTESTHGRARILEIRTDRIRGHLADGRVVVVAGFQGTSSGIGGVAEITTLGRGGSDTSAVALAAALNADACEIYTDVPGVLSTDPRKVADAQLMDEISCDEMLELASLGASVLHPRAVEIARNYGVLMVVRSSWSEAPGTRLTSRRGRPLNQTGLELGSPVDGVEQMDHQAVIALSHIPDQPGIAARLFETLSGAGINVDLIIQSTHEGSSNDITFTVAEADLEAARSVSQTVLDSLGGELAAEGGMTKLSISGAGIMGRPGIAAGLFHCLSQQGINLRLIATSEVKVSCVIDADSGRKALQAVQEAFDVADAQVELNPDLSISDVPEVRGVALDRDQAQLSVRHVPDRPGTAAALCSALAERGISLDAIVQSERQHTDGSRDISFILRKEDRSRADVALAPLLAQWPGAALEEGESIARVSAVGAGMPATPGTAGRMFRALADAGINIALIATSEIRTSCVVAEQDGVAALQAVHAGFGLGG

SEQ ID NO: 21030 - protein, 811 aa, SYNECHOCOCCUS SP. WH 8102
VDPQQLTPMLRHYVELKAAHPERVLLYRLGDFFECFFEDAITLSRLLELTLTGKEGGKAVGRVPMAGIPHHAAERYCGELIRRGFSVALCDQLETTPAKGALLKRDITRVLTPGTVLEEGMLSSRRNNWLAAVVIEPAHRDEPFRWGLASADVSTGEVQVMQRQDSDALHQQLAQLGAAELLSSTPESNPAWCPDQLRLTSVASTPFSRPAAEAALLRHYKLANLDGLGLPELPLALRAMGGLLAYLRDTQPLEENASVPLEVPAIVQRGDALVLDAQTRRNLELTATQRDGSLQGSLLWAIDRTLTAMGGRCLRRWLEAPLMDLDAIRQRQQLVSTLVEQRNLRQALRRLLRPMGDLERLAGRAGAGHAGARDLVAIADGLERLPQLAARLEGTIIRGPDWLDDLLQPDPALQDLASSIRHTLLESPPLSLSEGGLIHDGVDPLLDGLRNQLDDQDAWLSQQEKQERQRSGNSNLRLQYHRTFGYFLAVSKAKASAVPDHWIRRQTLANEERFITPALKEREGRIFQLRARACQREYELFCTLREQVGALAASIRRAARAVAGLDALTGLADTAASGAYCAPELVEGRALSLSEARHPVVEQLLVETRFTANDVHLGSGTDLVVLTGPNASGKSCYLRQIGLIQLLAQIGSWVPAAKARIGIADRIFTRVGAVDDLAAGQSTFMVEMAETANILHHATELSLVLLDEIGRGTATFDGLSIAWAVSEHLAGDLRARTVFATHYHELNNLANERANVANFQVLVEETGDDLLFLHRVSQGGASRSYGIEAARLAGVPTPVVQRARQVLDQIE

SEQ ID NO: 21031 - protein, 296 aa, SYNECHOCOCCUS SP. WH 8102
VVCLGEALIDRLGPPGGDPAIDGPLDDRLGGAPANVACGLARLGTSVAFLGRLGADAIGDRFATLFLQRGVDVDSVQWDAQRPSRIVLVRRSADGERQFRGFAGDEGLGFADQALASVELPKQARWLLTGTLPLAAHASADSLRGAVAQSKARGIALAVDVNWRPTFWDSAARPDAGPSQQAIELIRPLLEQAALIKLAREEAIWLFGSTDPRAICTQLPQEPDVVVTDGAEPVRWWMDGASGTQPAFHPPQVVDTTGAGDAFTAGLLHRWSASPAERVRFASACGALVCAGAGGI

SEQ ID NO: 21032 - protein, 461 aa, SYNECHOCOCCUS SP. WH 8102
DCVIADINQAAFGRKELDIAETEMPGLMALREKYGTEKPLKGARIAGSLHMTIQTACLIETLVELGAEVRWASCNIFSTQDHAAAAIAAQNIPVFAVKGETLEEYWEYTHRILEWGDGGSPNMILDDGGDATGLVMLGSKAEQDITVLDNPSNEEETFLFASIKKKLAQDPTFYSRTKAEIQGVTEETTTGVARLYKMQKSGELPFPAINVNDSVTKSKFDNLYGCRESLVDSIKRATDVMVAGKQALVMGYGDVGKGSAQSLRGLGATVCIAEVDPICALQAAMEGYRVVRLEDVVEEMDIFVTATGNYQVIRNEHLEKMKDEAIVCNIGHFDNEIDVASLKGYEWDNIKPQVDHITLPSGNRIILLAEGRLVNLGCATGHPSFVMSNSFTNQVLAQIELFTKGNEYGKEVYVLPKHLDEMVARLHLDRIGAKLTELSKDQADYINVPVEGPYKPDHYRY

SEQ ID NO: 21033 - protein, 669 aa, SYNECHOCOCCUS SP. WH 8102
MVAAPASLDTLCINSIRMLAVDAINKSKSGHPGLPMGCAPMGYALWDKFLKHNPKNPKWFNRDRFVLSAGHGCMLLYALLHLTGYDSVSIDDIKQFRQWGSKTPGHPETFETPGVEVTTGPLGAGISNAVGLAIAESHLAAKFNKPGATLVDHYTYVVMGDGCNQEGIASEACSLAGHLKLGKLIAFYDDNHITIDGRTDVSFTEDVLKRYEAYGWHVQHVADGNTDVDAIAKAIEAAKAVTDKPSIIKVTTTIGYGSPNKGDTAGVHGAPLGEDETVLTRQQLGWEYGPFEVPQEAYDQFRQAIERGASLEAEWNQTLATYRTQFPAEAAEFERMLRGELPEGWDKDLPTAGPDEKGLATRKHSQICLGALGPNLPELIGGSADLTHSNYTDIKGETGSYQPETPEKRYLHFGVREHAMAAILNGIAYHDSGLIPYGGTFLVFADYMRGSMRLSALSELGVIYVLTHDSIGVGEDGPTHQPIETIPSLRAMPGMLVFRPGDANETSGAYKLAIQNRKRPSALCLSRQGMANQANSSIDKVAKGGYVLEDCDGTPELILIGTGTELDLCVQAAKQLTEAGKKVRVVSMPCVELFDEQSDAYKEKVLPNAVRKRMVVEAAESFGWHRFIGLDGDSVTMNRFGASAPGGTCLKEFGFTVENLVAKASALLA

SEQ ID NO: 21034 - protein, 407 aa, SYNECHOCOCCUS SP. WH 8102
RVVVTGLGAVTPIGNTVQDYWSGLISGRNGVDAITLFDASAHACRFAAEVKDFDPAGLIEPKEAKRWDRFCKFGVVAAKQAIADAGLTISDANADRIGTMIGSGVGGLLTMETQAHVLEGKGPGRVSPFTVPMMIPNMATGLAAIALGTKGPSSAVATACAAGSNAIGDAFRLLQLGKADAMVCGGAESAITPLGVAGFASAKALSFRNDDPATASRPFDKERDGFVIGEGAGVLVLETLEHAQARGATILGEVVGYGMTCDAHHITSPTPGGVGGAEAMRLALADGGIDPSEIDYVNAHGTSTPANDKNETSAIKSALGDRALQIPVSSTKSMTGHLLGGSGGIEAVACVLALQHGVVPPTINHTNPDPDCDLDVVPNQARDQTLGTVLSNSFGFGGHNVCLAFKR

SEQ ID NO: 21035 - protein, 75 aa, SYNECHOCOCCUS SP. WH 8102
AILEKVRSIVAEQLSVDAGEVKPESNFQNDLGADSLDTVELVMALEEAFDIEIPDEAAEGITTVGDAVKYIEDKQ

SEQ ID NO: 21036 - protein, 629 aa, SYNECHOCOCCUS SP. WH 8102
MCGIVALVGSQPAAPQLLEGLRQLEYRGYDSAGLATVTSQGQLTCLRAKGKLVNLSQRVEALGAPGQCGIGHTRWATHGKPEERNAHPHRSVDGGVAVVQNGIIENHRQLRDGLEASGVEFQSETDTEVIPHLVSAELHRRLQNGEQPSGSTLLQAVQTVLPQLQGAYALAVIWEKAPGALVVARRAAPLLIGLGEGEFLCASDTPALAGFTRTILPMEDGEVALLSPLGVELYDGEGVRQQRMPTLLTGTDHVADKREFRHFMLKEIHEQPETAALWVSRHLPEGLPASMPVALPFDEAFYAGIERIEILACGTSRHAALVGAHLLEQFAGLPTAVHYASEFRYAPPPLAPNTLTIGVTQSGETADTLAALAMEAQRRCAHPDPAYASRQLGVTNRPESSLSRQVPHILDIGAGVEVGVAATKTFTGQLLAFYGLAMAFATRSGSRSAAEIQTLADELRMLPQQLQELVSLHDQRSEALAHRFAETQDVIFLGRGINYPIALEGALKLKEISYIHAEGYPAGEMKHGPIALLDAHVPVVSIAVPGTVFEKVLSNAQEAKARDARLIGVAPEGPDTALFDDLLPVPEVSEWLSPLLTVVPMQLLSYHIAAHRGLDVDQPRNLAKSVTVE

SEQ ID NO: 21037 - protein, 830 aa, SYNECHOCOCCUS SP. WH 8102
PLDLRLPTPGCYNDPERAGLDAKSVFDGMTEHLFFTLGKLAPTASRHDLYMALSYAVRDRLMMRYLATTEAMRAHPQKSVAYLSAEFLIGPQLNNNLLNLGIQQEAEAALRNFGIESLQQILDVEEEPGLGNGGLGRLAACYMESLASLKIPATGYGIRYEFGIFDQLIRDGWQVEITDKWLKGGWPWELPQPDEACFVGFGGRTESYIDDKGSYRSRWIPAEHAIGIPHDVPVLGYRVNICDRLRLWRADATESFDFYAFNIGDYYGAVEEKVGSETLSKVLYPNDGTDEGRRLRLKQQHFFVSCSLQDMLRSLDNRGLPVEDFPKYWTVQLNDTHPAIAVAELMRLLIDDRHMDWDKAWDITSRSVAYTNHTLLPEALEKWDLNLFSSLLPRHLELIYEINRRFLQQLRLRYPGNDAIQRKLSIIDEDGSKAVRMAHLATIGAHHVNGVAALHSDLVKTDLLPEFAELWPEKFTNVTNGVTPRRWVALANPELSTLLNEHIGEDWISNMENLRKLEERQNDQGFLEHWGNTKLSVKRKLASYIHRNTGVLVDPSTLFDVQVKRIHEYKRQHLNVLQVITQYLRIKNGQADGMAPRTVIFGGKAAPGYYMAKLIIRFINGIAETVNADPDMDGRLRVVFLPDYNVKLGEQVYPASDLSEQISTAGKEASGTGNMKFAMNGALTIGTLDGANVEIRELVGAENFFLFGKTVEEINDLKRSGYNPGAFINAMPELQEALRLIEMGHFSNGDSELFRPLLDNLTGHDPFFVMADFADYLRAQEAVSLAWTDRMHWNRMSLLNTARTGFFSSDRSIGEYCENIWNVGPLNVDI

SEQ ID NO: 21038 - protein, 467 aa, SYNECHOCOCCUS SP. WH 8102
KLTAPSQGTPIRFENGQPVVADNPIIPFIRGDGTGVDIWPATQKVLDAAVAKAYGGVKTIEWFKVYAGDEACDLYGTYQYLPEDTLEAIRTYGVAIKGPLTTPVGGGIRSLNVALRQIFDLYSCVRPCRYYEGTPSPHKRPQDLDVIVYRENTEDIYMGVEWEADDAVGQELRKHLNEVVIPANGKLGKRQIPEGSGIGIKPVSKHGSQRHIRKAIQHALRLEGNKRHVTLVHKGNIMKFTEGAFRDWGYELATTEFRDVCITERESWILGNLEKDSGLSVQANARMIEPGYDSLTPEKKADIDAEVQAVIDAIGSSHGGGKWRSMVLVDDRIADSIFQQIQTRPQEYSILATLNLNGDYISDAAAAMVGGLGMAPGANIGETAAIFEATHGTAPKHAGLDRINPGSVILSGVMMLEFLGWQEAADLVTKGLSAAITDKQITYDLARLMEPQVDPVSCSGFAEAIIQ

SEQ ID NO: 21039 - protein, 460 aa, SYNECHOCOCCUS SP. WH 8102
VLNRVSNSVIVPLLAVAGNALSIIVLLVGVVFAIGWSAVWMFALMFAAYVVASAIVTPYIRRASKQRVRYSRRINMILMESLRSMRDVHLYSADRYFLGSFSRNGIVAKRYERLVKLLPDVPRFLIEPAAITILFAAGLAPVVLSGDVSDVRDSVPSIVAVLITLTRISAPLQSTFRNLNKLRGGLPDIKDSLELLSLKPKRLLLDTDSVPTPSGVMPRRSIQLDDVTFKFKSGTAEILRSISISIPVGSRVALVGRTGSGKTTLAHILLGLYQPTSGVLRLDGVAVSPEEMPAWQANCALVPQDIRLLDSSLRENVAFGVSPEHIDDVRVWSALESAQFDESVAEMPHGLYSVIGEDGVKLSGGQRQRLSLARAFYREAKVLVLDEATSALDNRTEHDVMQALDLIGRRCTTIVIAHRLSTVRKCDRIYEVDGGVIKAQGDFEYLCSASESFRDMNRLE

SEQ ID NO: 21040 - protein, 788 aa, SYNECHOCOCCUS SP. WH 8102
  unsure (1)..(788): unsure at all Xaa locations
FLAGLNDAQRRAVDHHEGPLLVVAGAGSGKTRALTHRIAHLIGEHGADPAQILAVTFTNKAAREMKERLEVLLAQKLAQSQYGQPWSTLPPVDQRQLRSRIYREVSKELWIGTFHALFARMLRYDIDKFKDAEGLSWTKQFSIYDEADAQSLVKEIVTQELQLDPKRFEPKKTRWAISNAKNQGWLPDQLEANAEGQRGKLTANVYRRYRRALAANNALDFDDLLLLPVQLLQQNEQVRSYWHRRFAHVLVDEYQDTNRTQYDLIKLLVTDGKDPQTYNNWSGRSVFVVGDADQSIYSFRAADFTILMGFQEDFGDQAPDDATRTMVKLEENYRSTATILAAANALIANNSERIDKVLRPTRGDGELITLTRCDDEIAEAEAVVHRLRTMEAANPELSWGDMAVLYRTNAQSRSIEESLVRWGIPYIVVGGLRFYDRREIKDLLAYLRLLVNPADTVSLLRVINVPKRGIGKTTIQRLTDAANQLGIPLWDVVSDAEAVRSLGGRSARGLLQFCELLHDLRRQVQEVAPSELIQQVMEKSGYISELIAEGTDEAEERRRNLQELVNAALQYQEENEEGDLEGFLATAALSSDADSKDTAADRVTLMTLHSSKGLEFPVVCLVGLEQGLFPSYRSLDDPASLEEERRLCYVGITRAKERLFLSHASERRLWGGMREAAVPSVFLSELPEALVAGGSPPERWSGPAPRTAAGAAHPCGSXSSQLGAGQCVRRRQAGPAPGRSWSVGDRVTHASFGVGEITHTFGSGEKVSIAVKFAGMGPKILDPRLAPI

SEQ ID NO: 21041 - protein, 592 aa, SYNECHOCOCCUS SP. WH 8102
ESFPEGIELLLMERSNATPDQKFGPGWFWPALKRYRGVLIQVLAASFVVQLFTLANPLLIQVIIDKVISQRSLDTLQVLGIALVMVTILEGVLGSLKTFLFAETTNRIDQRLGAEVIDHLLRLPLGYFDRRPVGELGTRVAELEKIRNFLTGQALTTILDAAFSVIYIMVMVIYSWLLTLIALSVLPIQIGLTVLGAPLFRRQFRAAAEENAKTQSHLVEVLTGIQTVKAQNVEMVSRWRWQEFYSQYIARTFEKTITGTALNQTSQVLQKISQLMVLWIGASMVLSGDLTLGQLIAFRIISGYVTQPLLRLSTIWQNIQELRVSFERLADVIDTPEESDEVDKSKVMLPPLHGEVRFEGLSFRFRPGQPEVLKDINLEIKAGTFVGIVGQSGSGKSTLMKLLPRLYEPGEGRILIDGYDIAKVELYSLRRQIGIVPQDPLLFSGTVSENIALTNPEASSEEIVRAARLANAHDFIMDLPSGYSTPVGERGASLSGGQRQRVAIARTLLSNPKLLVMDEATSALDYETERKVCDNLLENLDDQTVFFITHRLSTIRQADVIVMLHQGAVVEVGTHEDLMKHRGRYYALYRQQ

SEQ ID NO: 21042 - protein, 448 aa, SYNECHOCOCCUS SP. WH 8102
VTIQRICCIGAGYVGGPTMAVIADRCPEIEVTVVDINQARIDAWNDADLSRLPVYEPGLDAVVGRARGRNLTFSTAVEATVASADMVFISVNTPTKTKGLGAGQASDLRWVEACARTVAKAATGHTIVVEKSTLPVRTAAAIKTILEAAQEDDQQRCFSVLSNPEFLAEGTAIRDLEAPDRVLIGGEDAASIEALAAVYSHWVDEAKILRTNLWSSELSKLTANAFLAQRISSINSVAALCEATGADVREVARAIGTDSRIGPKFLNAGPGFGGSCFQKDILNLVYLCRHFGLPEVADYWESVVALNTWQQHRIAQLVVQKLFGTVTGKRLAIFGFAFKADTNDTREAPAIRICGDLLEEGAQLAIHDPKVEPAQMARDLKQEAAAAADVLSGTGSWALAESVEEAVSGADAVLILTEWNVYRNLNWAELAGRMRKPAWLFDARAVAD

SEQ ID NO: 21043 - protein, 684 aa, SYNECHOCOCCUS SP. WH 8102
AFPLAAITGHGTLKLALLLAAVDPGLGGVVIAGGRGTGKSVLARGLHALLPPIDILDVDNGVGRNLDPQNPEEWDDTTRERISGEPPSKVIPAPFVQIPLGITEDRLVGALDVAASLASGSAVFQPGLLADAHRGVLYVDELNLLDDGIVNLMLAAVGSGENRVEREGLSLSHPCRPLLIATYNPEEGNVRDHLLDRFAIALSANQVVSTEQRVEITGAVLSHGQCSRSFAQKWGEETDALATQLLLARQWLPDVLISREQIEYLVTEAIRGGVEGHRSELYAVRVARAHAALSGRDTVEADDLQVAVALVIAPRASQMPPPDQQMEPPPPQDQEPPPPPQDQGDQQQDNPPPPPEGSDEEDSDPPEDSNDDNDTEDDDGDGEEDQAPPAVPEEFILDPEAIEVDPDLLLFNAAKAKSGNSGSRSVVLSDSRGRYVKPMLPRGPVRRIAVDATLRAAAPYQKIRREREPGRSVIVEEGDLRAKLLQRKAGALVVFLVDASGSMALNRMQSAKGAVIRLLTEAYENRDEVALIPFRGDQAEVLLPPTRSITAARRRLESMPCGGGSPLAHGLTQAARVGANALATGDLGQVVVVAITDGRGNVPLSTSLGQPELEGEEKPDLKQEVLDVASRYRMLGIKLLVIDTERKFIGSGMGKDLAEAAGGKYVQLPKASDQAIAAVAMNAI

SEQ ID NO: 21044 - protein, 259 aa, SYNECHOCOCCUS SP. WH 8102
LLDLTGKKILVTGIANNRSIAWGIAQQLKAAGAELGITYLPDDKGRFEAKVRELTAPLEPSLFLPLNVQDADQMAEVFGEIKAKWGVLDGLVHCLAFAGKEELIGDYSATTAEGFARSLDISAYSLAPLCAHAKPLFSEKAGVITLSYLGAERAIPNYNVMGVAKAALEASVRYLAAELGPEKQVRVNAISAGPIRTLASSAIGGILDMIHNVEEKAPLRRTVTQMEVGGTAAFLLSDLASGISGQTIYVDAGYCVTGM

SEQ ID NO: 21045 - protein, 194 aa, SYNECHOCOCCUS SP. WH 8102
RQGDIHRVTGETDVKVRLDLDGSGQCQASTGVPFLDHMLHQISSHGLIDLEINAVGDTHIDDHHTNEDVGIAVGQALAQALGDRRGIHRFGHFAAPLDEALVQVALDCSGRPHLSYSLSIPSQKIGSYDTELVKEFFVAVVNNSGLTLHIRQLDGVNSHHIVEACFKAFSRALRMATEIDPRRAGAIPSSKGVL

SEQ ID NO: 21046 - protein, 476 aa, SYNECHOCOCCUS SP. WH 8102
SPAPIKFGTDGWRGVLGVDITVERLLPVAAAAAQELAHRAPDGLNSRTVIIGFDRRFLAPELAEAIANAVRGCELEPLLTETPVPTPACSWAVVERKALGALVITASHNPPEWLGLKIKGPFGGSVEGDFTAAVERRLAAGGITPPIAATTSRFDGRGEHLEGLRRKLDLTALVTGLKAMNLKVFVDPMHGSAAGCVSDLLGPEASELVDEIRSTRDPLFGGNPPEPLAPYLSDLITAVQHSTAAGTPAVGLVFDGDGDRIAAVDENGRFCSTQLLMPLLIDHLARARQLPGTVVKTVSGSDLMRLVAEAQGREVLELAVGFKYIASEMLAGEVLIGGEESGGVGFGMHLPERDALFAAMLVLEALVEGGQPLGSRLDALQQRHGGASHYDRLDLRLQDMEARRRLETLLASSTPQQVAGDAVVEVNTTDGIKLRMGASHWLMLRFSGTEPLLRLYCEAPDRDRVDAVLAWAKRYA

SEQ ID NO: 21047 - protein, 974 aa, SYNECHOCOCCUS SP. WH 8102
RLDRSIEQVVLERQDPISGLLPASTAHTVHGNYGDAWVRDCVYSVQCVWALAMAHRRRHGAHDRRAWELEQRVISLMRGLLRAMLRQAGKVERFKVSLDPLDALHAKYDSSSGDPVVADDAWGHLQLDATSLFLLQLAQLTRGGCTVIQSRDEVDFIQNLVYYVARAYRTPDYGIWERGDKGNNGLPERNSSSIGMAKAALEALEGLDLFGVHGDGSCQLLIPQGAVVRLRRALESLLPRESASKEADSACLSVVGFPAWAIENQDLVQRTLRRVRRELGGTYGYKRFLRDGHQTAVEDVNRLHYEPEELAQFEGIESEWPLFLAFELVTACCEERWQDARSWQDKLAALAVHRDGEALYPELYQVAADRVEAERRQPGSQPRQANSNLPLIWTQSLAWLGEMLLEGLITPEDLDPCERRHAMGLGADGMLVAFAAETTSVRQALIDAGLPLDSGDGITIQPSDALAARWSSIGANPRLGLSGKPVQRIETEDTARLYRLGEQTLAFTTAVLEDGISYLADDPLQLEDSVVDELHLLRRHWRGPGLPLLLIPVSAESFQHHPEVFLQLGQTLLTGRIGDIPVQFDQLKQLASQASWVTLREGGGDIEPTALERSRPSLLQDATDLRDLTAAEEQELDETDADLLRRRLWNTQSLHEQADVLDLLQRRFGAKALETNPHGRSVTIQQLLEEVYHRGLRCQDWSVVRRCAGAMGMVHPQLEDALTDLLVRQKQVVVGRNYTADARLSHPLDSSAIAERIARTSGVDGRERMLEQELLLALDGVARRDPGLLKGILTLQLSQLLLLLTSELAAEDQLSQDEAFEALCSSSPHRIRDRLRQLLSDVEHARAALQRGEQLHVTGRVQWKVPDPIDQPPSGGDWLQHRIRLGSLQKVPRDFYAGIWSLLQHCRGLVVGDKLERRNRLNSRLILEKTAGEKNFATLVEHLLSRIQAPEYRQLCTECLLSLMAFVEANPEVH

SEQ ID NO: 21048 - protein, 887 aa, SYNECHOCOCCUS SP. WH 8102
IETFRSRSRRDLRSGWRRSHALEREPFILESWGKNNRPDWAARGLLIWPRGRAWLRLEQTVVRPEAWPDASHHRARLCLSWWAESARLWVDGVLVHQGDLFDTACRWTLPEAFLAGHVHRIQLELCSPLHDDGALISSWLDLEPNRPGEDPAGVLLPEALLLHLEAGGDLPFGWEQMDPNSEAALKAVAQQLKAQPTPQGAVHWFGHAHLDLAWLWTVADTWQAAERTFRSALALMKRWPDLRFAHSTPALYAWMEHHRPELFSAICKASRAGRWEPINGPWVETDCVLVSTASLWQQFAIGQAYSREIFPEWRHHLAWLPDSFGFAAGLPAVAQATGVRWFCTHKLAWNASNSFPHRLFRWRSRGGGDVMSLMLPPIGRRGDPSDILKEQRRWQQCSGVSELLWIPGVGDHGGGPTEEMLEQMQLWDPEPSALPRQAGSLRQYLDRLEPMAGQLPVWRDELYLELHRGCATSRPDQKRHNRSLERLLRESDTVAALLAFAGRPSVGSDWRPLLFQQFHDILPGTSIPEVFDQAEPIWRRARRQARHQRDQGLRQLLGVDSGSGASSTWLWMGWQPLARWSPLLKLPHGAWHTDGAALPQQPSVQGGTWVQLPEQRGICSVALSDGPVDSGEIAPRHPVSVVQVSPEIWRVSNGLVEFECSPVGLLQLRDAQGVDQLSAPLCPCRYRDRGEFWDAWDIAAEYRRHPLELEPVGSVQLLESGPLVAQLVVTYRVGASRMRLDLRLKADCPWLELIVSVDWCQRHELLRLDIPLASAAVRLAADTSGGVIERPAHPQTPREQERWEVPAISWLASQAKAPGGGIAVLLDGPQGVDGATDRLGVSLLRGATWPDPSADQGQQRMRLALMPFQGSWAHAAVPQAAIAFREP

SEQ ID NO: 21049 - protein, 454 aa, SYNECHOCOCCUS SP. WH 8102
VPSIGPSLGSSAPGFGTDGIRGRAGTELSPALCLQVGYWIGRVLKADGPVLIGMDSRSSGSMLVAALTAGLTAAGRDVWELGLCATPAVPLLIREVGAAGGLMVSASHNPPADNGIKVFGADGTKLSAERQARVETGLRGEVEDDGPSRCGRSVQRQDLLRSYQDKLLSSVGDRRLNGVPIVLDLCWGSATACAAEVFQTLGADLTVLHGQPDGERINVACGSTQLDPLRQAVVAQGAVMGFAFDGDADRMLAVDARGRVVDGDHVLYLWGSVLQDQKALPGDRLVATVMSNLGFERAWERRGGELERTPVGDQHVHAAMVANGAALGGEQSGHILAASHGLCGDGVLTALQLATLCHGQDIALSDWLDRSFKAYPQKLVNVTVPDRARRKGWSSCMPLQEAVLQAEASMGAAGRVLVRASGTEPVLRVMVESEDQSLVDRWTQHLAAMADEHL

SEQ ID NO: 21050 - protein, 338 aa, SYNECHOCOCCUS SP. WH 8102
LMSGWHHRHILDLAAFSREDYAAVLDLAERFRSLPVTGARKLPALQGRLVATLFFEPSTRTRSSFELAAKRLSADVQSFSPSSSSLSKGESVLDTARTYVAMGADVLVVRHRSTGVPQQLAEDLESAGERTVVLNGGDGLHSHPSQGLLDLHTLARHFAPQHPMPEALQGRRIVIVGDILHSRVARSNLWALTACGADVVLCGPPSLVPDAFRAFVEAPPPGQSADPVPQRGSVRVERRLERALPGADAVMTLRLQKERMTQQLLTGLERYHRDFGLSHERLSLCGQPVPVLHPGPVNRGVEMTGALLDDPSICLVEEQVRNGVPIRMALLYLMAAAE

SEQ ID NO: 21051 - protein, 426 aa, SYNECHOCOCCUS SP. WH 8102
  unsure (1)..(426): unsure at all Xaa locations
LIPTISRFNVIKGASAPFFDAWXQIAMIWENRRTSGLAMTASAPASAQRSGVIAPYGGSLVDLMVPQEEREAVKATTTKSLECSDRNACDVELLVVGGFSPLRGFMHQEDYDAVVSGHRLVAGQLFGLPIVMDTDREDVVVGDTVLLTYKGQNLAVLQVEAKWEPNKVVEAKGCYGTTSIEHPAVRMITMERKRFYLGGSLNGLELPQRVFPCKTPAEVRAGLPDGEDVVAFQCRNPIHRAHYELFTRALHAQNVSENAVVLVHPTCGPTQQDDIPGAVRFQTYERLAAEVNNDRIRWAYLPYAMHMAGPREALQHMIIRRNYGCTHFIIGRDMAGCKSSLTGDDFYGPYDAQNFAKECAPELTMETVPSLNLVYTEEEGYVTAEHAEARGLHVKKLSGTQFRKMLRGGEEIPEWFAFKSVVEVLR

SEQ ID NO: 21052 - protein, 611 aa, SYNECHOCOCCUS SP. WH 8102
NKRWRNIGLTALLVLAIVVIAPAFLGGGNTQQEARTMRYSDFVEAVEDNQISRVLISPDRGTAQVVENDGRRAQVNLAPDKELLGLLTQHDVDIAVQPTRQAPAWQQAAGSLIFPLLLLGGLFFLFRRAQGGGGGNPAMQFGKSKARVQMEPSTQVTFTDVAGIEGAKLELTEVVDFLKNPDRFTAVGAKIPKGVLLVGPPGTGKTLLAKAVAGEAGVPFFSISGSEFVEMFVGVGASRVRDLFEQAKKNAPCIVFIDEIDAVGRQRGAGLGGGNDEREQTLNQLLTEMDGFEGNTGIIIVAATNRPDVLDAALMRPGRFDRQVTVDRPDYAGRLQILNVHARGKTLSKDVDLDKVARRTPGYTGADLANLLNEAAILAARRELTEVSNDEISDAIERVMAGPEKKDRVMSERRKRLVAYHEAGHALVGALMPDYDPVQKISIIPRGNAGGLTFFTPSEERMESGLYSRAYLQNQMAVALGGRVAEEIVYGEDEVTTGASNDLQQVASTARQMITRFGMSDTLGPVALGRAQGGMFLGRDIAAERDFSEDTAATIDQEVSELVDVAYKRATKVLVDNRAVLDELADMLVEQETVDAEELQELLITRDVRVA

SEQ ID NO: 21053 - protein, 360 aa, SYNECHOCOCCUS SP. WH 8102
MGSSFGDLFRISTFGESHGGGVGVIVEGCPPRLDLDVDAIQAELDRRRPGQSHITTPRKEADQVEVLSGLLDGQTTLGTPIAMLVRNKDQRPGDYKDMAVAFRPSHADATYQVKYGVQARSGGGRASARETIGRVAAGAIAKQLLAKAAGTEVLAWVKRIHTIEANVDPQAVTLDAIESNIVRCPDASTAAQMVERIEAIGRDGDSCGGVIECVVRNPAPGLGMPVFDKLEADLAKAVMSLPATKGFEIGSGFSGTLLKGSEHNDAFVPTDDGRLQTATNNSGGIQGGISNGEPIVIRVAFKPTATIRKEQQTIDSDGKATTLAGKGRHDPCVLPRAVPMVEAMVALVLADHLLRQQGQC

SEQ ID NO: 21054 - protein, 453 aa, SYNECHOCOCCUS SP. WH 8102
  unsure (1)..(453): unsure at all Xaa locations
RHQAXTAAGCPSGKVLIANRGEIALRILRSCRELGIATVAVYSTVDKDALHVQLADEAVCVGDALSSKSYLNVPNILAAATSRGVDAIHPGYGFLAENDKFAEMCGDHGLTFIGPSPHAIRSMGDKSTAKATMQAVGVPTVPGSEGLLAGPQDAAVLAEQMGYPVMIKATAGGGGRGMRLVQSPDQLNNLFKAAQGEAEAAFGNPGLYMEKFIDRPRHVEVQVLADRHGNVVHLGERDCSIQRRHQKLLEEAPSPALDPDLRRRMGEAAVAAARSINYEGAGTVEFLLDRSGGFYFMEMNTRIQVEHPVTEMVTGIDLIAEQLRIAGGEPISVQQGEINLSGHAIECRINAEDATHNFRPAPGRITGWLPPGGPGVRVDSHVYTGYDIPPFYDSLIGKVIVWGRNRDVALSRMKRALNECAVTGIPTTVEFHLALLDRPEFINGDVHTKFVEQ

SEQ ID NO: 21055 - protein, 1199 aa, SYNECHOCOCCUS SP. WH 8102
LVHINQVGLTQFKSFGGAMTIPLEQGFTVVTGPNGSGKSNILDGVLFCLGLATSRGMRADRLPDLINSAVLKAGKAAETTVCVRFDLSDWQPDAAEDGLEAPEEGPWIKPGQTEWTVSRKLRVMPGGSYSSSYSADGVACNLQQLQTQLRRLRIDPEGSNVVMQGDVTRIVSMSNRDRRGLIDELAGVALFDSRIEQTRRKLDDVQERQDRCRIIEQELLASRQRLEKDCAKARQYQQLRERLQLGRRQEMVLAFEAAGQALRDLASRQQALEAQEQRDAAAIASGKESLSKASAELQTLQEQVKALGEDQLLAVQAELKGLETSARELERQAGRHQEEGQRLQGLRHDLANRRQDWLHQSRELEQDPHQNSLAAAEATCRGAEAAVEVSRRRLGDVAGRSGAWLEEQKRRSGRRQELQVALAPLLEEQQQLQERLRQDAERLTELQQEQQQDGNDEQAVQQRLEQLEQDWQALLQSLSSGKQALQQTADSLAIQQRTRSRLEQEQTRLEREIARLESRRDALQETRGTGALRLLLEAGLNGIHGPVAQLGEVEDCHRLALEVAAGARLGQVVVDDDRIAAQAIALLKSRRAGRLTFLPLNKIRAPGGGNSGAAFARGPRAGGGENSDGLVGRAVDLVRFEPVYDQVFAYVFGDTLVFSDLSSARQQLGRSRAVTIDGELLEKSGAMTGGSLSPRSGGLSFGRSSDQDEAEPLRRRLLELGETLAACRREESKLAQTLEQQKPQLRELEQRQAALVAERNAARRNHGPLLERSRQRAERLSRLSQEQSDQQQRLAVIGQELTPLQEELHQLEAAERNSDGHDDAGAWQQLQQDLEAADGRLDSARKERDALLQSQRERQLAIERLGDQRQTLEEEERRLQEAVQALAATHTSWREQQLQLQQQRSSLQQQQSDLQERFGEQRRARDAAEAEVGRQRQALQQAEWNLERLKEEREGLIEEQRSGAVRLQEMEQALPDPQPEIPEELRLAGLEALQADLQTIQQRMEALEPVNMLALEELEALEQRLAELNERLEVLNSEREELLLRIETVATLRQEAFMEAFTAVDGHFREIFASLSDGDGQLQLENPDDPLEGGLTLVAHPKGKAVRRLAAMSGGEKSLTALSFLFALQRFRPSPFYALDEVDSFLDGVNVERLAALIATQAEQAQFMVVSHRRPMIAAAERTIGVTQARGAHTQVVGL

SEQ ID NO: 21056 - protein, 111 aa, SYNECHOCOCCUS SP. WH 8102
MPFISVKTNITDVQTPNGLLKKLSAALATATGKPESYVMTLLDSGVPMTFAGSEEPCALCRGQIIGALTPPAMSDQFCELIKSSLGIPKDRIYIGFDDVNASNWGWNGRTF

SEQ ID NO: 21057 - protein, 412 aa, SYNECHOCOCCUS SP. WH 8102
MALRAEPAAVVGWGSLNPLGADANSTWDAVIAGHSGIQTLQAPWSEDLPVRLAGCVPTGALDSLPPLLRRRSDRCAQLALVAARQAWAMTGPITQGLDPSRIAVVIGTGIGGLATMHDQHTQLSTGGPSRVNPLTVPMLIPDAAAGQVAIELGLLGGAHTPVSACASGAEALMLGQMLLNDDRADLVLAGGSEAPVNRLGLVGFAAMRALSSRNDAPDQASRPYGLGRDGFVLSEGAGVLALMRQRDTPAGADLGWLLASGSSSDAHHIVAPEPQGLQASRAIDDALRRADVSPSDLCGVQAHATGTSLGDLAEARALRRSLGSAADHLPVCAPKGQLGHLLGGAGAVETILALQALRLGVLPGSLNADPLDPEVELAVANQGPVQLSSDQGQRLLLKNAFGFGGHNISLVL

SEQ ID NO: 21058 - protein, 928 aa, SYNECHOCOCCUS SP. WH 8102
AGELRRYGTGKQLVAAGERPDGVWLITKGGVRSMAQLPPKGDWRTVQRHGVGDLVGWLGLVQGQPLEHLRTSDLTETQFIPADQFLQLWDEQPKLSQWCAQQMPAIEVVDLMIRLAQANPARARQLEEWRNALSLHSMAREASGHDNDDPQTVGGGQWHWPDGTIWPARPSNEGLQQRLIWLPDPKLQALDNYFAAEIVPTDASPSTNLTPEVLSLPRASGPRDIPMALCQALAQHFGVPFWRDNVRDEVEALLARQPQLNLFNIGQLLNNLDLSVSLAEIPLAQLRRTPAPAVLEHDGRIAILEGVDPDGQLRLLEPEIGPVRVPLEAVLSEEADRLSLLLLRRRPDSKTQRFSWGWYGPFLRPHRRELIEVIATSAVVNVLALVTPLGIMRLINARSGGSDSLDGVISIGVILIGATVVEAIASALRSLIFTGIANRVDMDTRETILDRLVRLPQAFFDERPVGRITYYFTQLDRLRDFLISKALTTILDFSFSLLYVAVLFALNPLLTLVTLSTLPLFIVLAIIVNPVVETQIERTIEEGVNTNSYLTEALTGIQTIKSQNAELKTRWEFQDRYSRFIGEDFKLKVSGETIGALAKFLGELSSISTMVVGVWLVSRNELSIGALFAFRIIGGKVTGPMVQLVQTWQQFKIQSRNLTLAADVVDRPTEQSDLQASNIPMPLIQGSVHIDSVDFRYSLNGPPILNNVSLDVPMGTFVGMVGGSGSGKSTLLKLLPRFYEPEQGRIQIDGLDVSKVELYSLRRQIGVVPQDSLLFDGTIKDNLLMVKPDATSQELIRATTIACAHDFIMELPQGYNASVGERGAGLSGGQRQRMALARAVLQNPRMLILDEATSALDARTERQVCRNLFEAFRGRTVFFITHRLSTVRPADMIVLMDQGAVMEVGQHQELMERQGWYYALYQSQSQEG

SEQ ID NO: 21059 - protein, 364 aa, SYNECHOCOCCUS SP. WH 8102
AKTALITGITGQDGSYLAELLLEKGYLVHGIKRRASSFNTTRIDHLYQDPHESDPRLVLHYGDLTDSTNLIRIIQQEQPDEIYNLGAQSHVAVSFEAPEYTANSDALGTLRILEAVRMLGLIGKTRIYQASTSELYGLVQEVPQKESTPFYPRSPYGVAKLYAYWITVNYREAYGMYACNGILFNHESPRRGETFVTRKITRGLARIDAGLEQCLFMGNLDSLRDWGHARDYVEMQWRMLQQEGPPEDFVIATGRQESVRRFIELAASELGWGSIQWQGRGLQETGSRADTGDVVVRIDPRYFRPAEVETLLGDPTRAKEKLGWIPTTTLEELVAEMVATDREDAKKDAHLKRKGFAVVGSMEN

SEQ ID NO: 21060 - protein, 826 aa, SYNECHOCOCCUS SP. WH 8102
AYPIDALLPELCARFQPGRTLLLQAPPGAGKTTRVPLALIGALGDQVRRDGRIWMIEPRRLAARAAADRLASSLEEPVGQRIGFAVRGEQRRSARTQVEVITDGLFLRRLQADPSLDGVSCVLFDEFHERRRDADLAFALLREAAALLRPDLSLMLMSATLDIADLRSRLPEATLLTSQGRAHPVDTLHQPPRADEPLPQQVLRAVETHGLDLPTGSGVLVFLPGLAEIERCRERLEHADALRHWQICPLHGQLPLERQSDALKRCPANRDGKLVLASGIAESSVTIDGVRLVIDSGLSRQLRFDPNTGMEGLETVPASLASADQRRGRAGRQGPGCCVRLWSPAEQQRRPSFSPPELLLADPQPVVMELAGWGAGLGDALPWLDPPPQAALREGQGELKSLGILDRDGRLTAIGLQLTQLGVHPRLGLLMVEAQRHGRSRLGCDLAALLSDRDPLSAAEVGCDLEARLEAMGEQKRCKPLRELSRQLERQLERLGIDPDAEGTGIDSAQLILTAFPKWLALQRPGQTGRYRLRQGRGAILRPTDPLAGSEALAVARLDMGQRDTRIQLAVPLSRQRVEQLALQQGEWLDQVSWDDKSERIRAERQLKLGALVLRQEAQPAPPAEQCRDLLLGRFRESGRLELLPWSDSCEQLRRRLALAHRHRGSPWPNRDRIPLIEHPEQWLGPCLEGCLSWRDLDELSLQEALWGELSWEHRQQLNRLLPLRLSIPSGREATLRYEDEEVVLAVKLQEMFGCQEGPTVLDNRLAVTVELLSPAGRPLQRTRDLRGFWQGSYNDVRREMRGRYPKHPWPDNPLEAIATAFTKRR

SEQ ID NO: 21061 - protein, 210 aa, SYNECHOCOCCUS SP. WH 8102
LAWAHQRFGSGFALTTSFGIQSAVLLHMLSQLPEGDAVPVIWVDTGYLPEETYRYGAQLTKLLSIRLVVAQSAMSPARMEALHGRLWDTGQLDDLEKYHQIRKVEPLDRALAQLEVSCWASGVRRGQTDHRRAMTVLDPIRERLSLRPLLDWTQKDIYYYMQDNNLPQHPLFEQGYSTVGDWHSSAPDGAELSGRNTRFGGLKQECGIHV

SEQ ID NO: 21062 - protein, 534 aa, SYNECHOCOCCUS SP. WH 8102
PFTDQKPGTSGLRKSSQQFEQANYLESFVEAVFRTLPGVQGGTLVLGGDGRYGNRRAIDVILRMGAAHGLSKVIVTTGGILSTPAASNLIRQRQAIGGIILSASHNPGGPNGDFGVKVNGANGGPTPASFTDAVFECTKTLEQYTIVDAAAIAIDTPGSYSIGAMQVEVIDGVDDFVALMQQLFDFDRIRELIRSDFPLAFDAMHAVTGPYATRLLEEILGAPAGSVRNGVPLEDFGGGHPDPNLTYAHELAELLLDGEEFRFGAACDGDGDRNMILGQHCFVNPSDSLAVLTANATVAPAYADGLAGVARSMPTSSAVDVVAKELGIDCYETPTGWKFFGNLLDAGKITLCGEESFGTGSNHVREKDGLWAVLFWLQILAERRCSVAEIMAEHWKRFGRHYYSRHDYEAVASDAAHGLFHRLEGMLPGLVGQSFAGRSVSAADNFSYTDPVDGSVTKGQGLRILLEDGSRVMVRLSGTGTKGATIRVYLESYVPSSGDLNQDPQVALADMISAINELAEIKQRTGMDRPTVIT

SEQ ID NO: 21063 - protein, 271 aa, SYNECHOCOCCUS SP. WH 8102
MAIRNFRPYTPGTRTRVVTDFSEVTGRKPERSLVVSKHRRKGRNNRGVITCRHRGGGHKRLYRVVDFRRNKHGITAKVAAIHYDPHRNARLALLFYADGEKRYILAPAGVQVGQTVVSGPDAPIENGNAMPLSAVPLGSSVHCVELYAGRGGQMVRTAGASAQVMAKEGDYVALKLPSTEVRLVRRECYATLGEVGNSEVRNTSLGKAGRRRWLGRRPQVRGSVMNPCDHPHGGGEGRAPIGRSGPVTPWGKPALGLKTRKRNKPSNRYVL

SEQ ID NO: 21064 - protein, 973 aa, SYNECHOCOCCUS SP. WH 8102
LLQHRLELVEDLWQTVLRSECPPEQSERLLRLKQLSDPVALEGRDGESSSEAIVELIRSMDLSEAIAAARAFSLYFQLINILEQRIEEDSYLDSLRPSRSQDDETAAPFDPFAPPLASQTDPATFGEVFERLRRMNVPPAQVETLLRELDIRLVFTAHPTEIVRHTVRHKQRKVASLLQRLQSEPALPRYDEEELRRQLEEEIRLWWRTDELHQFKPTVLDEVDSTLHYFQQVLFEAMPQLRRRLVSSLSRHYPDVQFPQASFCTFGSWVGSDRDGNPSVTPEITWRTACYQRQLMLELYIGSVQSLRNQLSISMQWSQVAPPLLESLEMDRLRFPEIYERRAARYRLEPYRLKLSYILERLELTLQRNHQMSEAGWQSPPEPAATAPTDGIPGHEALHYTAIDQFRSDLELIRNSLVSTELSCEQLDTLLNQVHIFGFSLASLDIRQESTRHSDAIDELTTHLQLPKAYGAMEESERVAWLLEELQTRRPLIPAAVEWSEATAQTFAVFQMLHRLQQEFGQRICHSYVISMSHTASDLLEVMLLAKEIGLVDPQAGKASLLVVPLFETVEDLQRAPAVMDGLFQTPIYRNLLPSVGVQRQPLQELMLGYSDSNKDSGFLSSNWEIHQAQIALQTLASSHGVALRLFHGRGGSVSRGGGPAYQAILAQPSGTLQGRIKITEQGEVLASKYGLPELALYNLETVTTAVVQNSLVTNQLDATPSWNQLMSRVAKRSREHYRALVHDNPDLVAFFQQVTPIEEISKLQISSRPARRKTGARDLSSLRAIPWVFGWTQSRFLLPSWFGVGTALAEEVNDDPEQLDLLRRLHQRWPFFRMLISKVEMTLSKVDLDLAHHYMSSLGNPEQRDAFEGIFKVIADEYGRTLKLVLEITGQSRLLGADQNLQLSVDLRNRTIVPLGFLQVALLRRLRDQNRQPPMSESPGTPEDRRTYSRSELLRGALLTLNGIAAGMRNTG

SEQ ID NO: 21065 - protein, 323 aa, SYNECHOCOCCUS SP. WH 8102
LPPEDSRARARAMVMGLQDEICAGLESLDGEGTFVEESWERPEGGGGRSRVMREGLVFEQGGVNFSEVQGQELPPSILKQRPEAKGHPWFATGTSMVLHPHNPYIPTVHLNYRYFEAGPVWWFGGGADLTPYYPFLEDARHFHRTHQAACDSVHPDLHKVFKPWCDEYFFLKHRGETRGVGGIFYDYQDSSGVLYKGQDPSGPAAGVSAQLGARPLGWEQLFALGQANGRAFLPSYAPIVEKRHPMAYGDRERQFQLYRRGRYVEFNLVWDRGTIFGLQTNGRTESILMSLPPLVRWEYGYKAEAGSREALLTELFTKPQDWL

SEQ ID NO: 21066 - protein, 315 aa, SYNECHOCOCCUS SP. WH 8102
IGFGTWAWGNQLLWGYDAERDDRLLEETFRQALASGLGLIDTADSYGTGRLNGRSEQLLGRFAARLPATRRADLCIATKLAPFPWRLGRRGLDQALQASRQRLQGHLRRVQLHWSTARYAPWQEVQLLDGLADRVLDGSISEIGVSNIGPKRLAWMQQRLAERGVPLRSVQVQYSLLSSGDAKVDALRQLCRERGIEVLAYSPLAFGVLTMPPDGERRPRTVLQRQLLARLQPASRSLRAVVATIAGQRSVSMAQVALNWCRAQGTTPIPGLRTPKQARDVAGTLKWSLTSEELDQLTVARQQCTVRTPSNPFQS

SEQ ID NO: 21067 - protein, 408 aa, SYNECHOCOCCUS SP. WH 8102
ETSLALGIDLGTSGVRIAVLNQQGTLIHSSSAEYATGLTAPLDWAEACRDLITHLPAQIRGQLAAVAVDGTSGTLLACREDGTPMGPALSYATAFPEQNSALKRLVPDGCAASSSGGSLARALQLLKHHGHIDRLRHQADWISGWFLQNWQWGEEGNNLKLGWDLEQATWQGCIADQSWSSALPEVKPSGSVLGRIAIDQARNLGVPEDLLVVAGTTDSNAAVLAANPGDNDGITVLGTTLVMKRFTPVPIQGAGITRHRIGQRWLCGGASNAGAGVLRRYFTDAELAELSRQIDPDQDSGLSYQPLPARGERFPVDDPNLEPVLEPRPVSDALFLHGLLEGLAEIEAKGWERLTELGADPPQRVISLGGGARNPQWRKIRQRRLGLPVVSCNQPPAAGVALLALSRQ

SEQ ID NO: 21068 - protein, 386 aa, SYNECHOCOCCUS SP. WH 8102
VTEGHPDKICDQVSDAVLDALLAQDPSSRVACETVVNTGLCMITGEVTSKAQVDFIHLVRNVIKEIGYSGARAGGFDANSCAVLVALDQQSPDIAQGVDEADDHEGDPLDRVGAGDQGIMFGYACNETPELMPLPISLAHRLAKRLAEVRHNGSLEYLLPDGKTQVSVVYENDKPVAIDTILISTQHTAEVAGISDEQGIRERITEDLWTHVVEPATADLALKPSREATKYLVNPTGKFVVGGPQGDAGLTGRKIIVDTYGGYARHGGGAFSGKDPTKVDRSAAYAARYVAKCLVASGLAERAEVQLSYAIGVAKPVSILVESFGTGKVSNAELTELVQEHFDLRPGAIIETFGLRNLPQQRGGRFYQDTAAYGHFGRNDLKAPWE

SEQ ID NO: 21069 - protein, 168 aa, Xenorhabdus nematophilus
MNCLLLYSTQDGQTKKIITYIAENLRRAGAECDLRDLATIKHINLKPYHKVMIGASIRYGHFNSVLHKFAIRHQKQLNQMPTAFFGVNLTARKLEKRTPETNAYLRKFLMKSPWKPNLCDVFAGALLYPRYRWLDRIMIQFIMRMTGGETDTTKEIEYTYWEQVDLFS

SEQ ID NO: 21070 - protein, 244 aa, Xenorhabdus nematophilus
MSFDGKIALVTGASRGIGRSIAELLVERGARVIGTATSENGAEAISAYLGDKGKGFVLNVTDSESVEKTLSNIRAEFGEIDILVNNAGITRDNLLMRMKDGEWQDIIDTNLSSIFRLSKAVMRSMMKKRYGRIISIGSVVGTMGNAGQANYAAAKAGVIGFSKSLAREVASRGITVNVVAPGFIETDMTRALTDDQRVGILSEIPASRLGDAKEIASAVAFLASDEAAYITGETLHVNGGMYMI

SEQ ID NO: 21071 - protein, 215 aa, Xenorhabdus nematophilus
LGEYSALVCAGVIEFQQAIKLVELRGKLMQEAVPEGQGAMYAIIGLDNESIAKACKESAQGQVVSPVNFNSPGQVVIAGEKEAVERAGAACKAAGAKRALPLAVSVPSHCALMKSAAAQLAVALQSIVFNQPQFPVVNNVDVKVEESADGIRDALVRQLYNPVRWTESVEYIAAQGTEQLLEMGPGKVLTGLTKRIVDTLNAVAVNDVSSLTVAL

SEQ ID NO: 21072 - protein, 347 aa, Xenorhabdus nematophilus
LAPKAETIRLMGDKVSAINAMKTAGVPCVPGSDGSLGNDTEKNKAIAKRIGYPVIIKASGGGGGRGMRVVRSDKDLEQSIAMTRAEAKAAFNNDMVYMEKFLENPRHVEIQVLADGQGHALYLAERDCSMQRRHQKVVEEAPAPGISAELRRTIGERCANACIEIGYRGAGTFEFLYENGEFYFIEMNTRIQVEHPVTEMITGVDLIKEQLRIASGLPLSIKQEDIVIEGHAIECRINAEDPKSFLPSPGKITHFHSPGGFGVRWESHIYAGYTVPPYYDSMIGKLITYGETREVAIARMKNALAELIIDGIKTNIDLQVAIMNDENFQKGGTNIHYLEKKLGLQEK

SEQ ID NO: 21073 - protein, 284 aa, Xenorhabdus nematophilus
MSAKIIDGKTIAQTIRSEVAEKVRQRIAAGRRAPGLAVVLVGENPASQIYVASKRRACEEVGFTSRSYDLPDITSEAELLSLIDNLNEDPEIDGILVQLPLPAGIDNVKVLERIHPDKDVDGFHPYNIGRLCQRAPKLRPCTPRGIVTLLERCNINTYGLHAVIIGASNIVGRPMSLELLLAGCTTTVTHRFTKNLRQHVEQADLLVVAVGKPNFIPGEWIKPGAIVIDVGINRLENGKVIGDVDFDSASERASWISPVPGGVGPMTVATLIQNTLQACEEYHD

SEQ ID NO: 21074 - protein, 290 aa, Xenorhabdus nematophilus
MAYMLKYINHGRLNGTVEVKNGQLVVNGKTIRVTSERDPANLKWNEVGVDVVAEATGIFLTDETARKHIAAGAKKVVLTGPSKDDTPMFVMGVNHNAYAGQEIVSNASCTTNCLAPLAKVINDKFGIVEGLMTTVHATTATQKTVDGPSAKDWRGGRGAAQNIIPSSTGAAKAVGKVIPELNGKLTGMSFRVPTPNVSVVDLTARLAKPATYKEICDAIKEASEGELKGILGYTEDDVVSTDFNGEKLTSVFDAKAGIALNDNFVKLVSWYDNETGYSNKVLDLVAHISK

SEQ ID NO: 21075 - protein, 480 aa, Xenorhabdus nematophilus
MSRRLRRTKIVTTLGPATDRDGNLEKVISAGANVVRLNFSHGTAEDHVQRANKVREIAARLGYHVAILGDLQGPKIRVSTFKEGKIFLNIGDKFLLDANLGKGEGDKEKVGIDYKGLPSDVTTGDTLLLDDGRVQLRVLDVQGMKVFTEVTVGGPLSNNKGINKQGGGLSAEALTEKDKQDIITAAKIGVDYLAVSFPRSGEDLNYARRLARDAGCETQIVAKVERAEAVSSDDIIDEIILASDVVMVARGDLGVEIGDPELVGVQKKLIRRARQLNRVVITATQMMESMITNPMPTRAEVMDVANAVLDGTDAVMLSAETAAGQYPAETVAAMAQVCLGAEKMPSINVSKHRLDITFDSIEEAISMSAMYAANHLKGVKAIIAMTESGRTARMMSRISSGLPIFSMSRHESTLNRTALYRGVTPVYCSTHTDGISAANEAVNRLRDKGYLTSGDVVLVTQGDQMETIGSTNTCRVLEVE

SEQ ID NO: 21076 - protein, 749 aa, Xenorhabdus nematophilus
MLNQELELSLNIAFAKARDNRHEFMTVEHLLLALLSNTSARGALEACKVDLVMLRQELENFIAQTTPLLSENDDRDTQPTLSFQRVLQRAVFHVQSSGRSEVSGSNVLVAIFSEQESQAAYLLRKHDVSRLDIVNFISHGTRKDESDNESHHSVNPIQEEQVINEDRLENFTTNLNQLAQKGQIDPLVGRQHELERTVQVLCRRRKNNPLFVGESGVGKTAIAEGLAWRIVQKDVPEVIKDCTIYSLDIGSLLAGTKYRGDFEKRFKSLLKTLEQDSKSILFIDEIHTIIGAGAASGGQVDAANLIKPLLSSGRIRVIGSTTYHEFSNIFEKDRALARRFQKIDILEPSSEETVQIINGLRTKYEAHHDVRYTAKAIRAAVELSVKYITDRHLPDKAIDVIDEAGARTRLVPASRRKKTINVADIESVVARIARIPEKTVSASDKDVLRTLDDRLKMLVFGQDKAIGVLTEAIKMSRAGLGQEHKPVGSFLFAGPTGVGKTEVTLQLAKMLNIKLLRFDMSEYMERHTVSRLIGAPPGYVGYDQGGLLTDAIIKHPHSVLLLDEIEKAHPDVFNLLLQVMDNGTLTDNNGRKADFRNVILVMTTNAGVREIQRKSIGFTEQYNSIDGMEEITRIFTPEFRNRLDGIIWFHALSAEVIQLVVDKFIVELQAQLDEKGVSLEVSADARQWLCDKGYDRAMGARPMTRVIQDNLKKPLANELLFGSLIHGSVRINLDKDKRALIYDFKSAQK

SEQ ID NO: 21077 - protein, 469 aa, Xenorhabdus nematophilus
MKKTKIVCTIGPKTESETKLTELLNAGMNVMRLNFSHGDYEEHGQRIKNLRAVTAKTGKKAAILLDTKGPEIRTIKLEGGNDVSLTAGQTFTFTTDKSVVGNQECVAVTYAGLPADLKPGNTILVDDGLIAMTVKNITETEVICEVLNNGDLGENKGVNLPNVAINLPALAEKDKQDLIFGCEQGVDFVAASFIRKRSDVLEIRDHLKAHGGEHIQIISKIENQEGLNNFDEIMEASDGIMVARGDLGVEIPVEEVIFAQKMMIEKCNAARKVVITATQMLDSMIKNPRPTRAEAGDVANAILDGTDAVMLSGESAKGKYPIEAVSIMATICERTDRIMNSRIENIKTQKLRVTEAICRGAVEIAEKLEAPLIVVATYGGKSARSIRKYFPNAPILALTTNEITARQLLLVKGVSTQIVKEIASTDDFYRIGKEAALASGIANKGDAVVMISGALVPSGTTNTSSVHVL

SEQ ID NO: 21078 - protein, 315 aa, Xenorhabdus nematophilus
VPDMKLFAGNATPELAQRVANRLYTSLGDAAVGRFSDGEVSVQINENVRGGDVFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQKGLENPIVVSPDIGGVVRARAIAKLLNDTDMAIIDKRRPRANVSQVMHIIGDVAGRDCVLVDDMIDTGGTLCKAAEALKERGAKRVFAYATHPIFSGNAVENIKNSVIDEFIVCDTIPLSAEIKALNKVRTLTLSGMLAEAIRRISNEESISAMFEH

SEQ ID NO: 21079 - protein, 280 aa, Xenorhabdus nematophilus
MTLTWPSPAKLNLFLYITGQRSDGYHELQTLFQFLDYGDEITITPRQDNQIHLLTPVEGVAHDNNLIVRAARLLQDHLLQNNNKGTQHLGADIHIDKCLPMGGGLGGGSSNAATVLIALNYHWQANLSDDELAQLGISLGADVPVFIKGHAAFAEGIGEKLRPASPEEKWFLVAHPGIEISTPTIFTDPELKRNSPIRSLPALLQAPFTNDCESIARKRFRKVEQLLSWLLEYAPSRLTGTGACVFGEFESEASARKVLNQSPEWMQGFVARGVNISPLH

SEQ ID NO: 21080 - protein, 200 aa, Xenorhabdus nematophilus
LFRLLPLSAVLLTACTVTQPPTGTGSANSPQWHIREQQLQKLKNYQTRGSFAYLANEKKVYARFFWQQYSPDNYKLLLLNPLGTTELELFVQPNMIQLTDNNGKKYLSDTPESLIYQLTNMNIPLDNLKNWIIGLPGDAKDFQLDENYLLKSVSSKKNGEIWKVNYQGYDASTMPVLPNRLELTQGKNRIKLKMDNWTTQ

SEQ ID NO: 21081 - protein, 296 aa, Xenorhabdus nematophilus
MTLLALGINHKTAPVSLRERVAFSPDTIGLALDNLLQQRLVRGGVVLSTCNRTELYLSVEPQDNLKDQLISWLCEYHQLNPDDLKASLYWHLDNDAVSHLMRVASGLDSLVLGEPQILGQVKKAFAESQNYQSLSGELERLFQKSFSVAKRVRTETEIGANAVSVAFAACTLARQIFESLSKLNILLVGAGETIELVARHLKEHRVRHMMIANRTKERAQTLASQVNAEVISLSEIDTRLAEADIVISSTASPLPIIGKGMVERALKVRRNQPMLLIDIAVPRDIEPDVEKLSNAY

SEQ ID NO: 21082 - protein, 292 aa, Xenorhabdus nematophilus
FTGSMVAMVTPMNSNGQIDKTSLKKLIDYHVASGTSSIISVGTTGECATLNQDEHVDVVLTTLELADGRIPVIAGTGANATAEAISLTRRFENTGIAGCLSVTPYYNRPSQEGLYQHYKAIADNTDLPQILYNVPSRTACDLLPSTVARLAKLENIVAIKEATGNLGRVSQIQELVNDENFILLSGDDASFLDFVQLGGKGVISVTANVAAAEMAQIYELAQKGEFVKARSLNNRLMELHHQLFVEPSPTPAKWACRKLGLIADDTLRLPMIPLTQAGQVSVNNALKLAGLL

SEQ ID NO: 21083 - protein, 663 aa, Xenorhabdus nematophilus
MTTRKTLANAVRFLSMDAVQKAKSGHPGAPMGMADIAEVLWRDYLNHNPVNPNWADRDRFVLSNGHGSMLIYSLLHLTGYDVSIDDLKNFRQLHSKTPGHPEYGYTAGVETTTGPLGQGVANAVGFAIAERTLAAQFNRPGHDIVDHHTYVFMGDGCMMEGISHEVCSLAGTLKLGKLIAFYDDNGISIDGEVEGWFTDDTAARFDAYGWHVIRGVDGHDSDAIKAAIEEAQKETGKPSLLMCKTIIGFGSPNKAGKEECHGSPLGDAEIEATRKALGWEHPAFDVPQDIYAGWDAKAAGKAKEATWEEKFAAYAKAHPELAAEFNRRTRGELPANWEAESKAFIENLQQNPASIASRKASQNALEAFGKVLPEFMGGSADLAPSNLTMWSGSKPLNEVQDGNYIHYGVREFGMSAIMNGIALHGGFVPYGATFLMFVEYARNAVRMAALMKIRSIFVYTHDSIGLGEDGPTHQPVEQIASLRVTPNMSTWRPCDQVESAVAWKYAIERQNGPTALIFSRQNLAQQARTAEQLANIEKGAYILKDCAGQPELLLIATGSEVELAVKAADQLSAAGRQVRVVSMPSTDAFDKQDAAYREAVLPAAVSARVAIEAGIADYWFKYVGLNGAIVGMETFGESAPADLLFKEFGFTVENVVAKATSLL

SEQ ID NO: 21084 - protein, 225 aa, Xenorhabdus nematophilus
  unsure (1)..(225): unsure at all Xaa locations
MTIRIAINGFGRIGRSILRALYESGRQTEISVIAINELADAEGIAHLLKYDSSHGRFAWDVRLNNNLLLVGDDSIRLFHQPDISALPWKELGIDIVLDCTGKYGDRADGEAHIASGAKKVLFSHPGGNDLDATVVYGVNHHELVAEDCIVSNASCTTNCIIPIIKLLDDAFNIESGTVTTIHASMNDQPVIDAYHSDLRRTRAASQSIIPVDTKLSAGIXRYLPQ

SEQ ID NO: 21085 - protein, 244 aa, Xenorhabdus nematophilus
ILELNNITVDKRLTTLSESVIAKEQIHLVGLNGSGKSTLLSAIAGILPYSGKIHLNGRNLRDYRQYELAKYRAWFSQSVSVPIMPVYQYLDMYRPDSAPLDQSESVLYELCRQLKLTSLLSSSIGQLSGGEWQRVRLAGVFLQIWPELNPNGKLLLLDEPTNNLDITQQTVLDQLIKQFCSLGGSVLMSSHDLNHTYEQATSVWLLSHGKLLVSGIPQNVMTNQNLSEIFEVNIRHIQNTSYKL

SEQ ID NO: 21086 - protein, 497 aa, Xenorhabdus nematophilus
VGDTITEEQSLITVEGDKASMEVPAPFAGTVKEIKIAAGDKVKTGSLIMVFEVAGSGAAPAAAPAPVAAAPAASAAKEVNVPDIGGDEVEVTEIMVKVGDTITEEQSLITVEGDKASMEVPAPFAGTVKEIKIAVGDKVKTGSLIMVFEVVGAAPAVALAAAPSLAVESVKAAPAASQPAEGKNEFAENDAYVHATPVIRRLAREFGVNLAKVKGTGRKGRILREDIQAYVKDAIKRAEAAPTAAAGGGMPGMLPWPKIDFSKFGEIEEVEMSRIQKISGANLSRNWVMIPHVNLFDEADITEVEEFRKQQNKEAEKKQLGVKITPLVFVMKAAAKALEAMPRFNSSISEDGQKLILKKYINIGIAVDTPNGLVVPVFKDVNKKGIMELSRELAEVSKKARAGKLTASDMQGGCFTISSLGGIGTTGFAPIVNAPEVAIMGLSRSSMKPVWNGKEFVPRLILPMSLSFDHRVIDGADGARFITYINEVMSDIRRLAM

SEQ ID NO: 21087 - protein, 474 aa, Xenorhabdus nematophilus
MSTEIKAQVVVLGAGPAGYSAAFRCADLGLDTVLVERYSTLGGVCLNVGCIPSKALLHVAKVIEEAKALAQHGIVFGEPQTDIDKIRLWKEKVISQLTGGLGGMAKGRKVNVVNGIGKFTGANTLVVEGEKGATTINFDNAIIAAGSRPIQLPFIPHDDPRVWDSTDALELKTVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKSLDAGQAGVAVDERGFIHVDKQMRTNVPHIFAIGDIVGQPMLAHKGVHEGHVAAEVISGKKHYFDPKVIPSIAYTEPEVAWVGLTEKEAKEKGISYETATFPWAASGRAIASDCAEGMTKLIFDKESNRIIGGAIVGTNGGELLGEIGLAIEMGCDAEDIALTIHAHPTLYESIGMAAEMYEGSITDLPNPKAKKK

SEQ ID NO: 21088 - protein, 218 aa, Xenorhabdus nematophilus
AVSHLNAEIQGGSVTGLVGPDGAGKTTLIRMLAGLLKPDNGNIKIMGLDPIKDSVKVRSELGYMPQKFGLYEDLTVLENLNLYAELRGVLREERKATFQKLLTFTELTHFTGRLAGKLSGGMKQKLGLACTLLGSPKVLLLDEPGVGVDPIARQELWQMVHELASDGMLILWSTSYLDEAELCRDVLLLNRGKLLYRGQPQKLTQNIVGRSFLLDVKQ

SEQ ID NO: 21089 - protein, 455 aa, Xenorhabdus nematophilus
MNFESLGLKADILRAVEEQGYVEPTPIQQQAIPVVLSGKDLLASAQTGTGKTAGFTLPILQLLSESPAQAKGRRPVRALILTPTRELAAQVGENVCNYSKYLRLRSLVVFGGVSINPQMMKLRGGVDILVATPGRLLDLEHQNAVDLSHVEILILDEADRMLDMGFIHDIRRVLSKLPAKRQNLLFSATFSDDIKSLANKLLRDPVSIEVARRNSASEQIDQAVHFVDKKRKGELLSYMIGNQNWQQVLVFTRTKHGANRLAEQLSQDGVTAAAIHGNKSQGARTRALADFKSGRIRALVATDIAARGLDIDQLPHVVNFELPNVAEDYVHRIGRTGRAEATGQAISLVCVDEHKLLHDIERLLKREIPRIAISGYDPDPSIKAEPILNGSNSRGSQRGNGRQSPSNQGSSKPNRSNQSRSNQGSTKQHSDRPRSKGTPSGQRRQRTSSKTSNVA

SEQ ID NO: 21090 - protein, 278 aa, Xenorhabdus nematophilus
MKNEYFVSPQWLNDHLHDENVVIVDASAPMPTQTIDYHQLWLDNHIPGAQFFNLDKIANLQTNLPHMLPEPEVFRQAVSAMGISENHLVIIYDQGNMFSAPRAWWTFKIFGTRNIRILEGGLQGWQQMGYPTESGEVTRQPQIFNSQFTPEKVCSQEQILDALHHKAPIQFIDARAEDRFQAKVPEPRPGLRMGHIPGSKNVPWTTLIDNGSYKSPDEIAAIFKKQGVDLKQPIMTSCGSGMTAAVLVLGLDMIGHKEVGLYDGSWAEWGADDSLPLE

SEQ ID NO: 21091 - protein, 288 aa, Xenorhabdus nematophilus
MSILIDKNTKVICQGFTGSQGTFHSEQAIAYGTQMVGGVTPGKGGTEHLGLPVFNTVREAVEATGATASVIYVPAPFCKDSILEAIDAGIKLIITITEGIPTLDMLTVKVKLDQAGVRMIGPNCPGVITPDACKIGIMPGHIHKAGKVGIVSRSGTLTYEAVKQTTDAGLGQSTCVGIGGDPIPGSNFIDILKLFQEDPQTEAIVMIGEIGGTAEEEAAAYIKEHVTKPVVAYIAGVTAPKGKRMGHAGAIIAGGKGTADEKFAALEAAGVKTVRSLADIGDAVKVLL

SEQ ID NO: 21092 - protein, 338 aa, Xenorhabdus nematophilus
AGGRGKAGGVKVVNSKEDIRAFAEQWLGKRLVTYQTDAQGQPVHQILVEGATDIAKELYLGAVVDRGTRRVVFMASTEGGVEIEKVAEETPELIHKAIIDPLAGPMPYQGRELAFKLGLTSKQVGQFTKIFMGLAKLFLERDLAMVEINPLVITTQGDLICLDGKLGADGNAMFRQAELREMHDPSQEDPREAQAAQWELNYVALDGTIPPMVNGAGLTMGTMDIVKLHGGAPANFLNVGGGATKERVTEAFKIILSDENVKAVFVNIFGGIVRCDLIADGIIGAVEEVGVHVPVVVRLEGNNAELGAKKLADSGLNIIAASSLTDAAKQAVAAAGNK

SEQ ID NO: 21093 - protein, 280 aa, Xenorhabdus nematophilus
LKIAVVGGGNIGSSLAFDCALHGHDVVVIEKDVLACEQSRERVTETAGYAPLFSPLAKGKTTEEILLNIVWSQDLQAVSDCGFVVENITENIELKQALYARMSEFIAPHAVLAANTSCIPITKLGSFHKTPSQVIGVHFMNPVYLKHTVEVIVGLNTSEQTKARCLEILGMLGKNAVVVKDGPGFVSNRISHLFMNEAAFTIQDGVAQPADVDAIFKQCFGHKMGPLETADLIGIDTVVNSLDVLYQMFQDSKYRVCPLMRTMVDAGRLGRKSGRGFYTY

SEQ ID NO: 21094 - protein, 891 aa, Xenorhabdus nematophilus
MSFKLKTDCASTLSIGSKIYHYYSLSLLSERLGEIARLPKSMKVLLENLLRNIDGDSVVEEDLKALVEWQKNGHADREIAYRPARVLMQDFTGVPAVVDLAAMREAVLRLGGNVEQVNPLSPVDLVIDHSVMVDKFGTEQAFEENVQIEMERNYERYLFLRWGQKAFNRFRVVPPGTGICHQVNLEYLGKSVWYENQNGKDFAYPDTLVGTDSHTTMINGLGVLGWGVGGIEAEAAMLGQPVSMLIPDVVGFKLTGKLREGITATDLVLTVTQMLRKHGVVGKFVEFYGDGLSDLPLADRATIANMAPEYGATCGFFPVDDITLGYLRLTGRNKDEIALVEAYCKKQGLWRNAGDEPIFTNNLELDMYTVEVSLAGPKRPQDRVALGDVPHAFQAAMELDIHKIQEHRADTPVTLDNQTFALQDGAVVIAAITSCTNTSNPSVLMTAGLLAKKAIEKGLQRHPWVKTSLAPGSKVVTGYLELAGLMPYLEKLGFNLVGYGCTTCIGNSGPLPEPIEVAIKQSDLMVGAVLSGNRNFEGRIHPLVKTNWLASPPLVVAYALSGNMKKDLTREPLGQDQQGHDIYLQDIWPDSQEVAEAVGKVRTEMFHKEYNAVFDGDENWQSLEVESSETYSWQQNSTYIRLPPFFSDMTIEPKPITDIHQANILVILGDSVTTDHISPAGNIKADSPAGRYLQEHGVLPKDFNSYGSRRGNHEVMMRGTFANIRICNEMVPGVEGGYTRHIPSQAQLAIYDAAMLYQEDKTPLAIIAGKEYGSGSSRDWAAKGTRLLGARVVIAESFERIHRSNLIGMGVLPLEFPQGVSRKTLNLTGDERIDIVGLGHIEPGQIIAVKINYANGKETVIDARCRIDTNTELAYFYNDGILHYVIRNMLK

SEQ ID NO: 21095 - protein, 1087 aa, Xenorhabdus nematophilus
  unsure (1)..(1087): unsure at all Xaa locations
ICGKVVRQQIRSMVLDKLAQLGPVWVKGKPAGSWATIILEQIEDMQDFYSRYLPQMALATIIPLLILMTVFPVNWAAGLILLVTAPLIPLFMTLVGLGAADANRRNFVALSRLSGNFLDRLRGLETLRVFHRGEAEVKQLTESTDNFRHRTMEVLRMAFLSSAVLEFFAAVSIAVVAVYFGFSYLGELHFGSYGLGVTLFAGFLALILAPEFFQPLRDLGTFYHAKAQAVGAAESLFTLLSSEGEHSVFNGERMLPDTKSVTIEANELEIRSHDGHRLAGPLSFTIDQHQRIALVGKSGAGKSSLINLLLGFLPYRGSLKINGIELRELNLTKWREQLSWVGQNPHLPEQTLLDNIRLGQFDATQDQINDVMEQAYVSEFIYALPDGVNTVIGDNAARLSVGQAQRIAVARALLNPCQLLLLDEPAASLDAHSEQRVMMALNQASSQQTTLLVTHLLEETLEYDQIWVMENGLIIEKGHYQSLSQSQGAFSRLLSHRSVELXSCVYYSHFSHSIAATGFSSAXAWYXRLXPCXPVLACXRFPAGFLPVQPWQDSRGYIRSIICCQPLASVVQLFSVLLAVMVNDWVSHDATFRVLAHLRVFAFQKILPLSPGGIARFRQGELLNRIVADVETLDHLYLRVISPVLSALVVIVVLTFGLSFLDVTLAYTLGGIMLGLLIILPFGFYHAGKALWQRHHPTTRSNIVHYSLARCRDRRSXQCLAHSGVFDNQXQTLNPIGXNANNSKPTXRGFLKPLXFSLQAXQXLCYFGWQQQVXGNIANPEHXXLYLRSVLSLLSKALGPVTVAFQHMGQVISSATRVSQLMHQEPEVTFPAHGPQTTDSLNLEIKNIDFTYPEQPLPVLKNISLSLASGEHIALLGKTGCGKSTLLQLLSRAWNVDHGEIQLNQQPISQYDETTLRSMMSIVPQRIHVFSHTLRENLLLAKPDASDDELVIVLKQVGLGNLLDNNEKLNCWMGEGGRQLSGGEQRRLGIARALLHNAPLMLLDEPTEGLDADTEQQILSLLRHSCQHKTLIVVTHRLTGLQHLDRICVMDEGRIIEQGKHDVLLAQQGRYYQFYQRQSYPEQEXSF

SEQ ID NO: 21096 - protein, 582 aa, Xenorhabdus nematophilus
IMNDKDLSTWQTFRRLWPLITPFKLGLAVAAIALVINAAGDTLMLSLLKPLLDEGFGKADMSVLEWMPLVVIGLMLLRGISGFISSYCISWVSGKVVMQVRRRLFTHMMGMPVSFFDQQSTGTLLSRITYDSEQVASSSSGALVTVVREGASIIGLFILMFYYSWELSLILIVIAPIVALVIRLVSVRFRNISKNMQNSMGMVTTSAEQMLKGHKEVLIFGGQKIETKRFNQVSNHMRQQGMKMVSASSISDPIIQLIASFALAFVLYAASFPEIMGALTAGKITVVFSSMIALMRPLKSLTNVNAQFQRGMAACQTLFAILDMEQEKDEGKLELKKAKGDLEFRNVTFCYPTKDHPALKSISMTIPKGKTVALVGRSGSGKSTIANLLTRFYDINEGGIMLDGHDLREYSLSSLRSQIALVSQNVHLFNDTVANNIAYASEGKFSREEIERAAEMAYAMDFIKKLDQGLDTMIGENGVLLSGGQRQRIAIARALLRDSPILILDEATSALDTESERAIQAALDELQKNRTSLVIAHRLSTIENADEIIVVEDGFIVEKGNHSVLLEKDGAYAQLHRMQFGQ

SEQ ID NO: 21097 - protein, 442 aa, Xenorhabdus nematophilus
MSSRKYFGTDGIRGKVGDSPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDNVEEAIEAEMEKPLTCVESAELGRANRIVDAAGRYIEFCKGTFPSEQSLNGLKVVLDCANGATYHIAPNVLRELGANVVTIGCEPNGININEECGATDVRLLQKRVQEEQADVGLAFDGDGDRIIMVDHLGQKVDGDQILYIIAREALRQGQLRGGAVGTLMSNIGLELALKQLGIPFERAKVGDRYVLEKLQEKGWRLGAENSGHVILLDKTTTGDGIVAGLQILSAMVRNNMSLHDLCSGMKLLPQILVNVRFAGDNDPLQSESVLEAVKSVEAELNGRGRVLLRKSGTEPLIRVMVEGEDEELVTALAHRIADAVK

SEQ ID NO: 21098 - protein, 630 aa, Xenorhabdus nematophilus
MAKNLILWLVIAVVLMVLFQSFGPGDSSGRRVDYSNFISELSQNQVREVRISGRDIDYSKKDDGKKYSTYMPIQDEKLLDTLLNKQVKVIGEPPEQQGLLATLFISWFPMLLLIGVWIFFMRQMQGGGGKGAMSFGKSKARMLTEDQIKTTFADVAGCDEAKEEVGELVEYLREPGRFQKLGGKIPKGILMVGPPGTGKTLLAKAIAGEAKVPFFTISGSDFVEMFVGVGASRVRDMFEQAKKSAPCIIFIDEIDAVGRQRGAGLGGGHDEREQTLNQMLVEMDGFEGNEGIIVIAATNRPDVLDPALLRPGRFDRQVVVGLPDVRGREQILKVHMRRIPLDTDVDASIIARGTPGFSGADLANLANEAALFAARGNKRVVSMVEFEKAKDKIMMGAERRSMVMTEEQKESTAYHEAGHAIIGRLVPEHDPVHKVTIIPRGRALGVTFFLPEGDQISASRQKLESQLSTLYGGRLAEEIIYGVDSVSTGASNDIKVATSIARNMVTQWGFSEKLGPLLYAEEEGEIFLGRSVAKAKHMSEDTARLIDQEVKAIVDRNYQRARKILMDNLDILHSMKDALMKYETIDVSQIDDLMNRTTVRSPAGWEGDNNNGGNNRHNMSSPQQTVKPAD

SEQ ID NO: 21099 - protein, 643 aa, Xenorhabdus nematophilus
MRLFIAEKPSLARAIADILPKPHRRGDGFIECGNNQFVTWCVGHLLEQAEPDTYDSRYARWVLSDLPIIPEKWRLKPRAAVAKQLNTIKSLLEKADEVIHAGDPDREGQLLVDEVLDFLNLRDDKKQNVQRCLINDLNPQAVIKAVERLRSNREFIPLCVSALARARADWLYGINMTRAYTLLGQNAGYQGVLSVGRVQTPVLGLVVRRDEEIEHFVPKDFFEVKAYIVTPNEEQFTALWQPSESCIDFQDEEGRLIHQPLAEHVVARITGQPAYVTAYQDKRESETAPLPFSLSSLQIEAAKRFGLSAQNVLDICQRLYETHKLITYPRSDCRYLPEEHFVGRHAVLNAISIHSSDLLPQDALESDKKNRCWDDKKVDAHHAIVPTARSSQVNLTENERQIYGLIARQYLMQFLPDAVFRKCTIELDIAGGKFIAKARFLAEAGWRTLLGNKERDEENEGTPLPVVAKGDELLCEKGEVVERQTQPPRPFSDATLLSAMTGIARFVQDKSLKKVLRATDGLGTEATRAGIIELLFKREFLYKKGRNIHATPAGRALIHVLPDMAVLPDMTAHWESKLTQISEKQFRYQDFMLPLQETLQQLIWQAKQYRNLKAFRDLPPVPMKGKKGKTKQVKKGKEKVNKT

SEQ ID NO: 21100 - protein, 268 aa, Xenorhabdus nematophilus
MKFVSFNINGLRARPHQLAAIVEQHQPDVIGLQETKVHDEMFPLEEVSKLGYHIFYHGQKSHYGVALLTRQQPVTVRKGFPTDDDDAQRRIIMADIETPQGLMTIINGYFPQGESREHPVKFPAKEKFYQDLNRYLEKNQSPDSHILIMGDMNISPTDLDIGIGENNQKRWLKTGKCSFLPEEREWMGRLKDWGLIDTFRAQHPEASDQFSWFDYRSKGFDDNRGLRIDLLLASRPLAERCLSSGIDYAIRSMEKPSDHAPVWAEFGI

SEQ ID NO: 21101 - protein, 3390 aa, Xenorhabdus nematophilus
  unsure (1)..(3390): unsure at all Xaa locations
PKDTILNCCIHELFERQVEKTPDAVAVRFGEQSLSYAELNRRANQLARFLRDDLHVGPDTLVGVCVERSIEMVVALLAVLKAGGAYVPLDPHYPAERLDYMLHDAAPRALLSHGAVPAGVRALLDQYAMSTNVSVIDLEADVSQWSGQNSDNLHPADNGLTSSHLAYVIYTSGSTGRPKGVMNQHVGVVNRLVWMQKAYRLNASDAVLQKTPFSFDVSVWEFFWPLMYGARLVVAKPEGHKDPAYLSALIQEHRITTLHFVPSMLSAFLDQAPSEVDDCLQRVFCSGEALPARSMHRFRERFAKVELHNLYGPTEAAIDVTAWNCCLDETDSLIPENVIPIGKPIDNIQIYILDADGQPCPVGVAGELHIAGVGVARGYLNQPELTAEKFIKNPFSPALNGVMYRTGDLARYLPSGDIEYLGRNDFQVKLRGFRIELGEIEARLMKHPAVRDAVVLAQGESAEDKRLVGFVIAAERALQRQSRESVKESIQRLINDTVPDYMRLAAIVIVSGFPLSASGKIDRKSFPVITFDEFTAQDVEPPKNALEQTLVEVWSELLGVKNIGRNAHFFNLGGHSLLSLKMVLALRRRGLFVDGYTLYQYPVLSELATQLQVSDPQETRSDMAECSMVEASAWAQLSQKEIDVLTAAIPGGLTNIQDIYPLGALQQGMLYHYLTNLAGDPYVLWQVVRFRNADLLHAYVNALRGTIARHDTFRVSVHYKGLSQPVQVVWRDAELTVEELKPTMDCDDPLVILKQHCDPAMLRFDITKAPLQRCLYCYDPKRDEWVLLHLIHHMTVDHTTVEKMQQEIEAQLSSEPPAPIVPISFRQVNADLVRATGAEAQKAFFDAMLRDYEPTPAPFGAGEYLGGNAVVVEAWRPLQERLCSQIRQQAKAHGVSAAAVFHLAWAKVIACLTGCNDVVFGTVLLGRMFAGENAENIMGPFINTLPIRIRLDNLAVFECLWNAQDTLTQLVRHEQASLALAQKSVQTQGTAPLFTSLLNYRHSEVRNIPSADPFQAMNPSSINGVSYSGSMERTHYPVSVNIDDFTNDFVINAQAEQGLDPELICDYLQTALQEIVTALESAPERRIGRIHVLPAQEKDKLLWQWNQTESDFPRQTCLHTLIEDQVRRTPDAIAVVFEDQVLSYVQLNQKANQLARFLREDLHVGPDTLVGVCIERSIEMVVALLAVLKAGGAYVPLDPHYPAERLDYMLHDAAPRALLSHGAVPAGVRALLEKYAMSANISVIDLKADALQWSGQKADDLHPTDSGLTSSHLAYVIYTSGSTGRPKGVMNQHVGVVNRLVWMQKAYRLNANDAVLQKTPFSFDVSVWEFFWPLMYGARLVVAKPEGHKDPAYLSALIQEHRITTLHFVPSMLSAFLDQAPPEVGDCLQRVFCSGEALPARSVHRFRERFAKVELHNLYGPTEAAIDVTAWNCCLDETDSLIPENVIPIGKPIDNIQLYILNAYGQPCPVGVAGELHIAGVGVARGYLNQPELTAEKFIRDPFSPALNGVMYRTGDLARYLPGGDIEYLGRNDFQVKLRGFRIELGEVEAALLSHDSVKECVVLVREDVPGDARLVAYATPASGYVDQVPEERSQTLRMHLQTNLPLFMVPSHLLWLDAFPLTANGKLDRKALPSPADAPMGQTITVQPPQEGTETQLAQLWAELLNLNPNAIGRQSHFFEAGGHSLLAVALMARIQQAFSVSLLLSAIVEHLDLASQAELIETEIEKGNAARENGERAHLTEPIEPTPVEQIRALPTQKAIYKAVKLNPQDLSNNSFLALSFDDDVEPDLKQLRNLLQSVLSRHESLRAQFVLTGDELYLRPAKRFLFRLEKRQTLGALEEDLRDFIRPFSLEDGMNVRGRWVVDGRHPLLLLDFSHACIDGSGLMQILSELATENDPAPSGTRLATYSELFYSREFTTLRQEHADFWRTQLQEWSPLVHAQDTESVTHTCLITLDTGLKGQIETLTSRLKISVPEFFMAAFLLFKARLDYQPAQRNPHDQLTSMIFHGRDRLDQQTVIVPLMSVLPVRVRLRGETMEPEMLHEVSIAVRAACRHYLFDAEELTVRYPALAKQVLSPTSFFGYFQKEGFDGRIAGRLCRQLETPNVAGGQIALESDLRNCRAYHGLXRSSGSALVQYRKRRRKLGSAVXVDCAKCAECRVIXKXSRKLRKCTLNDPIVMNARKQALKDYVRQQLDAGYQGCPFFVSRLAASGMNTEVVTTSFTLAEPLNSRIFTMAASPLHRLSLFSACIKYLAFLHSREPEGSLIWAIGAQDRSGNGTPAVLSNDPPAGVYLVPAKWHLTETELTQPVKRLFGEELAQWKRIAALTSGMPLQSASSVMSQSPQVLVGYSETQTPFEGTDTAHYSLSIWIEACPQKTCLHMRFDSQRVDAELTSLLMDRLTLLLNSMVFEPNSPLASMPWMPVQERERIAALSAPVPAQPLRYKNVEQAMTASMRDRAETQFLEVGDQTVNFKQLEQYTAILLTDPNLPQWESLGDCVLIVGAKGVEITLAAMACMRIGKPFCLQSHSAPESQLLDIIELHNTKVVLLQESCGEMAELFRAQGCQVVMLPYYVPDAPVRLTHRTEMSVLAALLRKGEAVNPDDPLCVVMTSGSEGKPKGCINTHKALLNLSAEKQALYHTAGSRVASVANHTFDYFVLECVQCLTQDIVLVMPPEEARSDAGKCVRFLRESRIDLLFTTTVLAEYIMEQGDIPNLRQLYFGGESLRTFQKNNYELFNVYGPSETGVLTTYLSIVRNDQKVTIGKPFGGCQCVVVFPDTLEPCPIGVSGELLIGGAGVGAGYINRPDLTEKAFIDLDTEWLKGKYYRSGDLCCWNVQGEIEIEGRRDRQLKVNGFRIELDAIEKNILDLPTVAQTAVIGIEDQRGHTHVGAFIVTTDSGVTEQNVREALLSRMPAYMVPSQVILVAELPLTRNGKLNRQGLKQAFGKAMNGKVVRPDGATQEWLAACWARYLELDVDTLSVDKSFFSLGGHSLRAARVLAEIQHEFGQAVSLLEFFQNDTIEALAKTIDARRTGGDSMVTESFSNLLETAPQFAVDGRGPLSAQEVRLYAEYRLHPESQAYILALEIPLSHDLFPDAVKQALQALIDRHDILRTRYRIDSEGIPYAEILPSLPVDRVLIDDRNQWLQMRTQAFELGEAPLLRGCLQEINTEHACLQLQIHHILVDKPSLEILQREFQQLLAHESLSCVALSYRHYAMALADARQRPVWTQAEAFWVDYLEGLEFDPFGHGAVDAGGKVKTLSWHLSAADMAAVKHLCGAVNVTPAMFFLSVWGLTVAREGGSHAFSISVANAFRPKNALETVGMFVSLSPCAFRFDKPTATFDRFIKKLADEQWRMVDQLFFPVEEAFALLSRDPRMFGSNPLLNVAYSY

SEQ ID NO: 21102 - protein, 704 aa, Xenorhabdus nematophilus
LMHHPDINLILATGGPGMVKAAYSSGKPAIGVGAGNTPVVIDESADIKRAVASILMSKTFDNGVICASEQSVIVVDNVYDQVRERFSTHGGYLLQGEELQAVQDIILKNGSLNAAIVGQPATKIAEMAGICVPDETKILIGEVTLVDETEPFAHEKLSPLLAMYRGKNFEDAVEKAEKLVEMGGIGHTSSLYTDQDNQSERIEYFGDKMKTARILINTPASQGGIGDLYNFKLSPSLTLGCGSWGGNSISENVGPKHLINTKTVAKRAENMLWHKLPKSIYFRRGSLPVALEEVATDGAKRAFIVTDRFLFNNGYTDQVINVLKSHGIETEIFFEVEADPTLGIVRKGAEQMHLFKPDVIIALGGGSPMDAAKIMWVMYEHPETHFEELALRFMDIRKRIYKFPKMGVKAKMVAITTTSGTGSEVTPFAVVTDDITGQKYPLADYALTPDMAIVDANLVMNMPKSLCAFGGLDAVTHALEAYVSVLANEYSDGQALQALKLLKDFLPASYHEGAKNPVARERVHNAATIAGIAFANAFLGVCHSMAHKLGSEFHIPHGLANALLICNVIRYNANDNPTKQTAFSQYDRPQARRRYAEIAEHLGLTVSGDNTAAKIEKLLAWLEELKSQLGIPVSIRETGVQETDFLTKIDKLAEDAFDDQCTGANPRYPLISELKQLMLDSFYGREFTEYAISQEAEKPNRKNK

SEQ ID NO: 21103 - protein, 439 aa, Xenorhabdus nematophilus
MKVTVFGIGYVGLVQATVFAEVGHDVLCVDVDAKKVENLKNGQIPIFEPGLVPLVKKNFTEGRLNFTTDAKAGVAHGKLQFIAVGTPPDEDGSADLQYVTAVARTIAENMDGYKVVVDKSTVPVGTADKVRAVMQTALTQRSADFPFDVVSNPEFLKEGAAISDCMRPERIIIGCDNDNVIDVMRELYEPFNRNHDRMIVMDIRSAELTKYAANCMLATKISFMNEIANLAEMLGADIEHVRQGIGSDSRIGYHFIYPGCGYGGSCFPKDVQALIRTSEQIGYTPKILQAVELVNEKQKSKLPTFVKRHFGDDLSGKTFAIWGLSFKPNTDDMREASSRVLMEALWESGAKVQAYDPEAMQEAQRIYGQRDDLSLMGTKEAALKDADALIICTEWQNFRAPDFDIVKDSMKSPIIFDGRNLYDPERLQSRGFTYYGIGR

SEQ ID NO: 21104 - protein, 296 aa, Xenorhabdus nematophilus
MSIINKKIKKAVIPVAGLGTRMLPATKAIPKEMLPLVDKPLIQYVVNECIKAGINEIILVTHSSKNSIENHFDTSFELEAILERRVKRQLLDEVQSICPNHVTIMQTRQGIAKGLGHAVLCAKPLIGDEPFAVILPDVILDEYSTDLSKYNLSEMLSRFNSSGASQILVEPVPLESVADYGVVDCLGENLQPGDSKPIARVVEKPKPEEAPSNLSIVGRYVLSEKIWPLLAKTAPGAGDEIQLTDAIAMLMEKEPVEAYHLQGRSHDCGNKLGYMQAFVEYGMKHKDLGTAFKDWI

SEQ ID NO: 21105 - protein, 443 aa, Xenorhabdus nematophilus
MTATNFSEFELDECLLNALNEKGYERPTAIQAEAIPAAMDGRDVLGSAPTGTGKTAAYLLPVLQHLLDFPRKKSGPPRILILTPTRELAMQVAEQAQSFAAHTNLDVATITGGVAYMNHAEVFSENQDIVVATTGRLLQYIKEENFDCRAVETLILDEADRMLDMGFANDVETIAGETRWRKQTLLFSATLEGETIRDFAERLLTDPVEIDAEPSRRERKKIQQFYYRADNLEHKTALLCHLLQQPDVTKSIVFVRKRERVREIVDYLHKAGIQACFLEGEMVQTKRTDAVKRLNDGRVNVMVATDVASRGLDIENISHVFNFDLPRTADVYLHRIGRTARAGRKGTAIALVESHDHPLLGKVTRYLNEPLKVRVVDELRPQTKAPSEKKSYKPSKKVLEKRKEKKKVEEEAKKTRVKVRHRDSKNIGKRRTPSGDPKPETSE

SEQ ID NO: 21106 - protein, 305 aa, Xenorhabdus nematophilus
LQGSPLQLQSSSPAKSSSDKADVTHSTTQPTTAPLSENTQQNNNLYQSLIRDRHLSAMALPELHANDIAGKHSKRIDYDLSLVTRDVYRMNSMGIGDYVRLTKDEISKAGIDPAILEDSSTGFQAGVYRNKGLYIVSFTGSNEIQDFMASIRQGLGFKEEQYGQAVTLAQAALKAFGENVIFTGHSMGGGLASVAALTTGKPAVIFNAAGVSDSTLRSMGLSPEASREVAENGLIRNYIVEHDWLDNLQKTLPIPQPMGNKILLEYEYEPEGILDSIFAYRYAFHSFKAHFMEAVQELLTVHKPW

SEQ ID NO: 21107 - protein, 225 aa, Xenorhabdus nematophilus
MSASLTWHEVIGHEKTQPYFVDTLTYVANERKAGKTIYPLQQDVFNAFRYTELSDVRVVILGQDPYHGPNQAHGLAFSVQPGIPAPPSLVNMYKELESDITGFSRPNHGCLVSWAKQGVLLLNTVLTVERGNAHSHANLGWETFTDKVIAAINEHRHGVIFLLWGSHAQKKGHFINTQQHYVLKAPHPSPLSAHRGFLGCKHFSQANSLLEAQGLTPIDWYPTLP

SEQ ID NO: 21108 - protein, 1326 aa, Xenorhabdus nematophilus
MGSTTMGVKLDEATRNRIKSAAQRIERTPHWLIKQAIFNYLERLENEEKIPEISVFQDNKEEKISEEESQIEATSQPFLDFAEHILPQSVKRSAITSAYRLPETQAVPMLLQRAQLSGEQAKATHKLAYSIAEKLRQQKHGTGRAGLVQGLLQEFSLSSQEGVALMCLAEALLRIPDKATRDALIRDKISNGNWHSHLGQSPSMFVNAATWGLLFTGKLVSTHNEAKLSKSLNRIISKSGEPLVRKGVDMAMRLMGEQFVTGETIAQALANARKLEEKGFRYSYDMLGEAALTEEDAQAYMVSYQQAIHAIGKASNGRGIYEGPGISIKLSALHPRYSRAQYERVIDELYPRLLSLTLQACQYDIGINIDAEEADRLEISLDLLEKLCFEPKLEGWNGIGFVIQAYQKRCPFVIDSIIDLAQRSRHRLMIRLVKGAYWDSEIKRAQIDGLEGYPVYTRKVYTDVSYIACARKLLSVPNLIYPQFATHNAHTLSAVYHLAGQNYYPGQYEFQCLHGMGEPLYEQVVGKIADGRLNRPCRIYAPVGTHETLLAYLVRRLLENGANTSFVNRIADTSLPLDELVADPVKVVQELAQSEGQIGLPHPKIPLPHDLYGKNRVNSSGLDLSNEHRLASLSSALLSSSMETWNSEPLLGGDYAHTGELPTAKSVNNPARPSDIVGYVREATEQEVSHALDVAIDAGTIWFATPPSERAAILVRAAELMENNLQSLLGILVRESGKTFNNAIAEVREAVDFLYYYANQVRQDFANDTHRPLGPVVCISPWNFPMAIFTGQIAAALAAGNSVLAKPAEQTPLIAAVAVKMLHQAGIPRDVLQLLPGQGETVGALLVGDERVRGVMFTGSTEVASLLQRNIAGRLDAQGRPTPLIAETGGLNAMIVDSSALTEQVVTDVVASAFDSAGQRCSALRILCVQDDVAERTLTMLKGAMAECRIANPEHLSTDIGPVIDAEAKAGIERHIQTMRTKGRPVYQAVHKNEADSQESSQGTFVKPTLIELENFDELKKEVFGPVLHVVRFNRNELDKLLEQINASGYGLTLGVHTRIDETIAQVTANAKVGNLYVNRNMVGAVVGVQPFGGEGLSGTGPKAGGPLYLYRLLSQRPVNAASQTLERQDEEYQLDARARVALRSPFNKLAEWVTAQHNDALSKLIQKYSLLAQGGTIRLLPGPTGERNTYTLLPRGEVLCLADNEQDTLVQLSAVLSVGCQAIWEKDDLHQQLLRQLPDEVRHSIRLINDWQNEETEMEAVIYHGDCDQLRHVCGIIAQRKGPIVSVQGFARGETNLLLERLLHERSLSINTAAAGGNASLMTIG

SEQ ID NO: 21109 - protein, 413 aa, Xenorhabdus nematophilus
IAVYDLGGGTFDVSVLRLSRGVFEVLATGGDTALGGDDFDLLLANWIREQAGISDSDHGLQRQLLDVATQAKIALSDADTAEINIAGWQGNITRTEFNELIVSLVKRTLLACRRALKDAGVTTDEVLQVVMVGGSTRVPLVRSMVGEFFDREPLTSIDPDRVVAVGAAIQADILVGNKPDSEMLLLDVIPLSLGLETMGGLIEKVIPRNTTIPVARAQEFTTFKDGQGAMSIHVVQGERELVNDCRSLARFTLRGIPPLPAGGAHIRVTFQVDADGLLSVSALEKSTGVEASIQVKPSYGLSDAEIARMLRDSMTNAQEDIQARKLAEQKVEAARVLESLTSALEKDADLLSQEEQAAIDAAVEVLIESAQGTSSDAIESAIKQLDKQTQEFAARRMDTSIRRALAGHSVDEI

SEQ ID NO: 21110 - protein, 256 aa, Xenorhabdus nematophilus
  unsure (1)..(256): unsure at all Xaa locations
LVASLFFQASTRTRLSFESAANRLGARVIGFADGESSRSGSSWNEKFTDTAQMINAYADIAVIRHAEVEPVHNYCIKSRLPVINAGNGEGLNAEHPTQALLDIFTIHQSFPLHKSLTLLLCCHPSSRSARSLLFCIALFHNIKLLLCTEENCKLFQEDEAYLRQAGVTYXYLHNIKEGLCSADVIYMAGYRETADHLPNSNLMLTPDLLSHLHPRAIIMHPLPRGYELPYELDNSVHCAYFSQAENGVFVRMAILQ

SEQ ID NO: 21111 - protein, 436 aa, Xenorhabdus nematophilus
MGRSSTKVAQQKERVAIVSGLRLPFAKQATSYHGIPAVDLGKAVVSELVIRSGLSPEKIDQLVFGQVVQMPEAPNIAREIVLGAGLSVSTDAYSVSRACATSFQAIANVAESIMAGTVNVGIAGGADSSSVLPIGVTKSLARTLVDMNKAKSLSQRLKLISRLKLRDLLPVSPAVAEYSTGLRMGDTAEQMAKTYHISREEQDKLAHRSHILAAKAWQQGCLNEEVVAAHFPPYRDTLTEDNNIRKNSVLTSYSKLRPAFDRKYGTVTAANSTPLTDGAAAVMLMRESVAKELGMTPLGYLRSYAFSAIDVWQDMLLGPSYATPIALERAGITLNELSLIDMHEAFAAQTLANLKMFASEKFAREKLGRSQAVGDVDMDKFNVLGGSIAYGHPFAATGARMVTQTLNELRRRGGGFGLTTACAAGGLGVAMVLEVE

SEQ ID NO: 21112 - protein, 220 aa, Xenorhabdus nematophilus
DPEKLAEAQNVLSEAVYECQHQNMRTLIFGGGHETAFAHGMGIYRAFPTQRVGIINFDAHLDLRNSAQPTSGTPFRQLADYCQQHQRPFNYTCIGASLASNTQALLDEANHLDVTIIWDTQCIESMLDKVKEQIQNVINQVDIIYMTIDLDVLPIWQMPSVSAPAALGVPLERLLPLIQLICQSKKLQAVDLVELNPLYDIQGMGGKAAARLTWQLVHWW

SEQ ID NO: 21113 - protein, 507 aa, Xenorhabdus nematophilus
MKHITIHPGKMTLEELRHIYQYPVQITLDEQCVPAIERSVDCVNRIINENRTAYGINTGFGLLASTRIAEQDLEELQRSLVLSHAAGVGEPLPDEIVRLIMVLKINSLARGYSGIRLDVIQALITLVNAEVYPCIPSKGSVGASGDLAPLAHMSLLLLGESKARYRGEWLPAKDALEKANLKPIRLAAKEGLALLNGTQTSTAFALKGLFAAEDLLASAVICGAMSVEAALGSRKPFDARIHEARGQQGQIDVAALYRLVLEEQSGLSESHKNCPKVQDPYSLRCQPQVMGACLTQIRHAADVIMTEANAVSDNPLVFTDQDEVISGGNFHAEPVAMASDNLAIALAEIGALSERRISLLMDSNMSQLPPFLVNNSGVNSGFMIAQVTAAALASENKALAHPSSVDSLPTSANQEDHVSMAPAAGRRLWEMADNVRGILAIEWLTACQGMDFRDGLKSSPILEKARHILRNKVAYYDKDRFFAPDIDAAIQLLIEQQLSALLPTGKL

SEQ ID NO: 21114 - protein, 241 aa, Xenorhabdus nematophilus
NLKDKIAFISGGTKGIGKGIAQVFKRAGAITIISGTNRARGEAIAKELDIDFIPLDVTDQAACKNVIDEIVEKYGRLDILCSNAGIFPQHYLKDMTAEDWDLVNTVNLKGTFLLVQAALNVMEKQHYGRVVLTSSVTGEMTGIPGYSHYGASKAGQLGFMRSAALEYAGQGITINAIMPGMIMTEGLKAFGEDYLQHVQSTTPMRVLGLPEDIGYTACFLASDEAKYITGQAIVVDGGQIL

SEQ ID NO: 21115 - protein, 549 aa, Xenorhabdus nematophilus
MKFSFKTSACALVVSLSLLPISAAAWEKNKTYDITILHTNDHHGHFWQNDHGEYGLAAQKTMVDSIRQEVAKKGGSVLLLSGGDINTGVPESDMQDAEPDFKGMNLVGYDAMALGNHEFDKPLNVLHQQEKWANFPFLSANIYQTSTGKRLFKPYVMFDNQGVKIAVIGLTTDDTAKVGNPANFPDVEFRVPAEEAKKVIDELKKNEKPDVIIAATHMGHYNDGHHGSNAAGDVEMARSLPAGYLNMIVGGHSQDPVCMSAENKNYKQMDYVPGTPCSPDRQNGTWIVQAHEWGKYVGRADFQFRNGEFKLVHYQLIPINLQKKVKNEDGSTGRAYYTHQITENPAMLKLLTPYQDKGSRKLNVQVGVVDGKLEGDRSKVRFIQTNMAHLVLAAQMERTNADFAVMSGGGIRDSIEAGDITYKDVLKVHPFANQLVYVDFKGREVLPYLTAAANMETDSGAYGQFYNVSFVVDGKKIRDVKIGGKPLDLNKTYRMATLNFNAIGGDGYPRVDNLPGYVDTGFVDAEVLKGYIEKHSPLKATDYEPKGEI

SEQ ID NO: 21116 - protein, 842 aa, Xenorhabdus nematophilus
IELQLSGLSCMKCAGKTQKALESVEGVIAAKVDTQTAKIYGKVESNALIKAVEQAGYHAELAAGTRFPKTEPLTISAPQTPEFLAAAENATPVRNPENTVSHDTPDNDNDSIQLLLDGMTCASCVSKVQKALQSVDGVENARVNLAERSALVTGAVSPNALVDAVIKAGYGAEVIQDETERRERQQQVAQANMRRFRWQSAFALAVGVPVMVWGMLGDNMVLTPSNHAIWLTIGLVTLAVMVFAGGHFYRNAWQSLKNGSATMDTLVALGTGVAWLYSISVNLWPEIFPSQARHLYYEASAMIIGLINLGHALEQRARQRSSKALERLLDLTPPTARVITEKGEKTLPLADVKPNMILRLTTGDRVPVDGEIIQGTVWLDEAMLTGEPIPQQKSTGDGIHAGTVVQDGTVLFRAAAVGSQTTLARIIKLVRQAQSSKPEIGQLADKISSIFVPVVIAIALVAGAIWYFIGPAPQLMYSLVIITTVLIIACPCALGLATPMSIISGVGRAAELGVLVRDADALQQASQLDTLVFDKTGTLTEGMPQVTEISTFNGFTEEQVLLWAGALESGSNHPLAKAIALKVAGQKLPEVQQFRTLAGLGIRGVVGDTTLLLGNQSLLEQNQIETAELKTLMATQAEKGITPVILAADGKIAALFSIRDPLRQDTLSALQRLHHQGYRLVMLTGDNPVTANAIAKEAGIDQVIAGVLPDGKAAAIQTLQSEGRKVAMIGDGINDAPALAQADVSIAMGGGSDIAIETAAITLMRHSLNGVADAVALSRGTLRNMKQNLFGAFVYNTLGIPIAAGVLYPFTGTLLNPVVAGAAMALSSITVVSNANRLLRFK

SEQ ID NO: 21117 - protein, 258 aa, Xenorhabdus nematophilus
GKVMQKAVLITGCSSGIGLVAAKILHQRGYRVFAACRKSADLAHMRELGLEPIELDLDDKESVERAAEQVIQLTHGRLFGLFNNGGFGVYGPLESVSRELMEKQFSTNVFGTHQLTSLLLPAIRAYGKGRIVQTSSVLGLISTPGRGAYAASKFALEAWSDALRIELADTGIKVSLIEPGPITTRFTENVNQTQRDHPVENPGLADRFRLTPEDVVTKLIHALEAPNPKIRYPVTLLSHAMTILRRILPTRLIDKIVK

SEQ ID NO: 21118 - protein, 226 aa, Xenorhabdus nematophilus
VESILEVHHLTKHVGQGEQVINILQGVELVVEPAQTIALIGESGSGKSTLLGIIAGLDDGSGGEVHLLGQNISRMNEEQRAQLRAKNVGFVFQSFMLIPTLNALENVQLPALLRGESENQSRQNAIELLKQLGLGQRLKHMPAQLSGGEQQRVALARAFSTRPKILFADEPTGNLDRQTGDRIADLLFSLNHDYATTLILVTHDSRLAARCQRRLRLVDGTLQEEV

SEQ ID NO: 21119 - protein, 336 aa, Xenorhabdus nematophilus
MYYSLLRKALFQLDPEQAHELTFRQLKLVTGTPFEFLIRQSVATKPVTCMGLSFKNPLGLAAGLDKNGDCIDAFGAMGFGFVEIGTVTPRPQVGNDKPRLFRVIEAEGIINRMGFNNLGVDNLVENVKRAKYDGIIGINIGKNKDTPVENGKDDYLICMDKIYPHAGYITINISSPNTPGLRTLQYGEALDDLLSAIKNKQSELQQKFQKYVPIAVKIAPDLTEEELIQVADSLMRHRIDGVIATNTTLDRKLIEGLNHCQQAGGLSGRPVQLRSTEIIRCLSQELKGKIPIIGVGGIDSLIAAREKMEAGSSLVQIFSGFIYKGPKLIKDIVNHI

SEQ ID NO: 21120 - protein, 354 aa, Xenorhabdus nematophilus
MQKGALNNIHILGEQIFITPEELKQKYPLSRNDLHTITNARNTIADIIQHRDPRLLVVCGPCSIHDVDAALDYARRLKVLSAELSDCLYIVMRVYFEKPRTTVGWKGLISDPHMDGSFDIDAGLHIARSLLMNLVKMGLPLANEALDINNPQYLGDLFSWSAIGARTTESQTHREMASGLSVSVGFKNGTDGNLNTAINAMKAAAMPHCFMGISQSGQVCLLQTQGNPNGHVILRGGAEPNYSSEHVADCENQMIKAGLTPSLMIDCSHGNSNKDFRRQSIVVDSVAEQIMSGNRSIIGIMLESNIHEGNQPSEQLRSEMKYGVSVTDACINWQTTEQVLRKLHQQIAPRFAKR

SEQ ID NO: 21121 - protein, 727 aa, Xenorhabdus nematophilus
  unsure (1)..(727): unsure at all Xaa locations
MRLDRLTNKFQLALADAQSLALGRDNQFIEPIHLMSALLHQEGGSVRPLLTLAGVDTSSINNQLNQALGRLPKVEGNGGDVQVSNELGRYLNLCDKLAQKAGDNFISSELFVLAAIEERGTLSDILKAVGTTKDKIAKAIEQMRGGEKVSDQGAEDQRQALKKYTIDLTERAEQGKLDPVIGRDEEIRRTIQVLQRRTKNNPVLIGEPGVGKTAIVEGLAQRIINAEVPEGLKNKRVLSLDMGALVAGAKYRGEFEERLKGVLNDLAKQEGSVILFIDELHTVVGAGKADGAMDAGNMLKPALARGELHCVGATTLDEYRQYIEKDAALERRFQKVYVAEPTVEDTIAILRGLKERYELHHHVQITDPAIVAAATLSHRYISDRMLPDKAIDLIDEAGASLRMQMDSKPEALDRLERRVIQLKLEQQALKKESDDGSKKRLEMLNMELVEKEREYSELEEEWKAEKAELTGTQNIKAELENTRLELEKARRSGDLAKMSEIQYGKIPELEKRLATAATAATAESHHMKLLRNKVTDAEIAEILARWTGIPVSRMLESEKDKLLSMEHELHKRVIGQNEAVEAVSNAIRRSRAGLSDPNRPIGSFMFLGPTGVGKTELCKALANFLFDSDDAMVRLDMSEFMEKHTVSRLVGAPPGYVGYEEGGYLTEAVRRRPYSVILLDEIEKAHPDVFNILLQVLDDGRLTDGQGRTVXFRNTVIIMTXXXGADM

SEQ ID NO: 21122 - protein, 757 aa, Xenorhabdus nematophilus
VMKVLIAKNEVGTRYHSHYIENAVHRLADKLTDRNVEVVIADSFDDSYTIIASNESFDCLMVSCALMDDELYREIQQLLNKLFERQENVPVFLLSDREKTVFLLNHELLEQLTEFAWILEDSADFIAGRAIAAMRRYRQQLLPPLMAALMKYSQTYEYSWAAPGHQGGVGFNKTPVGRLYHDYYGENLFRTDMGIERASLGSLLDHSGAFGESEKNAARVFGADHSYSVVVGTSGSNRTIMQACMTEDDVVIIDRNCHKSIEQGLILTGAKPVYLLPSRNRYGIIGPIYPQEMQTETLQKKLKQNPLTQGMASRKPAYSVVTNCTYDGVCYNARHVQELLDKSVDRIHFDEAWYGYARFNPIYHDHYAMRGNPKDHAGPTVFATHSSHKLLNALSQASFIHVRDGRNSVDFSRFNQAYMMHATTSPLYAICASNDIAVSMMDGNSGYSLTQEVIEEAVDFRQALARLHRDFNEKGDWFFKPWNQEKVLDPATGKKIAFEDAPRDLLTKEQSCWTMRPGDSWHGFEDLPDDWSMLDPIKVSILAPGMGDNGQLLKQGVPAALVTAWLSQHGIVPTRTTDFQIMFLFSMGITKGKWGTLLNTLLSFKHHYDANTPLNKVLPDLVNQYQEVYGNLGLQELGDKMFAYLRQNNPGDKLNHAYSGLPEMAMIPRAAYQAIVTNNVEMVAIDDLPHRIAANSIIPYPPGIPMLLSGENFGDKTSPQMSYLHALQKWDHEFPGFEHETEGTEIINGVYHVMCIK

SEQ ID NO: 21123 - protein, 552 aa, Xenorhabdus nematophilus
  unsure (1)..(552): unsure at all Xaa locations
LEKVWLKHYPADVPAEIDPDRYLSLIEMFENAVGTLCRSSRIHQHGXGDNFPKLEERSRAFAAYLQNGLGLKKGDRVALMMPNLLQYPVALFGVLRAGMVVVNVNPLYTPRELEHQLTDSGTSAIVIVSNFAHTLEKIVFNTQVKHVILTRMGDQLSRPKGTLVDFVVKYVKRLVPKYHLPDAISFRNVIHKGYRMQYVKPDVDGDALAFLQYTGGTTGVAKGAMLTHRNMLANLEQGKANYAPLMAPGQELVVTALPLYHIFALTVNCLLFIELGGQNLLITNPRDINGTVKELSRYPFTALSGVNTLFNAWLNNPEFQKLDFSSLRLSVGGGMAVQRIVAEKWQNLTGCHLLEGYGLTECAPLVSGNPYNLTHYSGSIGFPVPSTEIKLVSDDGNEVPLEQAGEMWVRGPQVMKGYWNRPEATAEVLKDGWLATGDIANVDENGFLHIVDRKKDMILVSGFNVYPNEVEDVVSSHPKVLESAAIGVPNDNSGETVKIFVVRKDQSLTENELKTHCRRYLTGYKVPKLIEFRDELPKSNVGXILRKELRNE

SEQ ID NO: 21124 - protein, 491 aa, Xenorhabdus nematophilus
MAVTSVAQACDLVIFGAKGDLARRKLMPSLYQLEKAGYIHPDTRIIGVGRADWDKKAYTKVVEEALATFMSEKLDPELWKKFSSRLEFCNLDVNETEHFTRLAKILKQDSLPAIHYFAMPPNTFGSVCHGLGAAGLNKEPNRVVMEKPLGTDLASSRAINDEVAKYFNESQIYRIDHYLGKETVLNLLALRFANSLFANNWDHRTIDHVQITVAEEVGIEGRWGYFDQAGQMRDMIQNHLLQILTMIAMSPPSDLTADRIRDEKVKILRSLRRIDQTNVREKTVRGQYTAGFVHGKKVPGYLEEEGANKISKTETFVSIRVDIDDWRWSGVPFYLRTGKRLPAKCSEVVVYFKEPSLNLFANSYQQLPQNKLTIRLQPDEGIDIEVLNKAPGLEHKHRLQTTKLDLSFSQTFNQTHLADAYERLLLEAMRGIQALFVRRDEVEEAWKWVDSIMDAWEADNEPPKPYQAGTWGPVASIAMITRDGRSWNEFE

SEQ ID NO: 21125 - protein, 396 aa, Xenorhabdus nematophilus
MFEKITAAPADPILGLADSFKADPRENKINLGIGVYKDETGKTPVLTTVKKAEKFLLENETTKNYLAISGLPEFGRVTQELLFGNTSTIITDKRARTVQSPGGTGALRTAADFIAKQTNAKRVWISNPTWPNHKGVFSSAGLEIREYQYYNAEKHALDFDGMLASLSEAQAGDVVLLHGCCHNPTGIDPTAEQWQKLADLSAANGWLPVFDFAYQGFARSLDEDAEGLRIFTKNHNELIVASSYSKNFGLYNERVGACTIVATDSDTAEKAFSQAKSIVRTNYSNPPAHGASVVTTILSNDEFKAEWIQELATMRERIRRMRQLFVNTLQEKGAKQDFSFIISQNGMFSFSGLTKEQVDRLREEFGIYAVSSGRINVAGLTLENMVPLCEAIVAVL

SEQ ID NO: 21126 - protein, 353 aa, Xenorhabdus nematophilus
SEHGGNIIEVAQQFGIPANELIDLSANINPLGAPERVKTLIKDNLACIEKYPDVEYRHLHQVLADAHQCDTASVIAGNGATELIYAVVRYLNPKRALLLTPGFAEYRRALQHVGAEIIAYPLTEDAGFQPDLRLLDTLTILQPDCVFIATPNNPTGLMPDSRFLQSLGQHCEEHRIALIVDEAFIDFLPDNRGLIPHIAATRHLYVLRSLTKFFAIPGLRLGYLVSGDCAGVAWMKNRREPWSINALAAQVGEVLLDDQAYITATHQWLKSQQHYLWTYLSSCPELTVWPPSANFLFFRCHQPNLDLWHTLLEHRLLIRHCKNYVGLDESYYRIAVRSEWENRRLTAAIQHVF

SEQ ID NO: 21127 - protein, 251 aa, Xenorhabdus nematophilus
MELIRIPALSDNYIWLLCDEDKHCVIVDPSESQPVIDILAANQLIPAAILLTHHHHDHVGGVAGLLKQYADLPVYGPEETRSKGTTHIVHEHDTIETGHYCFHIMELPGHTLGHIAFYQAPYLFCGDTLFSGGCGRLFEGTAEQMFSSLEKIMSLPDETLICCAHEYTAANMKFARAVLPENETIHDYYNKIISIRENNKPTVPTTLQIEKKVNVFLNCHNIDLQKNIGIKPNSKPLSSVFQQLRIYKDRF

SEQ ID NO: 21128 - protein, 299 aa, Xenorhabdus nematophilus
PNISQVKNFFLSLQDEICKQLERLDGHSNFMEECWQREEGGGGRSRVLKAGNVFEQAGVNFSHITGASLPPSASAHRPELAGRSYQALGVSLVIHPLNPYIPTSHANVRFFIAEKEGEAPVWWFGGGFDLTPYYGFKEDAIHWHTVAKTLCQPFGNNVYPEYKKWCDDYFFIKHRNEPRGIGGLFYDDLNTPDFETCFNFTQAVGNGFLAAYLPIVERRKNINWGEREREFQLYRRGRYVEFNLVWDRGTLFGLQSGGRTESILMSMPPLVRWEYNHSPEPNSPEAEFYTSFLIKKDWI

SEQ ID NO: 21129 - protein, 141 aa, Xenorhabdus nematophilus
MTIERTFSIIKPNAVKKDAIGSIYARFESAGFKIIAAKMLYLTREQAEGFYAEHKGRPFFDGLVEFMTSGPIVVQVLEGENAVQRHRDLMGATNPDNALAGTLRADYADSFTENAVHGSDSIESANREIAYFFSDDEIFPR

SEQ ID NO: 21130 - protein, 615 aa, Xenorhabdus nematophilus
YQWSLQDPEAFWSEKGKIVDWIKPYTQVKNTSFDPGHVSIRWFEDGTLNLSANCLDRHLQERGEQTAIIWEGDNPAESKHVTYRELYHDVCQFANVLKKLDVKKGDVVAIYMPMVPEAAVAMLACTRVGAIHSVIFGGFSPDAIAGRVIDSNAKLIITADEGIRAGRVIPLKKNVDEALSNPAVTDVVNVVVFKRTGNTKSWQEGRDLWWHELIENVSTDCPAEEMNAEDPLFILYTSGSTGKPKGVLHTTGGYLVYASLTFKYTFDYRPGEIYWCTADIGWVTGHSYLLYGPLSCGATSLMFEGVPNYPDVNRLCQIVDKHQVNIIYTAPTAIRALMAEGDKAIEGTKRTSLRIMGSVGEPINPEAWEWYYRKIGNSKCPIVDTWWQTETGGFMITPLPGAVDLKPGSATLPFFGISPALVGNSGEPLTGECEGNLVITDSWPGQARTLFGDHERFEQTYFSTFKGMYFSGDGARRDEDGYYWITGRVDDVLNISGHRLGTAEIESALVSHPKIAEAAVVGIPHHIKGQAIYAYVTLNHGEEPSPDLYTEVRNWVRKEIGPIATPDILHWTDSLPKTRSGKIMRRILRKIASGDTSNLGDTSTLADPGVVEKLL

SEQ ID NO: 21131 - protein, 266 aa, Xenorhabdus nematophilus
RDTTLIALGGGVIGDMTGFAAACYQRGIRFIQIPTTLLSQVDSSVGGKTGVNHPLGKNMIGAFYQPASVIIDINCLKTLPAQELHAGLAEVIKYGIILDGEFFNWLESNIEQLLALDNQVIAYCIRRCCELKAWVVAADEQERNGMRALLNLGHTFGHAIEAEMGYGVWLHGQAVAAGMVMAARTSELMGTFSKQDTQRIISLLERAKLPVNGPVEMSPEIYLPHMMRDKKVSAGKLHLVLPTAIGKAELRSDIGSDVILDAIHLC

SEQ ID NO: 21132 - protein, 417 aa, Xenorhabdus nematophilus
MESKVVVPAEGKKITIDAKGKLNVPNNPIIPYIEGDGIGIDVTPVMLKVVDAAVQKAYSGERKISWMEIYTGEKSTQVYGKDVWLPEETLDLIRDYRVAIKGPLTTPVGGGIRSLNVALRQQLDLYVCLRPVRYYQGTPSPVKQPELTDMVIFRENAEDIYAGIEWKAGSAEADKVIKFLQDEMGVTKIRFPQECGIGVKPCSEEGTKRLVRAAIEYAIDNDRESVTLVHKGNIMKFTEGAFKDWGYELALTEFGGELLDGGPWMKIKNPKSDKDIIIKDVIADAFLQQILLRPAEYDVIACMNLNGDYISDALAAQVGGIGIAPGANIGDECALFEATHGTAPKYAGQDKVNPGSVILSAEMMLRHMGWFEAADLIVKGTEGAIAAKTVTYDFERLMEGAKLLKCSEFGDALISHM

SEQ ID NO: 21133 - protein, 237 aa, Xenorhabdus nematophilus
SRGIGAATAILAANKGYSICLNYLNDEKSAFKVRDEILNLGAKCITVRADVSNEHQVKKMFDDIDTQLGSITHLVNNVGILKQKMPLIDMDGERFQQVLLTNVMSHFYCSSEAIKRMSISRGGSGGSIVNVSSGASKSGSPFEYIDYAASKGAVDTFTTGLSKEVAADGIRVNCVRPGGIYTDIHADGGEPSRVDRIAKNFPMQRGGTPEEVANAILWLLSDEASFVTGSFTDLCGG

SEQ ID NO: 21134 - protein, 350 aa, Xenorhabdus nematophilus
MNYQNDDIRIKKITELLPPVALLEKFPATRNTATTVREAREAIHNVLTGEDDRLLVVIGPCSIHDPKAALEYAERLNKLRGELKADLEIVMRVYFEKPRTTIGWKGLINDPNMDCSFDINDGLRTARKLLIDINDMGLPAAGEFLDMITPQYLADLMSWGAIGARTTESQVHRELASGLSCPVGFKNGTDGTIKVAIDAINAASSPHCFLSVTKWGHSAIVSTTGNQDCHIILRGGKEPNYSAEHVSVVKEELMKAGLAPRVMIDFSHANSSKQFKRQMDVNDDVCDQIARGERAIIGVMVESHLVEGSQNLDSDKPLVYGQSVTDACIGWDDTEMLLRQLSQSVKARRG

SEQ ID NO: 21135 - protein, 250 aa, Xenorhabdus nematophilus
MAVTKLVLVRHGESEWNKENRFTGWTDVELSDKGRTEAQQAGQLLKQEGFAFDFAYTSVLKRAIHTLWNILDQVDQQWLPVEKNWKLNERHYGALQGLDKAETAAKYGDDQVKLWRRGFAITPPDLAKDDERYPGHDPRYANLKPEELPATESLAATIERVVPYWEDVIKPRVANGEKIIIAAHGNSLRALVKYLDGMSEEEILELNIPTAVPLVYEFDENMRPIKHYYLGNADEIAAKAAAVANQGKAK

SEQ ID NO: 21136 - protein, 417 aa, Xenorhabdus nematophilus
MNPSDLEFDLRHIWHPYTSMTHPLPTYPVVSAAGVELELSDGRRLIDGMSSWWAAIHGYNHPVLNEAAKSQIDRMSHVMFGGIIHPPAIELCQQLVAMTPAALECVFLADSGSVAVEVALKMALQYWQAKGEKRHRFLTLRHGYHGDTFGAMSVCDPDNSMHNLYKGYLPNHLFADAPQSRFEGEWQPEDITSFRQLLLQHHNEIAAVVLEPIVQGAGGMRIYHPEYLRQVRKLCDEYQILLIADEIATGFGRTGKLFACEHAQIEPDILCLGKALTGGYMTLSATLATRHVAETISQGEAGCFMHGPTFMGNPLACAVASANLKLLSDSQWQPRIQSIEAQLKVELLPLKSHTTVKDVRVLGAIGVVEMKQPVDMASLQRRFVQHGVWIRPFGRLIYLMPPYIIRSEQLSKLTNAI

SEQ ID NO: 21137 - protein, 925 aa, Xenorhabdus nematophilus
LFRVLGFMLWVLGALLTSFYLVNIFNEVKSDIRQEYNTNYDTMFSYIRHTTNTLRDIQYMTEKHLSQKNEKDLTITLPYNNPAFSYTPLNMNSDCDLLRKSTHSYLDSLNNLILFWKDNIAAPRGLNQIFLVGTQSMCMVSFSVRSTITEPETLKKMVYENFRKLIILKEQGKERNVFWVMPNTRADSGTFYILAPIYTNGQMTAVIGIEQAIRLDSFLPTRNRPISITMLNHYNQPELYYPVKNDNKFRYADYNIQTPYFGYDEGFSNLLLKRRLAPSSFNVVFSLPLKYIYSELKVTIINSIVLNLIFTILIIFFVWLFERKIFSPAEENAIRLEEHEQFNHKIVASAPVGISILRINDGANILSNELAHNYTRMLTYEDQKRIVDIICDKTSSYIDVVTSNNNHLQISFVHSRYRNEEVAICVLVDISTRVKMEQSLQEMASAAEQANQAKSMFLATVSHELRTPLYGIIGNLELLQSHTLPSESARLLSAMNNASSLLLKIISDILDFSKIESKQLKIDSKKFSCKEIVLHVISNYLPLIVKKELGLYCYIEPDIPDIINNDPVRLQQIISNLLNNAIKFTETGSVVITISIKHSYLYISIKDTGVGIEDKLQTQLFEPFFQINANKQTFSQGTGLGLAICEKLINLMDGDIEFISQQYIGSIFSIRLPLYGAKYHTKAYSKNRTQQKIVLAVRNDYLEKYLQNFLTKNYFQIALYDKSKIDGTELVILDQPDVLDIAVRYYIEISEKHIGPPKQIREHYWLHNTYQLIELDSVIDKLLSKNNHISPATISMSTSIRADSRLSTIKILVVDDHPLNRHLLIEQLNTIGFRTASANDGIDAIEHLKNNSTDIILTDVNMPNMDGYELTKYLRDKGYTSPIIGITANALAEEKQRCADAGMDYCLSKPVSLATLRDTLIEYSD

SEQ ID NO: 21138 - protein, 763 aa, Xenorhabdus nematophilus
MNQSLLVTKRDGHKEQIDLDKIHRVVAWAAEGLKNVSVSQVELRSQIQFYDGIKTADIHETMIKAAADLISGDAPDYQYLAARLAIFHLRKKAYGQFEPPALHDHVVRMVNLGKYDKHLLEDYSKEEFEQMDSFINHLRDMDFSYAAVKQLEGKYLVQNRVTGEIYESAQFLYILVAACLFSTYPKETRLSYIRRFYDAVSTFKISLPTPIMAGVRTPTRQFSSCVLIECGDSLDSINATSSAIVKYVSQRAGIGVNAGRIRALGSPIRDGEAFHTGCIPFYKHFQTAVKSCSQGGVRGGAATLFYPLWHLEVESLLVLKNNRGVEGNRVRHMDYGVQLNKLMYERLIKGEDITLFSPSDVPGLYDAFFADQDEFERLYTQYESDVTIRKERIKAVELFSLMMQERASTGRIYIQNVDHCNTHSPFDPAVAPVRQSNLCLEIALPTKPMNNINDENGEIALCTLSAFNLGAINNLTELEELAELAVRALDSLLDYQDYPIIAAKQGSMGRRTLGIGVINFAYYLAKNGVRYSDGSANNLTHKTFEAIQYYLLKASNGLAKEKGACPWFGETTYAQGILPIDTYKKTLDTLTREPLHMDWETLRNDIRQHGLRNSTLSALMPSETSSQISNATNGIEPPRGYISIKASKDGILRQVVPEYNRLKGAYELLWQMPGTDGYLQLVGIMQKFIDQSISANTNYDPARFPNGKVPMNQLLKDLLLAYKYGVKTLYYHNTRDGAEDVQGDLEEVVESADSDCDGGACKI

SEQ ID NO: 21139 - protein, 376 aa, Xenorhabdus nematophilus
MSYTTFSQVKNNQLQEPMFFGQPVNVARYDQQKYPIFEKLIEKQLSFFWRPEEVDVSRDRIDYNALPDHEKHIFISNLKYQTLLDSIQGRSPNVAFLPLISIPELETWIETWSFSETIHSRSYTHIIRNIVNDPAIVFDDIVANEQILKRAKDISGYYDVLIEMTNYYHQLGEGTYNVAGKNITVSLRALKKQLYLCLMSVNALEAIRFYVSFACSFAFAERELMEGNAKIIKLIARDEALHLTGTQHMLNLLRSGQDDPEMAEIARECEQQCYDLFVQAAEQEKEWADYLFKDGSMIGLNKDILCQYVEYITNIRMQAVGLKLPFEARSNPIPWINAWLVSDNVQVAPQEVEVSSYLVGQIDSEVNAEDLSGFEL

SEQ ID NO: 21140 - protein, 85 aa, Xenorhabdus nematophilus
MSQKKNSEDLRTELQSLADTLEEVLNSSGDKSKAELEKLRSKAEKTLKDARVTLSDASDKLVDQTKEMAGRADNYVRDNPWTGVG

SEQ ID NO: 21141 - protein, 283 aa, Xenorhabdus nematophilus
  unsure (1)..(283): unsure at all Xaa locations
PLLTVKDLNVAFSTPDGSVIAVNKLNFDLNAGETLGIVGESGSGKSQTAFALMGLLASNGVVSGSAAFNGREILNLKEKDLNRMRAEEISMIFQDPMTSLNPYMRVGEQLTEVLMLHKRISKSEAVEESIRMLDAVKMPEARKRMKMYPHEFSGGMRQRVMIAMALLCQPKLLIADEPTTALDVTVQAQIMTLLNELKNEFNTAIILITHDLXVVAGICDKVLVMYAGRTMEYGSARDIFYHPTHPYSIGLLDAVPRLDDDEESLTTIQGNPPNLLRLPKGCP

SEQ ID NO: 21142 - protein, 498 aa, Xenorhabdus nematophilus
MMSEITLLKPVTDFLQRPHGNYINGLSLPGQGNRTFSVVNPASDEMIAKVNQGEEAEINLAMEAASKAFHGSWAQTSPMERGKCLNRLADLLQKHGEELAQLESLCSGKPIQLARMLDVGASADYLRYFAGWSSKISGETLNVSLPSLKGEKYTAFTRREPIGVVVGIIPWNFSIMIAIWKLGAALACGCTLVLKPSEYTPLTMLRVAELAKEAGIPDGVINVVNGSGARVGSALLAHPHCAKVTFTGSVPTGTIIGKSAIEYGLSRATLELGGKNAAAFLSDMSVEKIVEGVLEAGYLNQGQICAAAERFYIPSVHMDAVLKLLSERLSAMKIGSPLDESTEMGPLANKEHYEKILSLFDKARQDGSEIVYGGHALEGAGFFVTPTIIRAKSAEDTLMQEETFGPIGTFLSYDDEEELIVMMNATPFGLSASLWTNDLSKAMRMIPRIQVGTLWINMHTFLDPALPFGGVKSSGIGREFGSAFIEHYTELKSVMVRY

SEQ ID NO: 21143 - protein, 412 aa, Xenorhabdus nematophilus
MTTINHWINGKNVASNTYFETTNPATGEVLAQVASGGQTEIDQAVAAAKDAFPKWADTPMKERARLMRRLGELIDQNVPDIAAMETKDTGLPIHQTQNVLIPRASHNFDFFAEICQQMNGRTYPVDDKMLNYTLIQPVGVCALISPWNVPFMTATWKVAPCLALGNTAVLKMSELSPLTANRLGELALEAGIPAGVLNVVQGYGNTAGDALVKHHDVRAISFTGGTATGRRIMQSAGLKKYSMELGGKSPVLIFEDADIERALDSALFTIFSLNGERCTAGSRIFIQESIYPEFVKRFAERANRLRVGDPQDPNTQVGSLISQSHWEKVSGYIRLGIEEGATLLAGGSDKPADLPDHLKKGHFLRPTVLADVNNRMRVAQEEIFGPVACLLPFKSEEDGLRMANDWEYGLAS

SEQ ID NO: 21144 - protein, 462 aa, Xenorhabdus nematophilus
MNLPLVINVLVFVALLIVLAKASSNKWSLSKKVVVALIMGVVFGLALNVIYGAHNIIVKESIKWFNIVGNGYVQLLQMVIMPLVFASILSAVARLHKASALGKISFLTIGTLLFTTAISALIGIIIANVFGLTAAGLIQGTQETARLSAIETSYIGKVSDLGVPQLILSFIPKNPFADLTGASPTSIIGVVIFAVFLGIAALQMLKDDHERGERALIAIDTLQAWAMKLVRLVMRLTPYGVMALMTKVVASSNIHDIAQLGNFVVASYIALGLMFVVHGGLLALTGINPIKFFKKAGPALTFAFTSRSSAASIPLNVETQTRRLGIPESIASFSASFGATIGQNGCAGIYPAMLAVMIAPTVGIDPFDPLWIATLVGIVTISSAGVAGVGGGATFAALIVLPAMGLPVTLVALLISVEPIIDMGRTALNVNGAMTAGTITSQLMGTTNKEILEQDETVGLSQ

SEQ ID NO: 21145 - protein, 228 aa, Xenorhabdus nematophilus
  unsure (1)..(228): unsure at all Xaa locations
RFVPDIYSCNTGXCTEIIFPSDLTFSLMRFQFRSRGXSDWRGGLSLTNSLSNTKNMAEKRNIFLVGPMGAGKSTIGRQLAQQLNMEFYDSDQEIERRTGADVGWVFDVEGEEGFRDREEKIINELTEKQGIVLATGGGSVKSKETRNRLSARGVVVYLETTIEKQLARTQRDKKRPLLQVDAPAREVLENLADERNPLYEEIADLTIRTDEQSAKVVANQIIELLEKN

SEQ ID NO: 21146 - protein, 464 aa, Xenorhabdus nematophilus
MAATRIEKDSMGPIEVPADQLWGAQTQRSLEHFRISQEKMPVALIHALALTKQAAASVNMDLGLLPKERSDAIIAAAKEVLEGKHPTEFPLAIWQTGSGTQSNMNMNEVLANRGSEILGGQRGNERLIHPNDDVNKSQSSNDVFPTAMHVAAVIGLSEQLLPELKTLQKTLADKAAAFKDIVKIGRTHLQDATPLTLGQEVSGWAAMLTHNLKHIEDSIPHVCELALGGTAVGTGLNTHPEYAVRVAKKISELSGQPFVTSPNKFEALATCDALVHSHGALKGLAASLMKIANDVRWLASGPRCGIGEISIPENEPGSSIMPGKVNPTQCEAMTMLCAQVMGNDVAINIGGASGNFELNVFRPMVIDNFLQSIRLLADGMRSFNDHCAVGIEPNHDRITQLLNESLMLVTALNTHIGYDKAAEIAKKAHKDGLTLKQSAMQLGYLTDAEFDAWVRPEDMVGSMK

SEQ ID NO: 21147 - protein, 207 aa, Xenorhabdus nematophilus
LKCRGFLFDLDGTLIDSLPVVERAWCQFADKMDIDRDEVLSFVHGTPAMISLRHFMPDASEEEINRTFKWIEKIESEDTEGVTALPGAIALIDKLNALDIPWAIVTSCTVPLASVRHKVAELPEPAHWVTAESIKNGKPNPEPYLLGASMLGLSPEECVVFEDAAAGIHAGLDAGCQVVVVHNSPGIPRRDELHLVLNNLEDIEISK

SEQ ID NO: 21148 - protein, 448 aa, Xenorhabdus nematophilus
EQSAGAQKLHRGLGKRHVQLIAIGGAIGTGLFMGTGKTIAVSGTSIILTYLLIGFFAFMVMRAMGELLLTKLDYRTFADFVADYLGEKASYFLGWTYWMSWVVSCIADVVVCGGYIQYWFPDVSLWFTALSLLGLICLCNFFSVQLFGETEFWFAMIKVVAIVALIIVGVGMVFVGWTSPNGVTASVRHLTDPEVFLPNGMFGFLAGFQIAIFSFTGIELVGTVTAETKEPEKVLPKAINTIPIRIIIFYVLSIMCIIAVTSWTNISPEVSPFVTLFALAGLPAAAAVINFVALTSAMSSANSGLYACTRMLYGLSTEKLAHGKFAQLSVSSAVPIFSLIFSVICMASGVFLLFIVPNVMKLFTIVSTVAAIMVIYSWGMILIAYLAYRKKRPDLHKISIYKMPMGIPMTWCTLIFFAFTVVIMVFDYDTRVALYGTPIWFVILEVLW

SEQ ID NO: 21149 - protein, 418 aa, Xenorhabdus nematophilus
NHQANYIGSGWVAGQGEPVIKYSPLDQRILWQANSASVSQVNDACQSARRAFPAWAKLTAEKRIAIIQAFADLLTQEKEAIARVISEETSKPLWETRTEVQSMIGKVAISIEGWQQRTGYSETPMPDGKAILQHRPHGVMAVFGPYNFPGHLPNGHIVPALIAGNTLVFKPSELTPMTAEKTVQLWIKAGLPAGVLNLVQGGRETGGALLDSREIDGVLFTGSAATGFHFHRVLAGQPEKMLALEMGGNNALIVDDYDDLEAAVYTIIQSAFISAGQRCTCARRLLVKRGEKGDALIQRLLDTAGQIIPSRWDADPQPFIGGVISLPAVENLLDAQSRLQALGGVSLLTMTQPDPDSTFMTPGIIDLTDAKEVPDEEYFGPLLTLKRYDTFEEAISIANDTRFGLATGLISPDAALFE

SEQ ID NO: 21150 - protein, 400 aa, Xenorhabdus nematophilus
SNTIQRSWFDQYMVPCFSPAQFIPVRAKGSRVWDQEGKEYVDFAGGIAVNSLGHANDELKKVLTSQIESMWHVGNGYTNEPVLKLAKTLVENTFADKVFFCNSGAEANEAALKIARKYALDKYGSHKNEIISFENSFHGRTLFTVTVGGQPKYSQDFAPLPQQISHLPYNNIDAIKAHISENTCAVIVEPIIGEGGVIPADPAFLKALRELCDQHQALLIFDEIQTGVGRTGYFYAYEETGVEPDILTSAKGLGGGFPIGAMLVKQPIADVFQPGSHGTTFGGNPLAAAVANQVVALVNQPEFLAGVQERHHKFIKRMSDLNQRYHVFSELRGKGLLLGAELEKKYQGKAKTLSNIAAEEGLIALIAGPNVLRFAPALNIEEQDINDGFARLENALKRFV

SEQ ID NO: 21151 - protein, 306 aa, Xenorhabdus nematophilus
VIEFEQVKKHYKDYQALKGISLDVYRGEFLGLLGPNGAGKTTLVEILEGLKTPDSGSVRVLGKTWQQDAPYLRQHLSGVLQQTLFIDKLSVEETLNLFGSFYGCSRKRAQEVMELVELEEKRKTYVEGLSGGQRQRLALGVSIINEPEILILDEPTTGLDPRIRHDTWDILRKLNREKHSTMILTTHYMEEAEYLCDRICIMNKGEIITQGSMDELLKKHCDGDLIEFRTHFPDRLQVLSQHAQVLNYEYDERKDKICMLIEDSTSFVAHLFEFAKQVEVDIIELMVRKKTLDDLFMTLAGRRLHE

SEQ ID NO: 21152 - protein, 347 aa, Xenorhabdus nematophilus
MHKTDELRTRSIGRLITPKALAEQYPISEKIRQNVTLSRKRIESILTGNDPRLLVIIGPCSIHDVDAALDYAARLQVLREKYQHSLEIVMRTYFEKPRTVIGWKGLISDPLLDGSCQVNKGISLARKLLNDINELGMPTATEFLDMVTGQYIADLISWGAIGARTTESQIHREMASALSCPVGFKNGTDGNTHIAIDAIRAARAKHMFLSPDKDGRMTIYQTNGNPHGHIIMRGGKKPNYKAEDIAAACQKLHEYQLTERLIVDCSHGNCQKIHRRQLDIAKDIGQQIQSGSTSIAGVMAESFLIEGTQKVVHGEPLTYGQSITDPCLSWQDTEQFINILSRAVKDR

SEQ ID NO: 21153 - protein, 249 aa, Xenorhabdus nematophilus
ENLLEARNLNYFIGHRQIIKDISLSLQKGEVVAIIGPNGAGKSTLLRLLTGYIPSNSGECLLKGVPISRWPTQQLARIRAVMRQYSSLSFPFSVEEIIAMGRVPHENTHRKTAIDEAIMLTECEELRHRNYQQLSGGEQQRVQLARVLTQLWHPEPTESCLFLDEPTSALDLYHQQHTLRLVHRLTRQRPLAVCCVLHDLNLASLYADKIILLHKGKLVASGSPQDVLRDDILKQWYRADLGVTQHPET

SEQ ID NO: 21154 - protein, 396 aa, Xenorhabdus nematophilus
VFQNIDAYAGDPILSLMEAFKKDPRAEKINLSIGLYYDEQGITPQLQAVATAEEQMSALPQSASLYLPMEGLLAYRSAIQELLFGKDHPLLGQKRIATIQTVGGSGALKVGADFLHRYFPDSEVWCCDPTWENHASIFAGAGINVNYYPYFDDKTKGVKFDKMLATFNQLPAKSIILMHPCCHNPTGSDLTNDQWDQVVQVAKERELIPFLDIAYQGFADGVEEDAYAIRAMANAELPCLVCNSFSKIFSLYGERVGGLSVVCDDAKAGECVLGQLKASVRRIYSSPPNFGAQVVARVLSDPELKALWLKEVEQMRLRIKEMRTVLVNALKSALPEKNFDHLLKQRGMFSYTGFSQEQVDRLREEFGVYLVISGRICMAGVNHQNVQKIAEAFAAV

SEQ ID NO: 21155 - protein, 360 aa, Xenorhabdus nematophilus
AGNSIGQFFRVTTFGESHGIALGCIVDGVPPGIAITEADLQIDLDRRRPGTSRYTTQRREPDQVRILSGVFEGVTTGTSIGLMIENTDQRSQDYSAIKDVFRPGHADYTYEQKYGLRDYRGGGRSSARETAMRVAAGAIAKKYLLEKHGIRIRACLTQMGDIHCELKDWDLVEQNPFFCPDESKLTQLDELLRTLKKEGDSIGAKVTLVAENVPVGLGEPVFDRLDADIAHALMSINAVKGVEIGDGFGVVNLRGSENRDEITSQGFTSNHAGGILGGISSSQPIIAHIALKPTSSIMVSGKTINRQGEEVDMVTRGRHDPCVGIRAVPIAEAMMAIVLMDHLLRQRAQCADVIFPLPRW

SEQ ID NO: 21156 - protein, 404 aa, Xenorhabdus nematophilus
MKRAVITGLGIVSSIGNNQKEVLESLREGRSGITFSEEFKEMGLRSHVWGNIKLDISGLIDRKTQRFMSDSSVYAYLAMDEAIKDSGLSDEQVSNLRTGLVVGSGGGSPRNQVSGSDGMRAKGLRGVGPYMVTRAMASGVSACLATPFKIKGVNYSISSACSTSAHCIGHAVELIQLGKQDVIFAGGGEELSWEMACEFDAMGALSTKYNETPELASRTYDQGRDGFVIAGGGGIVVVEELEHALARGAHIYAEIIGYGANSDGADMVAPSGEGAVRCMKLALDGIEGGVDYINTHGTSTPIGDLKELGAIREVFGDNTPAISATKAMTGHSLGAAGAHEAIYSLLMLEHGVIAPSINIDNLDEKALGMNIITEPTERELRTVMSNSFGFGGTNASLVMRKYSN

SEQ ID NO: 21157 - protein, 336 aa, Xenorhabdus nematophilus
MSEGWNIALLGATGAVGEAILALLQERQFQVGELHLLASEQNAGKIQRFNGKSITVYDAAEFDWSQVQLAFFAATKEATAQYVEKATEAGCLVIDSSGLFAAEPDVPLVVPGVNPHALAEYRNRNIIAVADSSTSQVLTAIKPLIDLAGIARLNLTNLLPVSVHGKAAINELAGQSARLLSGVPPDESLFNKQLAFNLLPLLPDAEGSVREERRIVDQIRRILQDEGLPISVSCVQSSVFYGIAQMVSVETLRPVGTEEAREELERFAEIQVSEEGDYPTQVTDASGSDRLSIGCLRNNYGMPEMLQFWSVADNIRFGGALMAVEIAEKLMQEQFY

SEQ ID NO: 21158 - protein, 385 aa, Xenorhabdus nematophilus
ILQIPQATSSLITWLSYLGNLHAKAIDMGLERVGALADQLDLLHPAPKVITVSGTNGKGTTCHTLESILLAAGLKVGVYSSPHLVRYTERVRIQGKEPAEQDFCRVFADIEAQRGDITLTYFEYGTLAALQLFKEADLDVVILEVGLGGRLDATNIVDSDVAAITSIALDHIDWLGADREHIGREKAGIFRQGRFAVVGEPDMPHTIAEVADELGAKLFRRGADWDFSQDANSWYWRTGDQQFSELPVPNLPLANAATAMGVIYCLLQQNDNVSQAINEQAIREGLSKAQLPGRFQIVRENPLVILDVAHNPHAAGYLVQKLAKLPRAPDSKIRGVVGMLEDKDIAGTLACLAQQVDEWYCASLHEFRGAEANILAEHLGDARTF

SEQ ID NO: 21159 - protein, 272 aa, Xenorhabdus nematophilus
MDKFAVFGNPIAHSKSPYIHRLFADQTGIDHLYGRVLAPIEHFEQTLDRFFERGGLGANITVPFKERAYQRSDELTERARISGAVNTLKLIEGNRLLGDNTDGVGLLADLQRLGFITKGRHILIIGAGGAAKGVLSPLLELGCAVTITNRTFARAQIIADKFSQLGDIQPIEMESLLSPDFDIIINATASGIDGQIPEVSPLIFCNDIACYDMYYQHGLTPFLDFARQNGISRLADGLGMLVWQAANAFELWHGVFPEIESVLTALRRELHA

SEQ ID NO: 21160 - protein, 425 aa, Xenorhabdus nematophilus
MQSLTLKPISCINGTINLPGSKSVSNRALLLAAFAKGTTCLTNLLDSDDIRHMLNALTTLEIPYRLSDDRTCCEIDGIGGTITGKGALELFLGNAGTAMRPLAAALCLGDNNVVLTGEPRMKERPIGHLVDALRQGGAKIDYLEQENYPPLHIKGGFSGGKVVVDGSVSSQFLTALLMAAPLAANDTDIHIQGDLVSKPYIDITLALMESFGVTVENHQYQVFHVKGQQQYQSPGHYLVEGDASSASYFLAAAAIKGGTVRVTGIGKNSLQGDTKFADVLERMGATIRWGHDFVECERGTLIGVDMDMNAIPDAAMTIATTALFAQGETVIRNIYNWRVKETDRLNAMAAELRKIGAEVEEGHDYIRVVPPQKLNHAEIETYNDHRMAMCFSLVALSDTPVTILDPGCTAKTFPDYFNQLEKLSQ

SEQ ID NO: 21161 - protein, 361 aa, Xenorhabdus nematophilus
MSQVYNFSAGPAMLPAEVLRRAEQELCNWHGLGTSVMEISHRSKEFMDVAAEAEKDLRDLLAIPENYKVLFCHGGARGQFSALPQNLLGDKTTADYIVSGYWSECAAKEAEKYCTPNVINITTEVDGIRSVKPMSEWALSSDAAYVHYCPNETIEGIAIFEEPDFGDDKIVIADYSSAILSAPIDVSRYGVIYAGAQKNIGPAGITVVIVREDLLGRAHQHTPSILDYTVQVKSASMYNTPPTFAWYLSGMVFKWLKEQGGLQEISKRNQAKAELLYRTIDNSNLYINCVAPQNRSIMNIPFQLANPMLDGKFLEEAYAHGLHALKGHKVAGGARASIYNAMPYEGVQALVEFMADFERRN

SEQ ID NO: 21162 - protein, 309 aa, Xenorhabdus nematophilus
VMSMAKLAVMGSINADHILNLESFPQPGETVMGKQYQVAFGGKGANQAVAAGRCGADITFIACVGQDDIGERVRQQLVKDNINTSAIGVIEGETTGVALIFVNQQGENVIGISAGANGALTSEYFHHHEQVVKEADVLLLQLETPLETVQLAAETARKHNTKVILNPAPAQKLSEQLLSLVDIITPNETEAEYLTGIAVKDNVGAEKAAQDLHKKGIEIVIITLGSRGVWLSENGKQGKIVPGFKVKAIDTIAAGDTFNGALVTGLLEGKGIVSAIRFAHAAAAIAVTRQGAQPAVPWRREIDAFLAEQ

SEQ ID NO: 21163 - protein, 177 aa, Xenorhabdus nematophilus
MSEFATVARPYAKAAFDFAVEHQSLEHWQNMLAFVAEVTRNEQVGELLSGSLAPETLANTFITLCGEQVDEHAQNFIRVMAENGRLLVLPEVFQQFTQLRASLESTINVEVISASELNEQQQAKISAAMEKRLSRKVKLNCKIDKSVIAGVVIRAGDMVIDGSIRGRLDRLTDVLQS

SEQ ID NO: 21164 - protein, 492 aa, Xenorhabdus nematophilus
MTRFGLQKLYIHGTYVNSVNPDKNTFDAINPANGEVIAQLQSATEQDVELAVKSAQKGQKIWAAMTAVERSRILLKAVDILRERNDVLAELETLDTGKPLSETQYVDIVTGADVLEYYAGLIHSLEGQQIPLRESSFVYTRREPLGVVAGIGAWNYPIQIALWKSAPALAAGNAMIFKPSEVTSLTALKLAEIYTEAGVPDGVFNVLTGAGHEVGHTLTVHPEIAKMSFTGGIVTGKKVMANASGSNLKEVTMELGGKSPLIIFDDADLDRAADIAMMANFFSSGQVCTNGTRVFVPKTLAPQFEAKIVERVKRIRIGSPLDPNTNFGPLVSFPHMESVLRYIESGKSSHARLLCGGERLLEGELAKGAFVAPTVFSDCTDDMLIVQEEIFGPVMCILTYETEDEVINRANNTDYGLAAGLVTQNLSRAHRVIHQLEAGICWINTWGESQAAMPVGGYKHSGIGRENGLVTLQNYTQTKSIQVELGHFESLF

SEQ ID NO: 21165 - protein, 553 aa, Xenorhabdus nematophilus
MVFDYIIIGAGSAGNVLATRLTEDSDVTVLLLEAGGPDYRFDFRTQMPAALAYPLQGTRYNWAYETDPEPHMNNRRMECGRGKGLGGSSLINGMCYIRGNALDFDNWATLSGLEDWAYLDCLPYFRKAETRDMGANDYHGDDGPVSVTTPKPVNNELFHVMIEAGIQAGYPRTDDLNGYQQEGFGPMDRTVTPEGRRASTARGYLDQARSRSNLTIITHALTDTLEFEGKMAVGVNFYQGNTSTLTQAKARKEVLLCAGAIASPQILQRSGIGPEEILNEFGIPVVQILAGVGQNLQDHLEMYLQYECLKPVSLYPALKWYNQPKIGAEWLFKGTGIGASNQFEAGGFIRTSEKFTWPNIQFHFLPVAINYNGSNAVNEHGFQAHVGSMRSPSRGRVKITSRDPRQHPSILFNYMSTAQDWQEFRDAIRITREIMAQPALASYCGREISPGTDIQTDEQLNTFIRERAETAFHPSCSCKMGTDEMAVVDGQGRVHGVKNLRVIDASIMPEIITGNLNATTIMIAEKIADKIRGRNPLPRSQAKYYVANGAPAR

SEQ ID NO: 21166 - protein, 255 aa, Xenorhabdus nematophilus
MRHPLVMGNWKLNGSTHMVNDLIAGLRKELSNVDGCGVAIAPPTVYVSLAKNALAGSRIALGAQDVDVNLSGAFTGETSAEMLKDVGAKYIIIGHSERRTYHKESDELIAKKFTILKEQGLIPVLCIGETEQENEAGQTEAVCARQIDAVLNTLGAEAFKDTVIAYEPVWAIGTGKSATPAQAQAVHKFIRDHIAKQDAAIAGQVIIQYGGSVNAGNAAELFTQPDIDGALVGGASLKADAFAVIVKAAAEAKKA

SEQ ID NO: 21167 - protein, 500 aa, Xenorhabdus nematophilus
ITEKKYIVALDQGTTSSRAVVLDHDANIVCISQREFPQIYPKPGWVEHDPMEIWASQSSTLVEVLAKSDISSDQIASIGITNQRETTIVWEKETGRPVYNAIVWQCRRTADICTKLKQKEGLEEYIRHNTGLVVDPYFSGTKIKWILDNVEGIRHRAENGELLFGTVDTWLVWKMTQGRVHVTDYTNASRTMLFNIHNLDWDQKILDELDIPRIMLPKVSSSSEIYGQTNIGGKGGTRIPIAGIAGDQQAALYGQLCVHPGMAKNTYGTGCFLLMNTGTDAVRSSHGLLTTIACGPRGEVNYALEGAVFVGGASIQWLRDELKLIADAADSEYFATKVKDSNGVYVVPAFTGLGAPYWDPYARGAIFGLTRGANSNHIIRATLESIAYQTRDVLDAMQADSGTRLKSLRVDGGAVANNFLMQFQADILGTRVERPDVRESTALGAAFLAGLAVGFWKDLDEVKSKATIEKEFRPGIETTERNHKYNGWKKAVARAQEWED

SEQ ID NO: 21168 - protein, 413 aa, Xenorhabdus nematophilus
VSKRRVVVTGLGMLSPVGNTVESSWNAVCAGQSGISLIEHFDTANHATKFAGVVKNFNHEDFNISRKDARKMDLFIQYGIAAGVQAIEDAGIEVTEANASRFGAAIGSGIGGLGLIEENHSTLLSAGPRKVSPFFVPSTIINMVAGHLSILYGLRGPSISIATACTSGVHNIGHAARIIAYNDADIMLAGGTEKASTTFGVAGFGAARALSTRNDDPQGASRPWDKDRDGFVLGDGAGVLVLEEYEHAKKRGAKIYAEIVGFGMSSDAYHMTSPPEDGAGAALAMENALKDADISPDQVGYINAHGTSTPVGDLAEARAVESVFGEGTKVLVSSTKSMTGHLLGAAGAIESIFTILALREQIVPPTINLENQDENCRLDLVPGEARKVEGMEYALCNSFGFGGTNGSLIFRKI

SEQ ID NO: 21169 - protein, 210 aa, Xenorhabdus nematophilus
MNSKFIVIEGLEGAGKTTAIRTVVETLKQYGISDLIFTREPGGTPLAEKLRQLIKQGVEGESLTNKAEVLMLYAARVQLVENVIKPALEKGTWVVGDRHDLSSQAYQGGGRGIDQKLMTSLRESALGDFYPDLTIYLDLPPEVGLQRARERGELDRIEKESLDFFHRTRERYLELVAQDDTIKKIDATQPLEKVQGAIRQTLLQWLKQQD

SEQ ID NO: 21170 - protein, 369 aa, Xenorhabdus nematophilus
MKSRAAVAFGPGQPLEIVEIDVAPPQAGEVLVKISHTGVCHTDAFTLSGDDPEGVFPVILGHEGAGVVVEVGAGVTSVKPGDHVIPLYTAECGECLFCKSGKTNLCVAVRATQGKGVMPDGTTRFSYNGQPIYHYMGCSTFSEYTVVAEVSLAKINPEANHEEICLLGCGVTTGIGAVHNTAKVQSGDSVAVFGLGGIGLAVIQGARQAKAGRIFAIDTNPAKFELAKQFGATDCLNPNDYDKPIQQVIIEMTEWGVDHTFECIGNVNVMRAALESAHRGWGQSVIIGVAGAGQEISTRPFQLVTGRSWRGTAFGGVKGRSQLPKMVEEAMKGEIELKPFVTHTLPLERINEAFNLMHEGKSIRTVIHY

SEQ ID NO: 21171 - protein, 383 aa, Xenorhabdus nematophilus
PVRVSCRKDLKLVIYITQTIIRRGLRLTVYGASDLLSSIGISWPDIAKLVEPDQISVYASSALGQIDRFSLAGLIGNPQNGTRISSKMLALSLADMPANFINSYIINSIGNTSANLGACASFLYNLKQGVNDIKQGKAKISLVGCSEAAIVPEIIEGFRVMGALAEDHQLCKLDGTDIVNNRRATRPFSTNVGFTIAESAQFVLLMSDDLALQCGANILGAVPDVFVNADANKKSISSPGIGNYITMMKAASLADHLLDGKLQYSYVQAHGTGTPQNRVTESHIINEVAKVFGLKCWDVTAIKSYVGHSIAASAGDQLACTLGVWQYGWIPGIKTIDHIAEDVHATNLNILMQNKFAGEHGEEMRATIINTKGFGGNNASAVI

SEQ ID NO: 21172 - protein, 493 aa, Xenorhabdus nematophilus
SKLTQLDPRSEESYRLDHFISATETTKFSYTSGRVALPVYNKYNVKNKPKVIGYYTDWSQYDSRLQGNQTPSARGRGIDLQHLLDNPFAYDKLIIGFCGIVGDQGEKKALISRAAPKFGRYNNGEVTFTDEWGDCQSYVNCTFPRWQDVQMPRDFKQDKSMGVLGGLAKIQDAARAQGHELVMSFSVGGWTMSNGFYNMVRNSQLKSKFISSLIDIFKRFPMFTEVDIDWEYPGAKGNDNPHDPKDGEYYISLIRDLSSAFKNAGRSDIKISIACSAVPDIMEKSKIPELLKVGLYGINVMTYDFFGTPWADKLRHHTNLRRYPGSENSVEKAVEYLLSVGVPSQAINIGYAGYSRNGKNTNITSYSPLSGSYSPEMGTTTGTFESGSTEWYDTIYNYLNLESRQDRNGFTLYTDEVADADYLYNQNSKLFISLDTPRTVKAKAKYALEKNLGGVFTWTADQDRGPLVNAAREGLGCPLLIKKIDMEPFYYKG

SEQ ID NO: 21173 - protein, 296 aa, Xenorhabdus nematophilus
FEEHLSACQQHVNDKLMATFSSLPFLDSPLATAMLHGAVLGGKRLRPFLVYSVGEMFGLSRESLDAPALALECIHAYSLIHDDLPAMDNDDLRRGQPTCHIKFGESLAILAGDALQSLAFEILAKQDMPNIALSDRLAMVAELATASGLAGMCGGQSLDLEAEGKQIDLATLEQIHRHKTGALICTAVRLGAYSAGQRGREVLPLLDQYSQAIGLAFQVHDDILDVIGNTDVIGKRQGNDQQLGKSTYPALLGLEQAKKKARDLYEEALAALTELEKQSYNTVILKKLAGFIIERN

SEQ ID NO: 21174 - protein, 620 aa, Xenorhabdus nematophilus
MSIDIAKYPTLALAETPEELRLLPKDTLPKLCDELRQFLLNSVSRSSGHFASGLGTVELTVALHYVYKTPFDNLVWDVGHQAYPHKILTGRRDHINTIRQKNGLHPFPWRDESEYDTLCVGHSSTSISAGLGMAIAAKHEDKGRKTVCVIGDGAITAGMAFEAMNHAGDIDPDMLVILNDNEMSISENVGALNNHLAHLLSGKLYTTLREGGKKVFSNLPPIKELLKKTEEHLKGMVVPGTLFEELGFNYIGPVDGHDVLALTQTLKNMRELKGPQFLHIMTKKGRGYAPAEKDPIGWHAVPKFDPATGSLPKSSDTRPTFSKIFGDWLCEEAAHDKKLMAITPAMREGSGMVRFSREYPEQYFDVAIAEQHSVTFAAGLAIGGYKPIVAIYSTFLQRAYDQVIHDVAIQNLPVLFAIDRGGIVGADGQTHQGAFDLSFLRCIPNMVIMAPSDENECRQMLHTGHHYQGGPVVVRYPRGTGTGAELQPLEALPIGKGIVRRQGERIAILNFGTLLPDALQSAEALNATVVDMRFIKPLDNQLVLEIAASHDMLVTLEENAIMGGAGSGVNELLMQTSQPVPVLNLGLPDHFIPQGTQEEIRADLGLDARGIQHAIEKYLA

SEQ ID NO: 21175 - protein, 465 aa, Xenorhabdus nematophilus
MQYTHFDAIVIGSGPGGEGAAMGLVKQEKNVAVIERYNSVGGGCTHWGTIPSKALRHAVSRIIEFNQNPLYSDNSRILRSSFSEILRHADVVISQQTKMRQGFYERNRCQMFAGEAAFIDEHRVSVRYADGSVDILSADKIIIATGSRPYCPPDVDFTHSRIYNSDTILQLDHEPRHVIIYGAGVIGCEYASIFRGLGVKVDLINTRDHLLSFLDQEMSDALSYHFWNSGTVIRHNEEYEKIEGLDDGVIVHLKSGKKVKADCLLYANGRTGNTDKLGLENVGLETDSRGLLKVNRVYQSSNENIYAVGDVIGYPSLASAAYDQGRIAAKAIMTGSANLHLVEDIPTGIYTIPEISSIGKTEQQLTAMKIPYEVGRAQFKHLARAQIAGMNVGSIKILFHRETKQILGIHCFGERAAEIIHIGQAIMEQKGEGNTIEYFVNTTFNYPTMAEAYRVAALNGLNRLF

SEQ ID NO: 21176 - protein, 456 aa, Xenorhabdus nematophilus
MALWGGRFSQEADQRFKQFNDSLRFDYRLAEQDIIGSVAWSKALVTVGVLVSEEQQKLELALNELLGEVRANPKAILKSDVEDIHSWVEGQLIAKVGDLGKKLHTGRSRNDQVATDLKLWCKDQIADIQQALVELQQALVITAENNQDAVMPGYTHLQRAQPVTFAHWCLAYAEMLDRDESRLQDALKRLDVSPLGCGALAGTAYDIDREQLASWLGFASATRNSLDSVSDRDHVLELLSDASISMIHLSRFAEDLIFFNSGEAGFIELSDRVTSGSSLMPQKKNPDALELIRGKCGRVQGALTGMMITLKGLPLAYNKDMQEDKEGLFDALDTWRDCLHMAVLVLDGIQVKRGRCEEAAKQGYANATELADYLVVKGVPFREAHHIVGEVVIAAIAEGKALEELSLFELQKFSEAISLDVYDVLSLQSCLDKRLAKGGVSQQQVAQAIAAVKQRL

SEQ ID NO: 21177 - protein, 398 aa, Xenorhabdus nematophilus
IKKIVLAYSGGLDTSAIIPWLKEHYDNCEVVAFVADVGQSREDLEGVEQKALRSGASECHVIDLREEFIKEYVYPVLKTGALYEGSYLLGTSMARPIIAKAQVELALKVGADSVAHGATGKGNDQVRFESTYTALAPHLKVVAPWREWDLRSREALLDYLKVRDIPTTATLEKIYSRDENAWHISTEGGVLESTWNAANKDCWVWTAEPEDAQNEPEYVTVTVEKGEVVGVNGKGLSPYQCLNALNELGAKHGIGRIDIVENRLVGMKSRGCYETPGGTIMMAALRGIEQLVLDRDSFKWRQQLGLEMSYVVYDGRWFAPLRQSIQAAAETLADSVSGAVVLKLYKGQVTAEQKKSTYSLYSEEFATFGEDEVYDHRHAEGFIRLYSLSSRIRTLNSK

SEQ ID NO: 21178 - protein, 257 aa, Xenorhabdus nematophilus
MEPLVIKLGGVLLDSEEALARLFSTLQSYRKTHKRPLVIVHGGGCLVDELMQRLQLPIVKIQGLRVTPADQINIVTGTLAGTANKALLACAIKYRLPAIGLCLGDGGVVQVSQFDEEFGHTGKAHPGKPDLLKILLDVGYMPIISSIGITENGELMNVNADQAATAIAQVLNADLVFLSDVSGILDGKGQKIPELTAEKIEQLIEHGIITDGMIVKVNAALEAAKTLKHPVDIASWRHTEQLIALFNGIPTGTRISA

SEQ ID NO: 21179 - protein, 334 aa, Xenorhabdus nematophilus
MLNTLIVGASGYTGAELAAYLQRHLHVHLSGLMVSSQSSDAGKCFSDLYPQYKGIVDLPLQPLTDVAEAVNGIDVVFLATAHEISHDIVPIFLQAGCTVFDLSGAYRVQNTQFYSKYYGFEHKNTAWLDKAVYGLAEWQAEKIKTAQLIAVPGCYPTVSQLSLKPLLEKNLLDTEQWPVINAVSGVSGAGRKATINNSFCEVSLQPYGIFNHRHQPEIATHLGTEVIFIPHLGNFSRGILATITCKLKSGVTEKQIREAYQLAYHDKPLVRLYTEGMPALKAVVGLPFCDIGFAVQGQHLIIVGAEDNLLKGAAAQAVQCMNIRFGFAETQALL

SEQ ID NO: 21180 - protein, 878 aa, Xenorhabdus nematophilus
MNQQYSAMRSNVSMLGKLLGNTIKEALGESILDKVETIRKLSKSSRAGNEADRQQLLSTLQNLSNDELLPVARAFNQFLNLANVAEQYHSISPHGEAASNPVALEALFNRLKDKKFSNDDLINAVNELAIELVLTAHPTEIARRTLIHKLVEVNACLSQLDHDDLADYERINIMRRLRQLIAQSWHTDEIRKIRPTPIDEAKWGFAVVENSLWEGVPAFLREFNEQLEESIGYSLPVEAVPIRFTSWMGGDRDGNPNVTAEITRHVLLLSRWKAADLFLKDIQVLVSELSMSECTPELRQLAGGDGVLEPYREIAKQLRTQLNSTLTYLEKHLKGERVLPPVGLLLHNEQLWQPLYACYQSLKTCGMEIIANGQLLDTLRRIRCFGLSLVRIDIRQESTRHTDAIAELTQYLELGDYASWSETEKQTFLLRELNSKRPLIPHCWQPSEETLEVFETCKVIAESPQDAIAAYVISMAKVPSDVLAVKLLLKEAGCSLKLPVAPLFETLDDLNNAESVIQQLLGIGWYRELIQDKQMVMIGYSDSAKDAGVMAASWAQYRAQDALIKVCEQESVTLTLFHGRGGTIGRGGAPAHSALLSQPPGSLKGGLRVTEQGEMIRFKFGLPQVTISSLALYASAILEANLLPPPEPKPEWKQVMDTLSDVSCDMYRDYVREQPEFVPYFRAATPEQELAKLPLGSRPAKRRPTGGVESLRAIPWIFAWTQNRLMLPAWLGAGAALQHVIDAGKLSVLADMCRDWPFFNTRIAMLEMVFAKADLWLAEYYDQRLVDKKLWPLGITLRNQLAEDIKTVLTISQDEQLMADLPWIAESIALRNVYTDPLNVLQAELLQRSRQQEQPDPHLEQALMVTIAGVAAGMRNTG

SEQ ID NO: 21181 - protein, 812 aa, Xenorhabdus nematophilus
MSALATAGAEFGRQLHKFGGSSLADVKCYQRVAEIMANYSQPGDLMVVSAAGSTTNQLIDWLKLSQSDRISAHQVQQSLRRYQQELIRGLLPEVIAEELVAHFISDLEKLSVLLDKPITDITYAEVVGHGEIWSARLMAAVLEHKGISSAWLDARQFLRAERAAQPQVDVNLSQPLLSQLLIQNPSKRLVVTGFISRNQKGETVLLGRNGSDYSATQVGALAGAKKVTIWSDVAGVYSADPRKVKDACLLPLLRLDEASELARLAAPVLHTRTLQPVSVSDIDLQLRCSYQPEQGSTRIERVLATGTGAKIVTSHDDVCLIELHISSAHDFKQIYKDIDSLLKRAQIRPLATGLHADCNLIQLCYTSEVVNSALDVLQDASLPGKLSLREGLALVALVGAGVCKNPLHSHRFYQQLKDQPIEFIWHAEEGISLVAVLRLSQTSHLIQGLHQSLFRAEKRIGLVLFGKGNIGSRWLELFAREQKNISARSGFEFILAGIVDSRRSLLNYQGLDASRALAFFGDEATQHEDDALFLWMRAHPYDDLVVLDVTASEELAKDYIDFASYGFHVISANKIAGSSNSNTYRMVRDAFAKTGRHWLYNATVGAGLPINHSVRDLRESGDTILSISGIFSGTLSWLFLQFDGSVPFSDLVEQAWQQGLTEPDPRIDLSGQDVMRKLIILAREAGYEIEPDQVRVESLVPVEARTGSIEDFFENSAVINEQMLQRLEASQEMGMVLRYVARFDATSGKAKVGVEAVRADHPLASLLPGDNVFAIESRWYRDNPLVIRGPGAGRDVTAGAIQSDLNRLSQLL

SEQ ID NO: 21182 - protein, 236 aa, Xenorhabdus nematophilus
NPLLRIVDIQYICGLAHKVGALAVVDNTFLSPVLQKPLDLGADLVVHSCTKYLNGHSDLIAGAIIAKDPVIAENLAWWANNIGITGAAFDSYLLLRGIRTLSARVMLQQNNAAAIAEYLQQQPQVKKLYYPALKNHPGHEIALKQQTGFGAMLSFELDGDEQTLRHFLSALKLFTLAESLGGVESLISHTATMTHAGMAAEARAQAGITDSLLRVSVGIEDSQDLIADLDKAFQAA

SEQ ID NO: 21183 - protein, 404 aa, Xenorhabdus nematophilus
MSSVEILVPDLPESVADATVATWHKKAGDTVQRDDVLVEIETDKVVLEVPASEAGVLEAILEEEGATVLSKQLLGRIRLSDSTGIPAEVKEKTESTPAQRQTASLEEESNDVLSPAVRRLIAEHDLDPAAIKGSGVGGRIVREDVEKYIAAHKKESGKVAEAAPAQASQLPHRSEKRVPMTRLRKRVAERLLEAKNNTAMLTTFNEVNMKPIQELRKQYGDAFEKRHGMRLGFMSFYVKAVVEALKRYPEVNASIDGTDVVYHNYFDISIAVSTPRGLVTPVLRDADALGMADIEKSIKELAIKGRDGKLTVEELTGGNFTITNGGVFGSLMSTPIINPPQSAILGMHAIKDRPMAVNGQVEILPMMYLALSYDHRLVDGRESVGFLVTIKEMLEDPTRLLLDV

SEQ ID NO: 21184 - protein, 927 aa, Xenorhabdus nematophilus
MKDWLDSSFLAGANQSYIEQIYEDYITDPNSVDASWREIFQQLPDIGLSGEQLHSQTRDYFRRLAKDATRYHTSVSDPAMDAKQVKVLQLINAFRFRGHQSANLDPLGLWKQEPVPDLDPAFHNLTKADFEETFNVGSFAIGKETLKLADLYDALKRIYCGSIGAEYMHITNTEEKRWIQQRLESIAVGSQFSADEKHRFLAELTAAEGLERYLGAKFPGAKRFSLEGGDALIPMLKELIRHAGKQGTREVVLGMAHRGRLNVLVNLFGKKPADLFDEFAGKHKEHLGTGDVKYHQGFSSDFETEGGLVHLALAFNPSHLEIVSPVVIGSVRARRDRLDEGRSNMVLPVTIHGDAAVIGQGIVQETLNMSQARGYEVGGTVRIVINNQIGFTTSNPKDARSTQYCTDIVKMVQAPIFHVNADDPEAVAFVTRLALDFRNTFKRDVMIDLVCYRRHGHNEADEPSATQPLMYQKIKKQPTPRKIYADKLIAEGLLAANDVTEMANLYRDALDHGECVVNEWRPMGLHSFTWEPYLNHEWDEDYPHKVDMKRLQDLGKRISTIPAEVEMHSRVAKIYGDREEMANGNKLFDWGGAETLAYATLVDEGIPVRLSGEDAGRGTFFHRHAVIHNQPNAAVYVPLENVHSSQGVFNVWDSVLSEEAVLAFEYGYATTEPRALTIWEAQFGDFANVAQVVIDQFISSGEQKWGRMCGLVMLLPHGYEGQGPEHSSARLERYLQLCAEQNMQVCVPSTPAQVYHMLRRQALRGMRRPLIVMTPKSLLRHPLAVSSLDELANGKFEPVIGEIDALDPKGVKRVVLCSGKVYYDLLDQRRKNEQADVAIVRVEQLYPFPRQNLQSLLEQYAHVHDFVWCQEEPLNQGAWYCSQHNFREVIPFGASLRYAGRPASASPAVGYTSVHQQQQQALVNDAL

SEQ ID NO: 21185 - protein, 238 aa, Xenorhabdus nematophilus
MKLEFSIYRYNPDVDNAPRMQDYTLEAEEGRDMMLLDALIQLKEQDPTLSFRRSCREGVCGSDGVNMNGKNGLACVTPVSVLRRGNKKIVIRPLPGLPVVRDLVVDMSQFYTQYEKIRPYLINDGKNPPAREHLQSPEQREKLDGLYECILCACCSTSCPSFWWNPDKFIGPAGLLAAYRFLIDSRDTETASRLDGLNDAFSVFRCHSIMNCVSVCPKGLNPTKAIGHIKSMLLKHSA

SEQ ID NO: 21186 - protein, 588 aa, Xenorhabdus nematophilus
MKLPVREFDAVVIGAGGAGMRAALQISQMGLSCALISKVFPTRSHTVSAQGGITVALGNTHEDNWEWHMYDTVKGSDYIGDQDAIEYMCKTGPEAILELEHMGLPFSRLDNGRIYQRPFGGQSKNFGGEQAARTAAAADRTGHALLHTLYQQNLKNNTTVFSEWYSLDLVKNQDGAIVGCTAICIETGEIVYFKSKATILATGGAGRIYQSTTNAHINTGDGVGMALRAGVPVQDMEMWQFHPTGIAGAGVLVTEGCRGEGGYLLNKDGERFMERYAPNAKDLAGRDVVARSIMIEIREGRGCEGPWGPHAKLKLDHLGKDVLETRLPGILELSRTFAHVDPVKEPIPVIPTCHYMMGGIPTKITGQALTVNEKGEDVIIPGLFAVGEIACVSVHGANRLGGNSLLDLVVFGRSAGLHLKECLMEQGTSRDASESDVDAALQRLNRWNNTRSGEDPVEIRKALQACMQNNFSVFREGDAMAKGLEELKVIRERLQNARLDDTSSEFNTQRIECLELDNLMETAYSTAVSANYRTESRGAHSRFDYPERDDANWLCHSLYLPRTESMTRREVNMQPTLREAFPPKVRSY

SEQ ID NO: 21187 - protein, 427 aa, Xenorhabdus nematophilus
MADKKATLTISGAAAIELDVLTPTLGSEVIDVRTLGSKSFYTYDPGFTSTASCESKITYIDGDEGILLHRGFPIDQLATGSNYLEVCYILLYGEPPTPEEYETFKKTVIRHTMIHEQITRLFHGFRRDSHPMAVLCGVTGALAAFYHDALDVHNPHHREITAYRLLSKMPTVAAMCYKYSIGQPFVYPRNDLSYAANFLHMMFSTPCEEYKVNPVLERAMDRIFILHADHEQNASTSTVRTAGSSGANPFACIAAGIASLWGPAHGGANEACLRMLEEIQTVKHIPEFIARAKDKNDSFRLMGFGHRVYKNYDPRATVMRETCHEVLNELGLNDSLLEVAMELERIALNDPYFIEKKLYPNVDFYSGIILKAMGIPSSMFTVIFAIARTIGWIAHWTEMHDEGLRIARPRQLYTGHTQRDFKSQLEK

SEQ ID NO: 21188 - protein, 684 aa, Xenorhabdus nematophilus
MKDKHQALFEPALIRHALIDAVKKCHPAIQWRDPVMFVVYLGSCLTTVLWLGMLTEQLTGNALFTGSIALWLWFTVLFANFAEALAEGRSQAQASSLKGVKKTTWATRLASASHDAAKEKVTSDHLRKGDIVLVEVGEIIPCDGEVLEGGASVDESAITGESAPVIRESGGDFASVTGGTRVLSDWLIIECSVNPGETFLDRMISMVEGAKRRKTPNEIALTILLTALTIIFLLSCISLLPFSLFSVQTNQSGDPISITVLVALLVCLIPTTIGGLLSAIGVAGMSRMLGANVIATSGRAIEAAGDVDVLLLDKTGTITLGNRQASQFLPAPGVTEEQLADAAQLSSLADKTPEGRSIMILAKQRFNMRERDLRALNATFIPFSAMTRMSGVNIGTRMIRKGAVDAIRRYVEANHNQFPDAIDLLVQQVASKGATPLVVAENQRVLGVVALKDIVKGGIKERFSEMRRMGIKTVMITGDNHLTAAAIAAEAGVDDFLAEATPEAKLALIRQYQSEGCLVAMTGDGTNDAPALAQADVAVAMNSGTQAAKEAGNMVDLDSNPTKLIEVVHIGKQMLMTRGSLTTFSIANDIAKYFAIIPAAFAVTYPQLNALNIMHLHSPESAVLSAVIFNAIIIIVLLPLALKGVSYRAMNALSLLRRNLWLYGLGGLLIPFVGIKLIDMLLTV

SEQ ID NO: 21189 - protein, 907 aa, Xenorhabdus nematophilus
ASAHWVDKRTLLWPEGADKPHVRLYYNRYNKVEVNDEGNFTDSYLVLTPTTLSKKTAERFPHLAELPAFQLPENTDVDRLITGELVALATNEEGLLLSATQVQIAGVLDDRFAGTAETLEYGALINDTEVTFRLWAPTAQNVGLVIYNENKQAIANHIMNRDAASGSWSWQGDTNLIGAYYRYALTVYHPYSRKVERYEVTDPYSHSLSTNSEYSQVINLDDEALKPQNWDDLSMPHPQKTPADIARMTLYEAHIRDLSVADNTVPQAWRGKYLALTANSSDMFKHLKALSQAGMTHIELLPVFDIASIDEFSRNVADLNQSFNRLCQVNTTVKNSRFADYCNRSMTVREVLQALQRGDSASNPQVQELNKMLAETDSYNWGYDPFHYSVPEGSYATHAEGSVRIKEFRTMVQAIKQQLGMNVIMDVAYNHTNAAGPTHRTSVLDKVVPWYYHRLDEITGNVENNTCCSDTAPEHRMFAKLIEDSLVTWVKHYKIDAFRFDLMGYHPKAQIVSALAKVRAINPSVYFFGEGWNSGQDDRFETASQINLKGSGIGTFSDRLRDAVRGGGPFDSADNIRINQGMGNGAGTLPNEIARLDANEARHLADLIRLGMAGNLADFAMIDKDGKVKAGREINYKGVAAGYAADPIEVINYVSKHDNQTLWDIISYKAAYEADLATRLRMQAISLSTVLLGQGLAFDQQGSELLRSKSFTRDSYNAGDWFNRVSYTYKDNNYDVGMPGKRDDGGNYALIHRVKNQVKKPGQSELLQMMAFYQELLRLRQFSPLMTLGKGESVKQRIDFRNVGPHQQLGLLVMTIDDGNTTDDDRDLRFDGLVVVINAASKSVTVRDLNTHGLKLNDIQSRLGNASLAAGIKITEDGMVTMPAWSAAVLVLPQKGIRGTGLPVRRK

SEQ ID NO: 21190 - protein, 543 aa, Xenorhabdus nematophilus
VAIHPRAGQPAQQHDLINIAQLTSQYYTLQPHPENPAHQVKFGTSGHRGSSGRNSFNEAHILAISQAIVEVRAQQGITGPCYVGKDTHALSEAAFISVLEVLIANGVDVIVQENNGFTPTPAISHAILCYNRQGKNRADGIVITPSHNPPEDGGIKYNPPNGGPADTDLTSIIEKRANALLANDLNGVKRLPYERVLKSEYLHPQNLVDPYVTSLGDVVDMAAIQQAGLKIGIDPLGGSGIAYWQRIGEYYNLDLTLVNDKVDQTFRFMTLDHDGVIRMDCSSRWAMAGLLELRGKFDLAFANDPDYDRHGIITPVGLMNPNHYLATAVDYLFRHRPQWSEKVAVGKTLVSSAMIDRVVADLGRELLEVPVGFKWFVDGLYRGELGFGGEESAGASFLRFDGTPWSTDKDGIILCLLAAEMTATTGENPQQRYDKLAARFGTPSYSRIQAPASHQQKALLSKLSPEMVKANTLAGDPITARLTTASGNGASIGGLKVMSDNGWFAARPSGTEEAYKIYCESFLGAEHREKIEQEALEIVNQVF

SEQ ID NO: 21191 - protein, 262 aa, Xenorhabdus nematophilus
MGFMTGKRILITGVASKLSIAYGIAKAMHDQGAELAFTYQNDKLKLRVEEFAASLDSNIILPCDVAEDESIDALFAELGKVWPKFDGFVHSIGYAPAEQLDGDYVNAVNREGFKIAHDISAYSFVAMAKSCRNMLNPNSALLTLSYLGAERAIPNYNVMGLAKASLEANVRYMANAMGAEGVRVNGISAGPIRTLAASGIKDFRKMLAHCEAVTPIRRTVTTEDVGNAAAFLCSDLAGGVTGEIMHVDGGFSIAAMNELELK

SEQ ID NO: 21192 - protein, 206 aa, Xenorhabdus nematophilus
NESQHVSTQDALLGRAIPLTVSPYHVITQHSINDIPENMEIAYIGMGCFWGVERLFWQQEGIYTTSVGYSGGTTPNPTYEEVCTGLTGHAEVVRIVFDPTKITYGQLLTLFWENHDPAQGMRQHGDIGTQYRSAIYTISSQQYEQALATREQFQQAMNENGDQRTITTEIHAAKPFYFAEDYHQQYLFKNPEGYCGLGGIGVCLLP

SEQ ID NO: 21193 - protein, 332 aa, Xenorhabdus nematophilus
MKTLGEFIVEKQQDFPHATGELTALLSAIKLGAKIIHRDINKAGLVDILGTSGVSNVQGEVQMKLDLYANEKLKAALKARGEVAGIASEEEDEIVVFDGDRAENAKYVVLMDPLDGSSNIDVNVSVGTIFSIYHRITPIGQPVTEDDFLQPGNRQVAAGYVVYGSSTMLVYTTGYGVHTFTYDPSLGVFCLTHEKVQFPAKGNMYSINEGNYIKFPMGVKKYIKYCQEQDEATQRPYTTRYIGSLVADFHRNLLKGGIYIYPSTASNPTGKLRLLYECNPIAFLAEQAGGKASDGKNRILDITPTQLHQRVPFFVGTKSMVEKAESFMAEFP

SEQ ID NO: 21194 - protein, 311 aa, Xenorhabdus nematophilus
MKVAVLGAAGGIGQALALLLKTQLPSGSELSLYDIAPVTPGVAADLSHIPTEVKVTGFAGEDATPALVGADVVLISAGVARKPGMDRSDLFNINAGIIRNLVQQVAKACPKALIGIITNPVNTTVAIAAEVLKKEGVYDRNRLFGITTLDIIRSNTFVAELKGKNSEELEVPVIGGHSGVTILPLLSQIQGVSFTDEEVEALTKRIQNAGTEVVEAKAGGGSATLSMGQAAARLGLSLIRGLQGESNVIECSYVEGDGKYARFFAQPVRLGKNGIEERLDIGKLSDFEQKSLDSMLGVLKKDIELGEKFIN

SEQ ID NO: 21195 - protein, 307 aa, Xenorhabdus nematophilus
AMVNETIINQLNSDVALINQLGYYIISGGGKRIRPMIAVLAGKALHCEKEKHIKVAALIEFIHTATLLHDDVVDESDMRRGKATANAMYGNAASVLVGDFIYTRSFQMMTDLDSMRVLKLMSDATNVIAEGEVMQLMNCNDPDTSEDDYMRVIYSKTARLFEVAAHSAAILSGATPEQEAALRDYGRYLGTAFQLIDDLLDYDSDDSTLGKNTGDDLNEGKPTLPLLHAMHHGVPEQSALIRSAIEQGNGRHLLDTVLATMKQCGSLKYTRQRAEEEADKAISALQVLDESPYKAALVGLAHVAVQR

SEQ ID NO: 21196 - protein, 202 aa, Xenorhabdus nematophilus
MIDLYYAPTPNGYKISLFLEEAGLPYTIYPINIGTGEQFKPEFLAISPNNKIPAIVDHQPADGGEPISIFESGAILLYLANKTGQLLSKDVRERNQQLQWLFWQVAGFGPMLGQNHHFNHYASEVVPYAINRYMEESRRLVNVLNTQLEKTPYLGGNEYSIADIATYPWARCHEHQKINLNDYPAVEKWLKKIEQRPATQAA

SEQ ID NO: 21197 - protein, 175 aa, Xenorhabdus nematophilus
MVEEKSAGIEWIDIVNEGNEVIAQATRQQMRSQNLRHRATYIVVHDGMGKILVQHRTETKDFYPGRLDATAGGVVMVGENMLDSARREAEEELGIAGVPFAEHGIFYYEEKTCRTWGGLFSCVSHGPFALQEEEVSAVYWLSPEEITARCDEFTPDSLKALSLWLARNRQRELPE

SEQ ID NO: 21198 - protein, 427 aa, Xenorhabdus nematophilus
LDNSKDFYKKCWELMPGGTHYNFGDPERPLVIPFNRGRNSRVWDLDGNEHLDLFCKFGALLVGHHNEAYNQSLIEYMGKVTSVDTCDLEVGVCETLVKHIPCAEMVRFCLSGTEAVQNALRLARAFTGKNRFIRFHGHYHGNADNIMGWRKKQDLTYPVPEQFNGDLLDTLGRDPKIMVDQTFMLPWNDIDVLTATIERYHNEIGAVLMEPLCINGGGIFPEEGYLEKTKALCEKHNIVLIFDEIITGVRLGLGGAQKILGVTPHLATFGKALGGGSMPISAIVGRSDIMNLYTRGKVIHAGTFNGYPLGLAAIQTTFNLIEQDPGCYDRMGNIMRQISDVFVKAAKAVDLPLVVQGMPTALVYHSQSIPVSSTEGYSDKVKFCDIIIREISKRYGIQFSPLSRMYSNLLMSQDDVRFFEERIFDAM

SEQ ID NO: 21199 - protein, 704 aa, Xenorhabdus nematophilus
DHTNNHALDCVAYLGTQFHKVASVRQLHHALGLDSLTLTDWQLREAIDAVGLHSKFDRLTADTAATLPLPALIELGQCWWVLLEVSPDQFTVLNPITEKQEIRPLHGTQATPDEAKHSEYKILLVADKSLTKQQVKFGLSWFYPSIFRQKNQLRDIFLFAIVLQLFALASPLLFENVIDKVLVGRSLSSLHVLGLAMLALAVAEPLYGFLRNTVFGHMASQINAELSGRLYRHLVGLPLPYFKQRQTGQIIARVREMAQIRQFLTGSTLMLLLDLIFIILFLGVMFHYSTLLTGIVISSLALYFLLWIAIGPLIRRKVETEYEADAHATSFLTESVMGIETIKTTATEKRFLRQWQKVLSQQLIRRFSAQKSGLAAGQGIALIQKIVAALLLWWGVRSVLNGELSPGELIAFNMLAGHVTQPILRLAQVWQDFQHTLIALRRVGDILDEPMESSKQGLAASPELAGQIEFRNIRFRYHADTPEVLANLSLTIKAGEFIGITGPSGSGKSTLTRLLQRLYVPQHGQVLVDGMDLAIADPVSLRRNMSVVLQESILFSGSIADNIRLCKPNASDEEVYRAATLAGATDFINEFPHKFAHSVGEKGSNLSGGQRQRIALARALLNDPKILILDEATSALDYESEAAIMSNLDEIRHNRTVISIAHRLNTIRHADKIFVLDQGTIVESGSHDDLLQQNGLYAQLWHQQ

SEQ ID NO: 21200 - protein, 158 aa, Xenorhabdus nematophilus
ISLIAAMAMDRVIGMENAMPWTLPGDLAWFKRNTLGKSVVMGRVTYESIGRPLPGRLNIVISSQPARDDSVTWVRTIEEALAAAGDVDEIMVMGGGKIYEQFIPLAHRMYLTHIDAEVIGDTHFPDYAPDEWNSVFTEYHDADEHNSHGYCFEILERR

SEQ ID NO: 21201 - protein, 322 aa, Xenorhabdus nematophilus
MANTFALILTLATLITGIIWCIDRFKFAPERRKKLAQIQEQTAGAESQEALATEINKPSWVETFASVFPVLAIVLLLRSFVYEPFQIPSGSMMPTLLIGDFILVEKFAYGLKDPITQTTLIKTGKPKRGDIAVFKYPVNPSLDFVKRVIGLPGDKIVYDDINKELQVFPGCGWNTVCKNLPVTYRDMFPSEWTIKEDITPEGARVRGVYPIPIEEQLGSNSIRQGERVEHLGNVSHHILIVPGASNIPFFSQPGLPLGTWVVPEGHYFMMGDNRDNSSDSRIWGFVPEKNLVGRATAIWISFEKQEGEWPTGVRLSRIGRIH

SEQ ID NO: 21202 - protein, 575 aa, Xenorhabdus nematophilus
MISGILVSPGIAFGKALLLKEDPIIINQKKITTEQTEQEISRFKQGRDKSSVQLEIIRKTAEKNLGAEKAEIFEGHIMLLEDEELEQEIVTLIKKNLATADAAVYSVIEDQAKALEELDDEYLKERAADVRDIGKRLLKNILGMPIIDLGTIEEEAILIANDLTPSETAQLNLDKVLGFITDLGGRTSHTSIMARSLELPAIVGTTNATTQIKNGSYLILDAVNNQIYVNPSNAEIDQLKKAKHEYLSEKTELAKLKDLPAITLDGHQVEVCANIGTVRDVMGAERNGAEGVGLYRTEFLFMDRDTLPTEDEQFEAYKAVAEAVGNQAIIIRTMDIGGDKDLPYMNLPKEENPFLGWRAIRICLDRKEILHSQLRAILRASAFGKLRIMFPMIISVEEIRELKAELALLKNQLRDEDKAFDESIEVGIMVETPAAATIAHHLAKEVDFFSIGTNDLTQYTLAVDRGNELISHLYNPMSPAVLSLIKQVIDASHAEGKWTGMCGELAGDERAALLLLGMGLDEFSMSAISIPRIKKIIRNANYDDAKALAEQALSQPTAKELMDLVDTFTREKTLC

SEQ ID NO: 21203 - protein, 464 aa, Xenorhabdus nematophilus
FAPSPTGYLHVGGARTALYSWLYSRHNKGEFVLRIEDTDLERSTQEAIDAIMDGMNWLNLNWDEGPYYQTKRFDRYNHVIDEMLEQGTAYRCYCSKEHLEQLRETQMANGEKPRYDGCCRDSECQHSHDEPHVVRFRNPQEGSVIFNDSIRGPIEFSNQELDDLIIRRTDGAPTYNFCVVIDDWDMEITHVVRGEDHINNTPRQINILKALGAPVPEYAHVSMILGDDGKKLSKRHGAVSVMQYRDDGYLPEALLNYLVRLGWSHGDQEIFSVEEMVNLFSLDAISKSASAFNTEKLQWLNHHYINTLPAEQVAVHLAWHIEQQGIDTRTGPELVALIKLLGERCKTLKEMAGSCRYFYEEFAEFDADAAKKHLRPVARQPLEVARAKLAAVTEWTPENIHHAIQATADELEVGMGKVGMPLRVAVTGAGQSPSVDVTIHAINQARSLSRIDKALAYITQREVQ

SEQ ID NO: 21204 - protein, 521 aa, Xenorhabdus nematophilus
SGKYLMALDAGTGSIRAVIFDLEGNQVAVGQAEWIHQPVPNVSGSMEFDLKTNWQLACQCIRQALQKAELPASAIQGVAACSMREGIVLYNRSGDPIWACANVDARSGHEVSELKELYDNTFEYDVYRYSGQTLALGAMPRLLWLAHHRADIYRQASTLTMISDWLAYMLSGELAVDPSNAGTTGMLDLVSRNWRPNLLEMAGLRSDILSPVKETGTLLGYITEKAAADCGLNSGTPVIMGGGDVQLGCLGIGVVKPAQTAVLGGTFWQQVVNLPAPITDPNMNIRINPHVIPGMAQAESISFFTGLTMRWFRDAFCAEEKLMAERLGVDAYSLMEDMAARVPAGAYGIMPIFSDVMRFKSWYHAAPSFLNLSIDPEKCNKATLFRALEENAAIVSACNLDLIAGFSGVKPDSLVFAGGGSKGKLWCQILADVTGLPVRVPVVKEATALGCAIAAGVGVSLYDSLPETGEKLVRWEREYQPDLTHWDIYQKAKKNWQAVYADQLHLVDDGLTTSLWKAPGL

SEQ ID NO: 21205 - protein, 172 aa, Xenorhabdus nematophilus
  unsure (1)..(172): unsure at all Xaa locations
FGVNAGRVVNTMISYIDRKSIXMSDNRTLQIEEILDLLPHRYPFLLVDRVLDFEEGKFLRAVKNVSFNEPFFQGHFPGKPIFPGVLILEAMAQATGILAFKSVGSLAPGELYYFAAIDGARFKRPVLPGDQMVLEVEFIKERRGVARFKGVAKVDGEVACEAEMMCARRREA

SEQ ID NO: 21206 - protein, 534 aa, Xenorhabdus nematophilus
FNRWPQDLAALYRLKGYWIDRPLSEILDIHRENDTTALFCGEQSWSYRELNEAVNRLAASLHRRGVRQGQTALVQLGNEAEFYIVFFALLRLGVAPVNALYSHQSSELTAYARQIMPSILIADRQHRQFHDDVLIDLLIDQCPELNIVVLHHANSDSDHSLARLISEEPGDFTPTPTPADEVAFFQLSGGSTGTPKLIPRTHNDYYYSIRASNPICNVSSKTRYLCALPAAHNYPMSSPGALGVFYAGGQVVLVPDPSPDGCFPAIAHHQINLVALVPPAVSIWLEYANLIGHINELSSLEVMLVGGAPLGEALARRIPKELGCQLQQVFGMAEGLVNYTRLDDDDTHTFTTQGRPISEDDEVWVANQEGLPVPLGEPGLLMTRGPYTFRGYYRSPEHNQTVFDSDGFYCSGDVVIQLPGGYLKVVGREKDQINRGGEKIAAEEVEHLLLRHPAVVYAALVAIPDCLMGEKTCAYVVTREHEAVKPAVFRRWLREQGIADYKIPDRFENLPTLPLTPVGKINKQALRTLASAAL

SEQ ID NO: 21207 - protein, 412 aa, Xenorhabdus nematophilus
FTPENLLRLPVDYGTPLWVYDSDIIIRKINRLKRFDIIRFAQKACSNTHILSLMRAQGVKVDAVSLGEIERALYAGYQPGRDRSEIVFTADLIDEITLNRVIELDIPVNVGSIDMLEQIGTRQSGHPIWLRINPGFGHGHSQKTNTGGENSKHGIWFQDLPLAIEKVRQYGLKLVGLHMHIGSGVDYQHLANVCNAMVEQVISCGEDIQAISAGGGLSIPYKTGDEIVDTEHYYSLWHKARQRIERHLGHHVELEIEPGRFLVAESGILMAEVRAVKPMGSRHYVLVDAGFNDLMRPTMYGSYHHISVLSVNSQHIDEAVSQDAELHETLVAGPLCESGDVFTQSAGGDVVPRLLPRVCVGDYLIFHDTGAYGASMSSNYNSRPLIPEILFIEGDARLIRRRQTIEELLALE

SEQ ID NO: 21208 - protein, 273 aa, Xenorhabdus nematophilus
MKNRKITFIGAGNMAHAIIAGLVRTGYPAEFITVCSPNTTRRDVLAKEYGINSENDNIRYAQEADVIVLAVKPQMMEEVCDSLRSQIDFSHKLVLSIAAGIPVARFYTLLQDNLNIIRIMPNTPALVGQGISGLFAPEYVTQPDRQFTESLMCGVGKVCWVNDENGINNIIAVAGSAPAYFFLFMESMQQEAERLGFDSQTARELVLQAATGSAKLAESQADLPFAILREQVTSKGGTTAEALRIFYEGHLPEIVSSAMQAAIRRAQEMEKLF

SEQ ID NO: 21209 - protein, 436 aa, Xenorhabdus nematophilus
MSSLNKLVNKFNNKSANIAIVGLGYVGLPLMLRYNDIGFKVIGFDIDKDKTEKLSRGLSYIEHISSSRIQKAIETGFEATTDFSRISECDAIILCVPTPLNKYREPDMSFVINTTDMVKPFLRKGQVLSLESTTYPGTTEEELLPRAEESGLRVGEDIFLVYSPEREDPGNPDFETRTIPKVIGGHTENCLNAGIAVYQPAIDKVVPVSSTKAAEMTKLLENIHRAVNIGLVNEMKLVADKMGIDIHEVIRAAATKPFGFVPYYPGPGLGGHCIPIDPFYLTWKAREYGVNTRFIELSGEVNSSMPDYVVTKTVLALNKVNKSINGSNVLVLGISYKKNVDDMRESPSVHIMEKLRDLGAFVEYSDPHVPAFPKMREHQFDLISQSITSNNLKEFDCIILATDHDKFDYDLIINNAKLIVDTRGKYSPNHNNVIKA

SEQ ID NO: 21210 - protein, 321 aa, Xenorhabdus nematophilus
IKRIGVLTSGGDAPGMNAAIRGVVRVALTEGLEVYGIYDGYLGLYENRMKKLDRFSVSDMINRGGTFLGSARFPEFRDDKVREIAIENMRKNDIDALVVIGGDGSYLGAKKLTEAGFPCIGLPGTIDNDVAGTDYTIGYFTALETVVEAIDRLRDTSTSHKRISIVEVMGRYCGDLTLSAAIAGGCEFIVLPENEIPFDREELLAEIKAGIQKGKRHAIVAITEHVCNVDELAKYIEAETRHETRATVLGHIQRGGAPVAYDRILASRMGAYSVQLLMEGFGGRCVGIQNEKLVHHDIIDAVQNMQRVFKKDWLETAKQLY

SEQ ID NO: 21211 - protein, 548 aa, Xenorhabdus nematophilus
MKNINPSQTEAWKALHQHFEQLKNVHLRDLFEQDKARFTAFSATFDEQILVDYSKNRITAETLTKLQTLAKETDLSGAIRSMFSGEKINCTEDRAVLHIALRNRSNTPINVDGEDVMPQVNAVLAKMKSFSERIISGEWKGYTGQAITDVVNIGIGGSDLGPYMVSEALKAYKNHLNMHFVSNVDGTHIAETLQTLNPETTLFLIASKTFTTQETMTNAYSARNWFLQNAEIEAHVAKHFAALSTNEQEVSKFGIDPLNMFEFWDWVGGRYSLWSAIGLSIALSIGYENFEQLLSGAHAMDKHFEQTSPDQNIPILLALIGIWYNNFFGAETEAILPYDQYMHRFAAYFQQGNMESNGKCIDRNGSPVDYQTGPIIWGEPGTNGQHAFYQLIHQGTKLIPCDFIAPAISHNPLSDHHSKLLSNFFAQTEALAFGKNREQVEAEFVAAGKNAQDVANVVPFKVFEGNRPTNSILLREITPFSLGALIAMYEHKIFAQGAILNIFSFDQWGVELGKQLANRILPELHDDEAINSHDSSTNGLINRFKTWR

SEQ ID NO: 21212 - protein, 447 aa, Xenorhabdus nematophilus
QYVVAKFGGTSVADFDAMNHCADIILANADVRVVVLSASAGVTNLLVALATGCDNDKRKKCLKQIRDIQYAIIDRLNDVNVICEEIDRLLENIEMLSEAASLATSEALTDELVSHGEVMSTLLFVELLRQRNVNAEWFDIRRVMRTNDHFGRAEPDSLQLHISAVELLQPRLNNTVVITQGFIGREEKGRTTTLGRGGSDYTAALLGEALNLQRVDIWTDVPGIYTTDPRVAPTAKRIDKIAFDEAAEMATFGAKILHPATLLPAIRCGIPVFVGSSKDPQAGGTLVCDKTENPPLFRALALRRKQTLLTLHSLKMLHARGFLAEVFTLLLRHNISVDLITTSEVSVALTLDTTGSTSTNGSLLTNALLTELSTLCRVEVEEDLALVAIIGNELSQAKGLGKEIFGTLESFNIRMISYGASSHNVCLLVPGQDAESVIQKLHQNLFK

SEQ ID NO: 21213 - protein, 432 aa, Xenorhabdus nematophilus
MGKNVVVLGTQWGDEGKGKIVDLLTERAKYVVRYQGGHNAGHTLVINGEKTVLHLIPSGILRENVISIIANGVVLAPDALMKEMNALESRGIPVRERLLISEACPLILPYHVALDNAREKARGAKAIGTTGRGIGPAYEDKVARRGLRVGDLFDKETFAVKLQEIIEYHNFQLVNYYNEPAVDYQKTLDDILAVADILTNMVVDVSDLLYKATQKGELVMFEGAQGTLLDIDHGTYPYVTSSNTTAGGVATGSGLGPRYVDYVLGIIKAYSTRVGAGPFPTELFDETGEYLRQKGQEFGATTGRSRRTGWLDIVAIRRAIQINSLSGFCMTKLDVLDGLKEVKVCIGYRMPDGSVIDTTPLAAENWEGLEAVYETLPGWDESTFGVKDHSLLPEAALSYIKRVEELTGVPVDIISTGPDRAETMILRDPFDA

SEQ ID NO: 21214 - protein, 452 aa, Xenorhabdus nematophilus
LTLDTNQTSASDRVQLRRTLTLFQVVMMGLAYMQPMTIFDTFGIVSGLTSGHVATSYALALIAILFTALSYGKLVKRFPSAGSAYTYVQKSINPHLGFMVGWSSLLDYLLMPMINILLAKIYLQALFPGIDPWIFVVTLTILMTIFNLSGINVVANLNGVIVIVQVAVMLVLVGFLVHGVYNGEGVGTLLSIQPFTSDEAKLIPMITGATILCFSFLGFDGISSLSEETPNAGKVIPKAIFMTALIGGAIFIAVSYFLQLYFPDISRFKNPDASQPEIMLYVAGALFQYIILMFSCVTVVASGMAAHAGVSRLLYVMGRDGVLPEKVFAYIHPKWRTPSINVILVGIVALSAGWLDLVTATALINFGALVAFTFVNLSVISQFYIREQRNSTLKDTIHFLILPVLGAATVGVLWMNLESSSMKLGLIWGGIGMIYMFFLTRSFRQPMPQFTE

SEQ ID NO: 21215 - protein, 471 aa, Xenorhabdus nematophilus
LRRELKARHMAMIAIGGSIGTGLFVASGATISQAGPGGALLSYALIGLMVYFLMTSLGELAAYMPVSGSFSTYGSKYVDEGFGFALGWNYWYNWAVTIAVDLVAAQLVMGYWFNDVPGWVWSALFLGIIFLLNFISVKGFGEAEYWFSLIKVSTIIVFIIVGILMIIGIMKGAESAGWQNWQVGDAPFAGGFAAMIGVAMIVGFSFQGTELIGITAGESKDPAKNIPRAVRKVFWRILLFYVFAILIISLIIPYTDPNLLRNGVKDISVSPFTLVFENAGLLSAAAMMNAVILTAVLSAGNSGMYASTRMLFTLAREGKAPKIFGHLSKGGVPRNALYATTVVAGLCFFSSMFGNQTVYLWLLNTSGMTGFIAWLGIAISHYRFRKGYIAQGRDLNELPYRSGFFPVGPIFAFVLCLMITLGQNYQAFLQDNIDWYGVTATYIGIPVFLIIWFSYKLKKKTRFVKCSEMEF

SEQ ID NO: 21216 - protein, 421 aa, Xenorhabdus nematophilus
SKRLQGTLNLPASKSSSTRALLTSSITSGKSIIRNIATGFNTIAMKSNCERLGAVFKEDKGNLIVNGIDVSSINQPLEFNPGNSGVVLRLLMGVAGFLPETKFITDYHASLGFRSQTEMVNALCMLNVQCRALGEEHRLPIRIKSDRKLNDYTEVSCRKSSQFLSGLLYLGAVMDNDLTIKVVDKITAPSMVHTTINNLKKAGIRIEYDSDFREFFVHGRCRLQASDFTVGSDPASTAAILALCGSLESEVQLNGFFEEELGNGAVIQYLIDTGTNIEFIGNETIIIRGSTEIRPLDFDGSLAPDAVPALAARASLASGTSIFYNIEHIRYKESDRISDFRKELSKLGVKSDEKHDQLIIHGNPKGYKGRVVLDGHYDHGLIMGLTTIGLHCSEPVIIKEPFHVGQTYPEYFSEIRSLGAK

SEQ ID NO: 21217 - protein, 422 aa, Xenorhabdus nematophilus
LTGEVFIPSSKPHIQRALLLALLNENTTKIVNISWNVETENQINALKKFGLEILHKDGTTLLLRGVGRNLSYNGEIYAGGSGMLFRMCAALASLIDNEKIVIKCNESLFNRESVFDEDFCNYLDIHIERIENEKIIITKSETNIKKPLTVLNSTQFITFALFVTPFSKQNIVPIVMDGSKMGYIDMTIKSMSLLGSMVTYEQKHFKVTKYIPKDIEIKIPSDFTSLSYIASSILSSKGVSDVLIRNYYFNDTINERDLFKFYQSIGLIIKYDSNWNNLRIFRQSIRLWDGEFSLKELPSVAVNIIAASSNLKGKKIFSGVRGINNHKSQRAFIVNENIRTMGGSSVLIFDRVGMFESIYIEGKGPLNGGVELKSYGDHRICAANLIASLGAEKESIIYDIDKLNDGFPDYIDTLRNLGVHIK

SEQ ID NO: 21218 - protein, 846 aa, Xenorhabdus nematophilus
SLENATTFCKLRSNPYVELVHWLHQLMQQQDCDLQSVIRYFALDEAKLAKDIITALDRLPRGASAISDLSEHIDSAVERAWVYGSLKFGVDKIRTAHWLIGMLKTFNLYNTLKAISRQFEQVNADTLIDNFNAICGNSSEEPENEPPSHHSQPTKPQSSDSALRQYGQNLTDLARHGDIDPVSGRDEEIRQIVDILMRRRQNNPLLTGEAGVGKTAIIEGLALRIAANEVPPPLQNVQLWLLDIGMLQAGAGIKGEFESRLRRVIDEVQSSPLPIILFIDEIHTLIGAGGQQGTGDAANLLKPVLARGQLRTLGATTWSEYKKYIEKDPALTRRFQVVQIHEPDEAKALLMLRSLVWTLEKHHRVLLLDEAVEAAIRLSHRYIPARQLPDKAVALLDTACARVAISQNAEPPQLENCRHKIDALKIELEIVEREAKMGIGDQQRSNTILNALSLLEEQLIQLENRWQQELSLINRIIHLQTQLYAPSFHQQQHNDPNALHEELIALQQQLKTLQGEIPLIFASVDSNVVSAVVSDWTGVPLGRMVKDEINAVLHLVDTLNQRIIGQYHALELIAKRVRTSRAKLDDPNKPVGVFMLCGPSGVGKTETALALAETLYGGEQNLITINMSEFQEAHTVSTLKGAPPGYVGYGEGGVLTEAVRRRPYSVVLLDEIEKAHSDVHEIFFQVFDKGWMEDGEGRHIDFRNTIIILTSNIGADLVSSLCLQQAPLPDPEKLSTALRKPLLHVFPAALLGRLIVIPYYPLSDNVMTSIVHLQLARIKKRLLENHDIVATFDEPMIKYIVGRCTEIESGGRMVDAILTNSLLPQISQLLLSANANGQQYHQLQVS

SEQ ID NO: 21219 - protein, 477 aa, Xenorhabdus nematophilus
LLRQQAYINGQWVDAHNKTTFAVINPANGEVIANVSDMGCAETQQAIEAAQTALPAWRALTAKQRSQKLKQWFHLIMDNQKSLAELLSAEQGKPHAEAMGEIAYGASFIEWFAEEGKRIYGETIPSPMPGRRLATIKQPIGVVAAITPWNFPNAMITRKVGPALAAGCTVVLKPAAETPLSALALAVLAEQAGIPAGVLNIVTGIDAKAIGETLTSSPIVRKLSFTGSTRVGKLLMAQSADTVKKLSLELGGNAPFIVFDDADLDAAVEGAMATKFRNSGQTCVSANRILVQEGVYDAFAERLVHAVKQLRVGPTHSDSSQPVPQQGPLINQAAVEKIQAHISDAVSHGARILAGGKSHTLGGLFFEPTVLADVDDSMRVSHEETFGPLAPLIKFRDEAEAIRLANDTEFGLAAYFYSRDIGRIYRVAEALESGMVGINEGLISNEVVPFGGIKQSGLGREGSRYGIEDYLEVKYLC

SEQ ID NO: 21220 - protein, 449 aa, Xenorhabdus nematophilus
MSSPPEAIQEPENPAYPPQKLTDRQQNVINKLFRRLILFLFVLFVFSFLDRINIGFAGLTMGKDLGLSSTMFGLAATLFYATYVIFGIPSNVMLSVVGARRWIATIMVLWGIASTATMFATGPTSLYILRMLVGIAEAGFLPGILVYLTYWFPAYYRARANALFMIAMPVTMAFGSLASGYILEMDGIWDLRGWQWLFLLEGFPSVLLGFVVWFYLDDSPEKAKWLTREDKQCLQEMMERDKLSQVQSSRPASSKTSLWREVFTPIVLMYTFAYFCLTNTLSAINIWTPQIMQSFNQGSSHVMIGLLTAIPQFCTILGMIYWSRRSDRLQERKMHTALPYLFAAAGWVLTSLTDHSMVQLLGIIMASTGSFTAMAVFWTTPDQSISLRARAIGIAVINATGNVGSAVSPLLIGWLKDQTGSFNSGLYFVAGLLIIGALMVSFIPMKQTQ

SEQ ID NO: 21221 - protein, 129 aa, Xenorhabdus nematophilus
MSHVPAELKYTSSHEWVRAEGNGEYTVGITEHAQELLGDMVFVDLPEVGVVVNNGNDCAVVESVKAASDIYAPLSGEVTAVNSELEGSPELVNSEPYNEGWLFRLKISDESELTHLLDAEGYQSLLAEE

SEQ ID NO: 21222 - protein, 437 aa, Xenorhabdus nematophilus
MTKQEYLSRRQALLSKMAPASAAIIFAAPPARRNSDCEYPYRQHSDLLYLTGFNEPKAVLVLIKSDENHNHSVLFNRVRDLTAEIWFGRRLGQDAAPEKLGVDRALPFDDLSKQLYLLLNGLDVVYHAQGEFEYADNIVFSALDTLRKNSRRNLSAPSMIADWRPWLHEMRLFKSAAELDIMRKAGDISAKAHTRAMQNCRPGMFEYQLEAEIHHEFTRQGARYPAYNTIVGAGENACILHYTENERRMKEGDLVLIDAGCEYEGYAGDITRTFPVNGKFTRPQREIYDIVLQSINVSFELYRPGTSIRKVTEHVVRIMVEGLVKLGIMHGEVEQLIETNAYRQFFMHGLSHWLGLDVHDVGHYGIDRDRILEPGMVLTVEPGLYIAPDADVPPEYRGIGIRIEDDIVITEAGNENLTEHVVKDPDEIEALMAQAKQ

SEQ ID NO: 21223 - protein, 795 aa, Xenorhabdus nematophilus
  unsure (1)..(795): unsure at all Xaa locations
SXKLAKAKRRESSMNPERSERIEIPVLPLRDVVVYPHMVIPLFVGREKSIHCLEAAMDHDKQVMLVAQKEASTDEPGVNDLFSVGTVASVLQMLKLPDGTVKVLVEGLQRARITTLTDNSEYFYAQVEYLESPVVDEREQEVLVRTAINQFEGYVKLNKKIPPEVLTSLHSIEDLAKLADTIAAHMPLKINDKQTVLEMSDVVERIEYLIAMMESEIDLLQVEKRIRNRVKKQMEKSQREYYLNEQMKAIQKELGEMDDAPDEYETLRRKIEDAKMPKEAREKVEAELQKLKMMSPMSAEATVVRSYIDWMVQVPWVARSKVKKDLVKAQEVLDIDHYGLERVKERILEYLAVQSRVSKIKGPILCLVGPPGVGKTSLGRSIARATGRKYVRMALGGVRDEAEIRGHRRTYIGSMPGKLVQKMSKIGVKNPLFLLDEIDKMSSDMRGDPASALLEVLDPEQNVTFNDHYLEVDYDLSDVMFVATSNSMNIPAPLLDRMEVIRLSGYTEDEKLNIAKRHLLPKQIERNALKKGELAIDDGAILGIIRYYTREAGVRNLEREISKLCRKAVKALLMDKKLKHIEINADNLKNYLGVQRVDYGRADTENRVGQVTGLAWTEVGGELLTIETASVPGKGKLTYTVSLGEVMQESIQAALTVVRARADKLGISSDFHEKRDIHVPVPEGATPKRWPSAGIAMCTALVSCLTGNPVRADVAMTGEITLRGLVLPIGGLKEKLLAAHRGGIKTVLIPDENKRDLEEIPQNIIQDLEIHPVKRIEDVLSIALQSPAFGAEAVS

SEQ ID NO: 21224 - protein, 1105 aa, Xenorhabdus nematophilus
  unsure (1)..(1105): unsure at all Xaa locations
SQLLMWLGIMLFIALAIYGLRYVWRVWLFGASYRLAVKLRSDFYQKLSSQNPEFYLRHRTGDLMARATNDVDRVVFAAGEGVLTLVDSLVMGCAVLIVMSIEISWQLTLLSLLPMPIMALVIKRYGEQLHHRFKSAQGAFSALNNHAQESLTSIRMIKAFGLEDLQSSQFEEVATDAGRKNIHVARVDARFDPTIFIAIGVANLLAIGGGSWMVVHGSMTLGELTSFVMYLGLMIWPMLALAWMFNIVERGSAAYTRIRSLLQEPLVIDDGSQSLLVERGTLQANINTFIYPANDRPILHDVRFQLSPGQLLGVCGPTGAGKSTLLALLQRQFDVTDGEILFQSRHVSTLRLEEWRSRLAIVNQTPFLFSDTVAGNIALGRPDATQEQIEEVARLANVHDDILRLPQGYQTEVGERGVMLSGGQKQRISIARALLLDTEILILDDALSAVDGQTEHQIMKNLSQWRRQRTVIISAHRLSALTEADNILVIQHGTVAQQGPHKQLIAQSGWYSDMYHYQQLEAELMVNMTNHDMRKPSVRKLWPSLKRLLSYSKNYRKPILLAVLMSWVAALTEVSGPLLVSYFIDNMVATGNLPLDVVSGLAVTFLVLQFVAAALHYFQFLLFNQASVGIVQKLRTDVMNSALRQPLSTFDSQPVGQLISRVTNDTEAIKDLFVNVIPTVFRCISLIGAMLIAMFILDWRMACVALTIFPAVLLVMIIYQHFSTPIIRRVRSYLADINDGFNETINGMTVIQQFRQQARFGEKMLATNREHYQSRMQALRLDGICXGRYXVCFLLPYCVACYCYLVSKERKXLVWVFYTHSSIILGAXMNPLIELTAQQSLLQQAVVSGERVFELMDSPQQQYGTDQQALMSGRIDIENLTFAYRNDKVVLSDINLHVPTHGFVALVGHTGSGKSTLTNLIMGYYPWQDGEIYLDGRPVSSLSHAVLRNGVAMVQQDPVVLAASFFDNITLGRDISEDKIWQVLEMVQLADFVRRLPDGLNSVLGEQGNTLSAGQKQLLAMARVLVQTPQILILDEATANIDSGTEQSVQQALRMIRKQTTLVVIAHRLSTIVEADSILVLHRGAIVEQGQHQQLLAKRGRYYQM

SEQ ID NO: 21225 - protein, 185 aa, Xenorhabdus nematophilus
SIMTANAQKLQFIKDSIETIPDYPKVGVLFRDITTLLDNPVAYQATIDLLVIHYQEKGITKIVGTEARGFLFGAPVALRLGVGFIPVRKKGKLPRATLSETYDLEYGTDTLEIHKNSIKEGDKVLVVDDLLATGGTIEATVSLIRRLGGEVSEAAFIIGLPDLGGTERLKKQGIESYTLIEFPGH

SEQ ID NO: 21226 - protein, 622 aa, Xenorhabdus nematophilus
MKGQETRGFQSEVKQLLQLMIHSLYSNKEIFLRELISNASDAADKLRFRALSKPELYENDGELRVRLAFDNEHKTITISDNGIGMSRDEVIDNLGTIAKSGTKSFLESVGSDQVKDSQLIGQFGVGFYSAFIVADKVTVRTRAAGTAADQGVFWESTGEGDYTIADLEKTERGTEITLHLREGEDEFLNDWRLRSIIGKYSDHIALPVEIETKNEEDDTVTWEKINKAQALWTRGKAEISDEEYQEFYKHISHDFTDPLSWSHNRVEGKQEYTSLLYIPAQAPWDMWNREHKHGLKLYVQRVFIMDDAEQFMPNYLRFMRGLIDSNDLPLNVSREILQDSTITRNLRNALTKRVLQMLDKLAKDDAEKYQTFWQQFGLVLKEGPAEDGSNKEAIAKLLRFATTHHDGSAQTVSLEDYLSRMTEGQEKIYYITADSYAAAKNSPHLELFRKKGIEVLLLSDRIDEWMMSYLTEFDGKSFQSVSKTDESLDKLADENKAEQEEEDKKLEPFIERVKTLLGDRVKEVKLTHRLTDTPAIVTTNANEMSTQMAKLFAAAGQSAPEVSYNFELNPEHNLVKKAADIPDEAQFADWIELLLDQALFAERGTLDDPNQFIRRMNQLLLA

SEQ ID NO: 21227 - protein, 306 aa, Xenorhabdus nematophilus
MSSNKYGVLLVNLGTPDEPTPVAIRRYLAKFLSDRRVVDIPSFIWKPLLYGIILPFRSSRVAKLYQEIWTDEGSPLLVYSQRQQKLLNERLTDIPVVLGMSYGFPSLPQAVGNLLQQGIDHLIVLPLYPQYSSTTSAAVFDSISKILKGYRTIPHLYFIRSYATHPAYIAALKETIEKSFEKHGLPDRLLLSYHGIPERLATIGDIYPQDCRATTELLIQALDYPADKIMMTFQSRFGRLPWLTPYTDKTMALLPEQGVEHVQVLCPGFSSDCLETLEEIQQQNQAIFRHAGGKKFEYISALNDNE

SEQ ID NO: 21228 - protein, 246 aa, Xenorhabdus nematophilus
MSILITRPDPAGEQLAKRLRAMGKIAFSAPLITIYPGGDLPLLSQKLQRLSAGDLVFLLSKNAVHYANEQLLQEGLSWPDKLSYYGIGKSTSLMFHQKTGLEILWPEQGETSEDLLQLPILQRVNDKKILLLRGNGGREVIASTLINRGGKVDYCECYSRQPIKYHVADFSRHWQQYGIKTLVVTSGEMLQLLYNLATDDDGKAWLLSCYLIVVSERLANIAQTLGWQTIKVAKSADNDALMQALE

SEQ ID NO: 21229 - protein, 310 aa, Xenorhabdus nematophilus
MTMKIIRIATRQSPLAMWQAQYVQKQLEQFHPELKVELIPMVTRGDVILDTPLAKVGGKGLFVKELELALLENRADIAVHSMKDVPVEFPDGLGLVTICERGDPRDAFVSVKYTSLDELPIGSIVGTSSLRRQCQLRQLRPDLVVRDLRGNVGTRLGKLDNGDYDAIILAAAGLKRLGLEDRIRMPLEPELLLPAVGQGAVGIECRLDDKQTRELLAPLNHTGTEICVLAERAMNTHLEGGCQVPIGSYAIWQGNNIWLRALVGAPDGSITVRGEKTVSPEEARRAGVELAEELLEKGARQILADVYQRN

SEQ ID NO: 21230 - protein, 274 aa, Xenorhabdus nematophilus
MQFSKMHGLGNDFMVVDAVTQNVYFSPELICRLADRRTGVGFDQLLIVEAPYDPDLDFHYRIFNADGSEVSQCGNGARCFARFVRLKGLTNKRDIKVSTQTGRMVLSITNDDQVCVNMGEPDFEPQHVPFRAIKAEKTYIIRAIERTVLCGVVSMGNPHCVIQVEDVDTAEVEILGPVLENHDRFPERANIGFMQIMNRSHIRLRVFERGAGETRACGSGACAAVAVGIQQDLLNSQVRVDLPGGFLQICWDGPGKPLYMIGPATHVYEGTIHL

SEQ ID NO: 21231 - protein, 719 aa, Xenorhabdus nematophilus
MDVSYLLESLNDKQREAVTASRTNMLVLAGAGSGKTRVLVHRIAWLLSVENASPFSIMAVTFTNKSAAEMRHRIENLIGTSQGGMWIGTFHSLAHRLLRFHHLDANLPQDFQILDSEDQHRLIKRIIKAMNLDDKQWPARQGMWYINGKKDEGLRPQHIEIYGNPVETTWMKIYQAYQEACDRAGLVDFAELLLRAHELWLNKPQILQHYRERFTNLMVDEFQDTNSIQYAWIRLLAGDSGKVMIVGDDDQSIYGWRGAQVENIQRFLRDFPAAETIRLEQNYRSTSNILKAANALIANNNDRLGKSLWTEGGEGEPIALYCAFNELDESRYVVSRIKHWLDNGGALKECAILYRSNAQSRVLEEALLQVSMPYRIYGGQRFFERQEIKDALSYLRLVSNRYDDSAFERVVNTPTRGIGDRTLDVVRQVARDQQKTLWESCLLLLQQKVLAGRAASALQRFIELIDALETETQEMPLHVQTDRIIRDSGLWAMYQQEKGEKAQARIENLEELVTATRQFSFKDEDEDLMPLQAFLSHAALEAGEGQADVYQDAVQLMTLHSAKGLEFPQVFIVGMEEGMFPSQMSLDEGGRLEEERRLAYVGVTRAMQKLTLTYAETRRLYGKAVYHRPSRFVGELPTECVAEVRLRATVSRPVSHKQLGTPISAGDSGYALGQRVHHPKFGEGTIINIEGSGEHCRLQIAFQGEGIKWLVAAYARLET

SEQ ID NO: 21232 - protein, 330 aa, Xenorhabdus nematophilus
KASWLNREPQFSAFTNGLLLDFWKTRDEREFMGVDDIPIRYVSFRSLHHDKTLLILPGRSESYVKYPEIAYDFYHLGYDIFIIDHRGQGRSGRMLDDPQKGHVEKFDHYVDDLAKFVELEITPRQSHGYYALAHSMGAAILSRFLLRQELVRQEPDFRAVALCAPMFGINLPMPRWLANFLVNQAEPYPKRRNSYAVSTGQWRPLPYLINLLTHSYARYQRYLRYYADYPELRLGGPTYHWMRESMQMGDELIENAGVIQTPLIVLKASEDKIVNNRELLAFCESRQKAGTGKAGRKPLVIQGAHHEILFEKDALRAQALNAICDFFDQH

SEQ ID NO: 21233 - protein, 286 aa, Xenorhabdus nematophilus
VLDNIKIKLQYLLPKQCITNLAGWFANKKAGWLTQFAIQSFAKVYKVDMNEAENSSFTAYSTFNEFFVRPLKEGIRPIVNEAHQLALPADGTISQLGMIRDDQIIQAKGHYYTVEALLAGQHQLAEQFRNGHFVTTYLSPKDYHRVHMPCDGVLQEMIYVPGELFSVNPLTAANVPNLFARNERVICLFDTAFGPMVQILVGATIVGSIETVWSGCVTPPREGIIKRWAYPAAGQEGAISLKKGEEMGRFKLGSTVINLFAPNQIQFANNLYSGSQTLMGDLLAQS

SEQ ID NO: 21234 - protein, 417 aa, Xenorhabdus nematophilus
MDKFRVKGPTCLSGEVTISGAKNAALPILFAALLAEEPVELQNVPELKDIDTTIKLLNRLGTKVKRNGSVFVDASNVNEYCAPYELVKTMRASIWALGPLVARFGQGQVSLPGGCAIGARPVDLHISGLEQLGAKIVLSEGYVKASVDGRLKGASIVMDKVSVGATVTIMTAATLAEGTTIIENAAREPEIEDTADFLNTLGAKITGAGTDRIVIEGVERLGGGVYRVLPDRIETGTFLVAGAISRGKVICRNTKPNTLDAVLSKLREAGADIQVGDDWISLDMHGKRPKAVTFRTAPHPGFPTDMQAQFSLLNMVAEGVGMITETIFENRFMHIPELIRMGARAEIESNTVVCHGVENLSGAQVMATDLRASASLVLAGCIAEGTTVVDRIYHIDRGYEHIEDKLRGLGANIERIK

SEQ ID NO: 21235 - protein, 317 aa, Xenorhabdus nematophilus
MFLTIALFITGLILLVYGSDRLVYGAAVFARSLKIPPYIVGLTVMGIGTSLPELMVSITAAQDGLPNIAVGNAIGSNITNLLLITGAASLIRPITVKSDILRRELPLMLLITAFVGYILADSYLNRLDGIVLLLTALFFIVIMIKMTTVSQDDGLDSYMQERDAELPVEGNKGIALLWVVLGLIILPISTRMVIDNAAVIARIYSISELIIGLTILAVGTSLPELATSIAAAIKGENDMAMGNIIGSNVFNITLVLGIPGILSPGVISPQAFSRDFWVMMAASVLFTIFCLGRKHRLNRLNGILLLGCFIAYFFVLF

SEQ ID NO: 21236 - protein, 199 aa, Xenorhabdus nematophilus
VLVTRQAPDFTAAAVLGNGEIVDNFNLKNHLNGRPAIIFFWPMDFTFVCPSELIAFDHRYEEFKKRGVEVIGISFDSEFVHNAWRKTPISEGGIGEVKYPMVADIKRDIMKSYGIEHPEAGVALRGSFLIDKNGVVRHQVVNDLPLGRNIDEMLRMVDALQFHEEHGEVCPAQWAKGQEGMGASPEGVAKYLTKNADKL

SEQ ID NO: 21237 - protein, 381 aa, Xenorhabdus nematophilus
MIKHNAMVMAIPVLLIAGTVNAAEIYNKDGNKIDLYGKADVQHYFAKSGNKKDGDNSVARLGIKGETQITDQLTGFGRWEYNMGASGSETEGAKNNRTRLAFAGLKFGKYGSLDYGRNYGVVYDTNAWTDELPFFGGDSIAATDNFWMGRSTGLLTYRNTDFFGLVDGLKFALQYQTKNDSNTINGRDDILRQNGDGFGLSSSYDFGNGISVAASYGNSNRTSAQKNGTDKTKVVAKGNNTEAWLMSVKYDKNNVYLAAMYGEGRNLTRFGKLDNYVLFANKTQNIELTAQYQFDFGLRPSIGYVYSKGKDLGGDSETNVLAAKSSEDLVNYVSVGAYYNFNKNMGTYAEYKINLMKDNDFTKKVNINTDNVLGVGLVYRF

SEQ ID NO: 21238 - protein, 416 aa, Xenorhabdus nematophilus
MLEQMGKAAKAASWQLAQLSTSQKNQALSHIADLLEKETEVILAANQQDMEQAREQNMSEALLDRLLLTPGRLSAIANDVRQVCRLADPVGQILDGQSLDNGLQLSRRRVPLGVIGVIYEARPNVTIDVASLCLKTGNAVILRGGKETHHTNQVMVKVIQQALEQSGLPATAVQAIGKPDRELVAELLKMNSYVDMLIPRGGAGLHKLCREQSTIPVITGGIGVCHTFVDESVDVEKALDVITNAKVQRPSACNSLETLLIHEQIASDFLPALSARMKEQGVTLHAGVSAMALLKEGPAKVVEVIEEDYCDEWLSLDMNVEIVSGIDQAISHIRTYGTAHSDAILTESLQQADYFVSHVDSSAVYVNASTRFTDGGQFGLGAEVAVSTQKLHSRGPMGLDALTTYKWIGYGDYLSR

SEQ ID NO: 21239 - protein, 160 aa, Xenorhabdus nematophilus
MKQTLFIVGARGAGKTTIGKLLAEALSYTFIDTDESIQAFCGMTIADLVEQYGWTHFRELESQILKNASQNKCVISTGGGMILSSENRQYMQQNGIVVYLQAPAEVLIKRLSLNPENTQRPSLTGKSITEEIESILTEREQLYRECANFIVDANSSTENI

SEQ ID NO: 21240 - protein, 327 aa, Xenorhabdus nematophilus
MANGKVLRQLIKAGATGDVATFRRVSEVIIEEERQKQHHLLANDLEHILYGDHTIQTSRVPAAPQMPVDKERGLPLLDIKQPSRSLNEIVLPESSSDAIEEILEENRRADVLRSYGMKAVSKVIFFGPPGCGKTLAAEVVACELDMPLAIVRLDTLVSSYLGETAANLRQIFDFISQYPMVVLFDEFDAIGKERGDSGDHGELRRVVNAVLQMMDAYQGKSLILAATNHEHILDSAIWRRFDDAIEFPLPDKHQLLELMKLKLRGIRRQFELEDDAVLSLFIGKSGADLERIVRRAIKRMILRSQEFLTLKDLKNALLRENVNKTRQ

SEQ ID NO: 21241 - protein, 367 aa, Xenorhabdus nematophilus
MKNVGFIGWRGMVGSVLVQRMLEERDFDEINPVFFTTSQHGLSAPEFAGKSGVLQDAFDIGALSALDIIISCQGGDYTNEIYPKLKATGWQGYWIDAASSLRMSDDATIILDPINHQHIQNSLNKGIKTFAGGNCTVSLMLMSLGGLFANDLIEWASVSSYQAASGSGARHMRELLVQMGMLHNQVADELQDPASAILDIEKRVTDFTRSGALPTDQFGVPLAGSLIPWIDKQLENGQSREEWKGQAETNKILNTGSNVIPIDGLCVRIGALRCHSQAFTLKLKKDIPIHEIETLLASHNDWVRVIPNDRELTMRELTPAAVTGTLNTPVGRLRKLNMGPEYLSAFTVGDQLLWGAAEPLRRMLRIL

SEQ ID NO: 21242 - protein, 609 aa, Xenorhabdus nematophilus
MCGIVGAVAQRDIAEILIEGLRRLEYRGYDSAGLAVVDSENGMTRLREVGKVQMLADEAGKQPVTGGTGIAHTRWATHGEPNELNAHPHVSEHIAVVHNGIIENYEELRELLKERGYTFFSDTDTETIAHLVHWEQKQGGSLLEVVQRVIPQLRGAYGTVIMDSRHPDVLVAARSGSPLVIGLGVGENFLASDQLALLPVTRRFIYLEEGDIVEITRRTVRIFDVTGAAVEREQIESNVQYDAGDKGIYRHYMQKEIYEQPMAIKSTLEGRLSHGQVDLSELGANAEELLSQVEHIQIVACGTSYNAGMVSRYWFESLAGIPCDVEIASEFRYRKPARRKGSLLITLSQSGETADTLAALRLSKELGYLTSLVICNVAGSSLVRESDFALMTKAGAEIGVASTKAFTTQLTVLLMLVAYMGRLKGADAALEQDVVHALQALPSRIESMLSKDKVIEALAEDFSEKHHALFLGRGDQYPIAVEGALKLKEISYIHAEAYAAGELKHGPLALIDADMPVIIVAPNNELLEKLKSNIEEVRARGGQLYVFADQDAGFTNSENMKIISLPHVEDLIAPIFYTVPLQLLSYHVALIKGTDVDQPRNLAKSVTVE

SEQ ID NO: 21243 - protein, 460 aa, Xenorhabdus nematophilus
MATGKIIQVIGAVVDVEFPQDSVPKVYNALEVKNSEEKLVLEVQQQLGGGIVRCIAMGTSDGLRRGLDAIDLGHPIEVPVGKATLGRIMNVLGDPIDMKGEIGEEERWSIHRTAPSYEELSSSQELLETGIKVMDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVARGVQSILQRYQELKDIIAILGMDELSEEDKLVVARARKIQRFLSQPFFVAEVFTGSPGKFVSLKETIRGFKGILEGDYDHLPEQAFYMVGTIDEAVEKAKKM

SEQ ID NO: 21244 - protein, 287 aa, Xenorhabdus nematophilus
MAGAKEIRTKIASVQNTQKITKAMEMVAASKMRKTQDRMAASRPYAETIRSVIGHLALGNLEYRHPYLDEREVKRVGYLVVSTDRGLCGGLNINLFKKLLIEMKDWSDKGVQVDLALVGSKAVSFFSSVGGNIVAQVTGMGDNPSLSELIGPVNVMMQAYDAGRLDKLYIVTNRFINTMSQVPTITQLLPLPAGDDETLKKKSWDYLYEPDPKALLDTLLRRYIESQVYQGVVENLASEQAARMVAMKAATDNGGNLIKELQLVYNKARQASITQELTEIVSGASAV

SEQ ID NO: 21245 - protein, 589 aa, Xenorhabdus nematophilus
HLINRLQQQSIEYPEKIAFRQWSPSEQLEMSWQDVTYRTESIAKALLSLGVEIQEKVAIFAHNCIAWSLADLAVLQLRAVTVPLYATSSRDQATFILKDAGVRVLFVGEQEQYNVAMTLLELCPQLNHLIVLDESVDLKSCPQAQYLSAFIVNAHAQYQPELDNRIAGQDLNDLFTLIYTSGTTGEPKGVMLDYHNIASQLYLHDQRLTLTKEDVSLSFLPLSHIFERAWSYYVMHTGALNVYLTDTNSVREAMAEVRPTVMCAVPRFYEKVHSAILEKVSRAPFLRRLIFRWAIKRGENRWMRQLQNKKACIFSLCSDQLADKLVLSKLRNIFGGRVRFLPVAGARLDDAIARFFLSAGINIKYGYGMTETCATVSCWEEKNYLPGSIGTPLPSIDVRISAEDEIQVRGPIVMKGYFNQPEETAHAFTEDGWLRTGDAGGLDETGNLFITERLKDLMKTSTGKYIAPQMLEGTLGQDRFIEYIAVIADSRNFVSALIVPSYDALEDYAKSIHLHYRDRIELLNNRQIIELFEQRLAELQKNIAKYHQVKRFILLPEAFSMEKGELTPTLKLRRKVISQHYHDEIESMY

SEQ ID NO: 21246 - protein, 362 aa, Xenorhabdus nematophilus
SGSYHIAVLPGDGIGPEVMRQAYKVLDAIRQRFNLHITTSEYDIGGIAIDRHGCPLPQTTIAGCEKADALLFGSVGGPKWEHLPPAEQPERGALLPLRKHFKLFSNLRPARLYAGLESFCPLRQDIAERGFDILCVRELTGGIYFGQPKGREGKGKYERAFDTEIYHRFEIERIARIAFESARKRRHKVTSIDKANVLQSSVLWREVVSEVARAYSDVEIQHMYIDNATMQLIKNPAQFDVLLCSNIFGDILSDECAMITGSMGMLPSASLNEKGFGLYEPAGGSAPDIAGKNIANPIAQILSTALLLRYSFERDDAANAIEHAINHALEQGYRTTDLAGNDKAVSTDEMGDIIARYIAEEI

SEQ ID NO: 21247 - protein, 344 aa, Xenorhabdus nematophilus
LMKALVYHGTGKKQWETKSPPQLIESTDAIVRIIKTTICGTDLHILKGDVPTVDAGRTLGHEGIGIVESVGESVRNIKVGDKVIISCITVCGRCRYCKRQLYSHCEDGGWILGHKIDGTQSEKVRIPHADNSLHRLPEGIDEEAALMLSDILPTGLEIGVINGKVQPGNTIALIGAGPVGLSALLASQFYSPAHIIMIDTDDNRLHVAQQFGADTVINPTHQNVVEVIQKLTDGIGVDVAIECVGIPATFKICQDIITAGGYIANVGVHGKSVELHLEDLWIKNITITTGLVNTSSTPMLLKSLQSGKISPEKLVTHRYSLSEIKTAYEVFGNAEKEKALKIVL

SEQ ID NO: 21248 - protein, 358 aa, Xenorhabdus nematophilus
MSKIFDFVKPGVITGDDVQKVFAVAKENNFALPAVNCVGTDSINAVLETAAKVRAPVIIQFSNGGAAFVAGKGLKAEGQQAAILGSISGAHHVHQMAEYYGVPVILHTDHCARKLLPWIDGLLDAGEKHYVQTGKPLFSSHMIDLSEESLEENIEICGQYLARMAKIDMTLEIELGCTGGEEDGVDNSHLDSSSLYTQPEDVAYAYEKLNAISPRFTIAASFGNVHGVYKPGNVKLTPKILRNSQDYVSEKFNLPHNSLDFVFHGGSGSTAEEIQEAVSYGVVKMNIDTDTQWATWEGILNYYKKNEGYLQGQLGNPEGADKPNKKFYDPRVWLRAAQVSMIVRLEQAFKELNAVDVL

SEQ ID NO: 21249 - protein, 385 aa, Xenorhabdus nematophilus
MSVIKMTDLDLAGKRVLIRADLNVPVKDGKVTSDARIRASLPTIVSALNQGAKVMVTSHLGRPTEGEYNEEFSLQPVVDYLKEKLSSPVRLEKNYLDGVEVAEGELVVLENVRFNKGEKKDDETLSKHYAALCDVYVMDAFGTAHRAQASTHGVAKFAAIACAGPLLSGELEALGKALYNPARPMVAIVGGSKVSTKLTVLDSLSKIADQLIVGGGIANTFVAAEGHNVGRSLYEDDLIPEAKKLLESCDIPVPTDVRVATEFSETAEATLKSTSEIKDEEQILDLGDASAERLVEILKDAKTILWNGPVGVFEFPNFRKGTEIIARAIAESDAFSIAGGGDTLAAIDLFGIADKISYISTGGGAFLEFVEGKKLPAVVMLEERA

SEQ ID NO: 21250 - protein, 304 aa, Xenorhabdus nematophilus
ISSLGNQIDNSLVSNAFGFLRFPLNFQPYSSDAEWVITGVPFDMATSGRAGSRHGPAAIRQVSTNLAWESCRWPWDFSLRKRLNVVDCGDLVFNFGDAQDMSDKLQAHAEKVLASGKKMLSFGGDHFVTLPLLRAHAKHFGKMALIHFDAHTDTYPNGSKFDHGTMFYHAPNEGLIDPHRSVQIGIRTEHDTDNGFTVLDAAQVNDRSVDAVVEQIKNVVGDLPIYLTFDIDCLDPAFAPGTGTPVIGGLTSDRALKILRGLQPLNIVGMDVVEVAPAYDQSEITALAAATIGLELLYLQASKK

SEQ ID NO: 21251 - protein, 699 aa, Xenorhabdus nematophilus
MALSSAIKNQISQWYKALSIHIDGFIPREPQRQMIAEVAKTLADEEGRHLVIEAPTGVGKTLSYLIPGIAVSRAEKKPLVVSTANVALQDQIYSKDLPLLRKLIPDLKFTGAFGRARYVCPRNLEAICAAEGEQIDLMLLVEDKTEIANSEERDLCRRLRSDYSTFIWDGLRDHHQLALSDSLWAKVSTDKMNCLARNCQFYHRCPFFLARREIESADVVVANHSLVIAALENESVLPDAKNLLLILDEGHHIPDVARDSLEVEGEITLFQLNGQLDTFVRNVEQYLLQFRPTKPPALANITRLQAHCEKIRECFKELADITQVLLPERREAAEYLFELGKLPENLLLCCQQLFKLTDGVRGLSEAIVNDLTDQTAKQDIVRLHHAILQTSRTLGYFENMVKLWRLASQEESSHAPISKWLTRRYEKNQSHLYFHCAGIRVSEQLTQLLWRKIPHIVVTSATLRSLNSFSRIQELTGLHENYDDRFITLSSPFEHVRQGRIIIPLMTQEPTIQNEMQHLEEMARYFRSQILMGAYRGMLVLFSSQRAMEGFLTFVKELRLMLLVQGDQPRYRLVETHCRRIDEGQPSVLIGLQSFAEGLDLKGDYLSQVHIHKIAFPPVTNPVIITESEWLKSLKRYPFEVQSLPSASFNLIQQVGRLIRSHECYGEVVIYDRRLLNKSYGSRLLNALPVFPIEQPDVP

SEQ ID NO: 21252 - protein, 569 aa, Xenorhabdus nematophilus
QRVSIMELEHESKRPLYIPYAGPILLEFPLLNKGSAFTEEERSNFNLHGLLPQIVETIEEQAERAYRQFCDFKSDGDKHIYLRNIQDTNETLFYRLLDAHLSEIMPIIYTPTVGEACEHFSDIYRRARGLFISYPNKASIDDMLQNATKQNVKVIVVTDGERILGLGDQGIGGMGIPIGKLSLYTSCGGISPAYTLPVVLDVGTNNPQRLNDPLYMGWRHPRITGKEYDEFVDEFIQAVKRRWPNVLLQFEDFAQTNAMPLLTRYRHDLCCFNDDIQGTAAVALGSLIAASRAAGRQLRDQTVTFLGAGSAGCGIAEQIVAQMKSEGLSDEQARARVFMVDRFGLLTDKQPNLLDFQSVLVQKNSVLQSWDVSNDSISLMDVVRNAKPTVLIGVSGQSGLFTEEIIREMHKHCERPIVMPLSNPTSRVEARPEDIINWTDGKALVATGSPFAPVKYDGQEYPIAQCNNSYIFPGIGLGVIASGARRVTDDMLMVASRALADCSPLAQTGSGPLLPPIDDIQNVSRKIAKEVAKKAQIQGMATVTSEDALEQAIERNFWKPEYRVYKRTS

SEQ ID NO: 21253 - protein, 468 aa, Xenorhabdus nematophilus
MSKQQIGVVGMAVMGRNLALNIESRGYSVSIFNRSSDKTDEVIAENPGKKLVPSYSIEEFVGSLEKPRRILLMVKAGEATDKTIASLTPHLDKGDILIDGGNTYFQDTIRRNRELSAQGFNFIGTGVSGGEEGALKGPSIMPGGQKEAYELVAPILKEIAAKVDGEPCVTYIGADGAGHYVKMVHNGIEYGDMQLIAEAYSLLKHSLNLSNQELADVFSDWNQGELSSYLIEITADIFRKKDEEGQYLVDVILDEAANKGTGKWTSQSSLDLGVPVTLITESVFARYISSLKDQRVAASKVLSGPEAQPFNGDKAEFIEKVRRALYLGKIVSYAQGFQQLKASSDDYNWDLNYGEIAKIFRAGCIIRAQFLQKITNAYNENAAIANLLLAPYFKQVADEYQQALRDVVSYGVQNGIPTPTFSAAISYYDSYRSAVLPANLIQAQRDYFGAHTYKRTDKEGVFHTEWLD

SEQ ID NO: 21254 - protein, 381 aa, Xenorhabdus nematophilus
MAVSTFFIPPVNKIGMGCMTEAIELMKNYGYRQALIVTDRVLNEIGVVGEVQNLLAEAGIKSAIYDGTNPNPTTINVEEGLTILRQHDCDCIISLGGGSPHDCAKGIALVAANGGDIRDYEGVDRSVKPQLPLIAINTTAGTASEMTRFCIITDVDRHIKMAIVDKNVTPILSVNDSALMAGMPEGLTAATGMDALTHAIEAYVSTAANPITDACALKAVTMISDYLRRAVANGNDMEARENMAYAQFLAGMAFNNASLGYVHAMAHQLGGFYDLPHGVCNAVLLPHVQKFNAKVSASRLKEIAAVMGADIANLNDRQGAEACIQEISKLAKDVNIPAGLSELSVKIEDLPMLASNALKDACGFTNPIQASHEEIVAIFKA

SEQ ID NO: 21255 - protein, 200 aa, Xenorhabdus nematophilus
TAQQIEKLDWKKVDNLMPVIVQHAVSGVVLMMGYMNKEALNATLDSGKVTFFSRTKQRLWTKGESSGHFLNLVDIYPDCDNDTLLALVNPIGSTCHTGTESCFAPAQTEWGFLYQLEQLLASRKNAPPASSYTARLYASGTKRIAQKVGEEGIETALAATVNDREELTSEAADLIYHLLVLLQDQDLDLSCIIRQLQKRH

SEQ ID NO: 21256 - protein, 258 aa, Xenorhabdus nematophilus
MLAKRIIPCLDVRDGQVVKGVQFRNHEIIGDIVPLAQRYAQEGADELVFYDITASSDGRVVDKSWVAKVAEVIDIPFCVAGGIKTTEEAGQILSFGADKISINSPALADPSLISRLADRYGVQCVVIGIDTWFDENSNSYRVYQFTGDEKRTTATQWQTRDWVREVQQRGAGEIVLNMMNQDGVRNGYDLTQLKLVRDICSVPLVASGGAGTPEHFLDAFKLANVDGALAASVFHKQIINIGELKQYLATQGVEVRTC

SEQ ID NO: 21257 - protein, 355 aa, Xenorhabdus nematophilus
MSQKLLFIDRDGTLITEPPTDYQVDRLDKLAFEAGVIPALLSLQKAGYKLVMITNQDGLGTDSFPQTDFEPPHALMMQIFTSQGIQFEEVMICPHKPEDNCNCRKPKLGLVEKYLTEGMVDMKNSYVIGDRETDLQLAENMGIKGILYQAQSLGWSTICEQLTHKDRHASVERKTRETGINIDIWLDREGRSEINTGVGFFDHMLDQIATHGGFRMNIQVKGDLCIDDHHTVEDTGLALGEALKQALGDKRGIARFGFTLPMDECLARCALDISGRPHLEYKAEFKHQRVGDLSTEMIEHFFRSLSYTMGCTLHLKTKGKNDHHRAESLFKVFGRTLRQAIRIEGDVLPSSKGVL

SEQ ID NO: 21258 - protein, 354 aa, Xenorhabdus nematophilus
MSTVFNVNSLARENVRKLVPYMSARRLGGKGDIWLNANEYPIAPDFQFSEKTLNRYPECQPASVIQRYADYAGLQPNQVLVSRGADESIELLIRVFCEPGKDAVLFCPPTYGMYSVSAETFGVEQKKIPTRADWQPDITAIENNLDRVKLIYICSPNNPTGNLIAPAALRQILELARNRAIVAIDEAYIEFCPQHTTTRWLRDYPHLVILRTLSKAFALAGLRCGFTLASPDIIALMLKVIAPYPLAIPVADIAAQALTGAGIHIMKDRVEEVVKNRTYLQQTLNELAMVEKVFPSEANYLLVKFTDAEIVFRALWEQGIILRDQRKQAGLNNCLRITIGSRNECKQLVNAIAA

SEQ ID NO: 21259 - protein, 430 aa, Xenorhabdus nematophilus
INFKTVIRWQECPPEQQKALLTRPAVVASENISRTVKQILETVKANGDEALQEFSQRFDKTTIDTIPLSTSEVNAAASRLTPEIKQAMQQAMNNIRLFHEAQKPAVIEVETLPGVRCQQVTRPIDSVGLYIPGGSAPLPSTVLMLGIPAGIAECRNVILCSPPPIADEILYAAQLCGINEIFQVGGAQAIAAMAFGTESVPKVDKIFGPGNAWVTEAKRQVSQRFDGAAIDMPAGPSEVLVIADSGANPAFTAADLLSQAEHGPDSQVVLVTPDEIFAEQVIREIETQLTALPRQQIAIQALQSSRIIVTDNLTQCVAISNQYGPEHLIIQTRQPEQLVEKITSAGSVFLGDWSPESAGDYASGTNHVLPTYGYTSTYSSLGLADFLKRMTVQQITPQGLRSLAPIIETLAQAEQLTAHKNAVTLRIAAL

SEQ ID NO: 21260 - protein, 206 aa, Xenorhabdus nematophilus
MLTIWGRKSSSNVKKVTWCLEELNVPYQQIDVGGKFGKLNTPEYLLMNPNAVIPCLQEDDFILWESNTIVRYISAKFGENSLYPANLQERAKIDQWMDWVGCNFFPPIKQLMINIVRTPEDQRDPKVIAQILKEIEKLLKIVDDMLGKQKYLSGDKFGMADIALAPLVYPWLNIEIERPSLPNLERWYQLLTERPAFQKIVMIEIS

SEQ ID NO: 21261 - protein, 444 aa, Xenorhabdus nematophilus
SKQSLQRGLEARHIELIALGGTIGVGLFMGSASTLKWAGPSVLLAYIIAGIFVFFIMRSMGEMLFLEPVTGSFAAFGHKYLSPYWGCLTAWGYWFMWVSVGISEITAVGVYAEFWFPDLPQWVSALVAVGLVALANLAAVRLYGELEFWFAMIKVTTIIVMILIGIGLIFFGLGNDWQPIGLDNLTAHGGFFSGGWKGFLFALCIVVASYQGVELVGITAGEAKNPQVTLKKAINNILWRILIFYVGAIFIVVTLFPWTEAGTHGSPFVMVFSKVGIASAAAVINFVVLTAALSGCNSGMYSGGRMLYALAKNRQLPASLLKLSKNGVPVRCIAITIGCLIAGSSLNYLIPNPQSVFVYVYSASVLPGMVPWFVILVSQLRFRQQNQEALKQHRFKSLLFPYVNYLTLVFLSCVLIGMAINPDTRFSLMVGGAFLLLVSLAYWL

SEQ ID NO: 21262 - protein, 293 aa, Xenorhabdus nematophilus
MKGIILAGGSGTRLYPITRGVSKQLLPIYDKPMIYYPLSVLMLAGIRDILIISTSEDLPAFKRLLGNGEQFGIRLSYAVQPSPDGLAQAFIIGEEFIGNDACCLVLGDNIYFGQAFSPKLQSVVARQTGATVFGYQVMDPERFGVVEFDEQYRVLSIEEKPARPKSNWAVTGLYFYDNKVVDLAKQVKPSARGELEITSINQMYLERGELNVELLGRGFAWLDTGTHDSLIEASTFVQTVEKRQGFKIACLEEIAWRHGWLDDEQLKAAAAELAKTGYGKYLMDLLHVYSRQY

SEQ ID NO: 21263 - protein, 415 aa, Xenorhabdus nematophilus
FETISVIGLGYIGLPTAAAFASRKKNVIGVDVNQHAVETINRGAIHIVEPDLDKVVKTAVEGGYLKAVTCPQAADAFLIAVPTPFKGEHEPDMAYVRSAAESIAPVLKKGDLIILESTSPVGATEQMAEWLAAARPELSFPQQAGENADIDIAYCPERVLPGQVMVELIKNDRVVGGMTLKSSRRASELYKIFLEGECVVTNAKTAEMCKLTENSFRDVNIAFANELSLICSEQGINVWELISLANRHPRVNILQPGPGVGGHCIAVDPWFIVSQNPAQSRLIHTARLVNDGKPLWVVDQVKAAVAGCLVESGKRADEIKIACFGLAFKPNIDDLRESPAVHITKMVAQWHVGQTVAVEPNVHELPNSLKESVELIDMQQALNEADVVLMLVDHSQFKAIAGREIKQKWVVDTKG

SEQ ID NO: 21264 - protein, 427 aa, Xenorhabdus nematophilus
MSKTHLTEKKFSDFALHPKVIEALDKKGFSNCTPIQALTLPFTVEGRDVAGQAQTGTGKTLAFLTSTFHYLLTHPAAADHKTNQPRALIMAPTRELAVQIYSDAEELAEATGLKMGLAYGGDGYDKQLKVLESGVDIVIGTTGRLIDYTKQGYVNLNAVQVVVLDEADRMYDLGFIKDIRWLFRRMPVAAQRMNLLFSATLSYRVRELAFEQMNSPEYVEVEPLQKTGHRIQEELFYPSNEEKMRLLQTLLEEEWPDRCIIFANTKHRCEDIWAHLAADGHRVGLLTGDVAQKKRLRILEEFSLGNLDILVATDVAARGLHIPFVTHVFNYDLPDDCEDYVHRIGRTGRAGESGHSISLACEEYALNLTSIEEYIQHQIPVSKYNSDALLMDLPVPKRRNRARSGGHPRRTNMSRRGNPTRNRKHPG

SEQ ID NO: 21265 - protein, 667 aa, Xenorhabdus nematophilus
MRLNPSQQQAVEFVTGPCLVLAGAGSGKTRVITNKIAHLIRACGYQARHIAAVTFTNKAAREMKERVAQTLGRKETRGLMISTFHTLGLEIIKREYKALGMKSNFSLFDDQDQRVLLKDLTADLLEEDKDLLQKLNSSISNWKNDLMSPEQVIRQARSAQEHQFAECYRRYDLHLNSCNVLDFDDLITKPTLLLMQNEEVRERWQNKIRYLLVDEYQDTNTSQYQLVKLLVGNRARFTVVGDDDQSIYSWRGARPQNLILLNEDFPQLNVIKLEQNYRSSGRILKAANILIANNPHVFEKKLFSELGYGDPLRVIEANNEDHEAERVVGELLAHHFINKTEYKDYAILYRGNHQSRIFEKMLMQNRIPYRISGGTSFFSRPEIKDLLSYLRVLTNPDDDSAFLRIVNTPRREIGAMTIQKLGEWANQRNKSLYHASFDLGLEQSLTGRGLAALQHFTHWMDEISRQAEREPLLAVRDLLRGMDYESWLYETSPSPKAAEMRMKNVNQLFTWMSEMFEGDDLNEPMTLSQVVARFTLRDMLERGEDDEELDQVQLMTLHASKGLEFPYVFLVGMEEGLLPHQSSIDENNIDEERRLAYVGITRARRELFFTLSKERRQYGELIRPEPSRFLLELPQDDLHWPRGKKMISAEDRMKQGQSRLADIKSRL

SEQ ID NO: 21266 - protein, 554 aa, Xenorhabdus nematophilus
MSEADARPTNFIRQIIDEDLATGKHTSVHTRFPPEPNGYLHIGHAKSICLNFGIAQDYQGQCNLRFDDTNPVKEDIEYVDSIKTDVQWLGFHWSGNIRYSSDYFDMLYQYAIELINKGLAYVDELSPEQIREYRGTLKEPGKNSPYRDRSVEENLALFEKMRAGEFAEGKACLRAKIDMASPFIVMRDPVIYRIKFAEHHQSGNKWCIYPMYDFTHCISDALEGITHSICTLEFQDNRRLYDWVLDNITIDCHPRQYEFSRLNLEYTVMSKRKLNQLVTENIVNGWDDPRMPTISGLRRRGYTAAAIREFCRRIGVTKQDNNVEMAALESCIRDDLNENAPRAMAVLDPVKLVIENMPEGEMILTMPNHPNKPEMGSREVPFSREVYIDRADFREEANRQYKRLVLGKEVRLRNAYVIKAEHVEKDAEGNITTIYCHYDEQTLNKDPADGRKVKGVIHWVSAVHAVPAEFYLYDRLFSVPNPGAEDDFLSTINSESLVVRKGFVEPGLVNAQPERTYQFEREGYFCADSGLSSAEHLVFNRTVGLRDTWTKISQ

SEQ ID NO: 21267 - protein, 177 aa, Xenorhabdus nematophilus
NIKAILFDMDGTLVKSLSEVEAIWSIWCELNNISIKKVLDICHGVRSRDVISSIAPHLNMEEQIQLLDDLEIKYSDTAKALPGAKEFLISLAACPWAIVTSASQRVAYHRMAICGLKIPDFIIGSDDVLNGKPYPDPYLMAAERLNIAAEDCLVFEDAHAGVQSALAAGCKVIQIGG

SEQ ID NO: 21268 - protein, 680 aa, Xenorhabdus nematophilus
MTNPLLTPSVLPKFAAIEPKHVVPAVKETLANYRQVIEKVLAGNVTFTWDNLCQPISEAKDHLSRVWSPVEHLNAVKNSPELREAYEQSLPLISEFETWMGQHEGLYQAYKALKESEAFKALSQPQRKAIENTLRDFELSGIGLPKEKQKRYGEISARLSELGSQFGNNLLDATMGWTKLITDECDLEGMPDSAKAAAKAAAEAKGLEGWLLTLNGPSYLPVMTYADDSELRQEMYYAYTTRASEQGPNAGQWDNSAVMTEILALRHELALLLGFKNYAENSLATKMAKTPKQVLDFLNDLANRAHAQGKRELEELTDFAESHYWVDELEAWDLAYYSEKQKQHDFSISDEQLRPYFPEQRVIEGLFEVIRRIYAITAKERRDVETWHPDVRFFELYDEKQTLLGSFYLDLYAREHKRGGAWMNSYVGRMRHTSGELQTPVAYLTCNFNKPVGDQPALFTHNEVTTLFHEFGHGLHHMLTQVETLDVAGINGVPWDAVEMPSQFMENWCWEPEALAFISGHYETKEPLPKEMLDNMLAAKNYQAAMAILRQLEFGLFDFRLHVEYDPAKGAQILPTLQSVKKQVAVVPSPEWGRFPNTFSHIFNGGYAAGYYSYMWADVLAADAYSRFAEEGIFNRTTGQSFLDNILTRGGSEDPMTLFVRFRGREPKLDAMLKSSGISG

SEQ ID NO: 21269 - protein, 447 aa, Xenorhabdus nematophilus
MNISPSLVSFLDSIQSHNPHQPEYLQAVREVLTSLWPFLQQNPQYREQSLLERLIEPERVIQFRVCWVNDQGKVQVNRAWRVQFNSAIGPFKGGMRFHPSVNLSILKFLGFEQTLKNALTTLPMGGAKGGSDFDPKGKSHGEVMRFCQALMTELYRHLGPDTDVPAGDIGVGGREVAFMAGMMKKLSNNTACVFTGKELSFGGSLIRPEATGYGLVYFTHEMLKRHGMGLEGMRVSVSGAGNVAQYTIEKCIELGAKVVTVSDSGGTVLDEEGFTPEKLAHLEEIKNQRYGRVEEYAKEHGLTFLKGQDPWSIPVDIALPCATQNELDLDAAKTLIKNGVKVVAEGANMPATISATDAFLEAGVLFAPGKAANAGGVATSGLEMAQNAARLSWKAEKVDVRLHHIMLDIHHACVEYGGEGKQTNYVQGANIAGFVKVADAMLSQGIL

SEQ ID NO: 21270 - protein, 421 aa, Xenorhabdus nematophilus
MTESMLAKRRSAAIAKGVGVTTQVYVERAENAEIWDAQGQRYIDFAAGIAVVNTGHRHPRVIAAAREQLEQFIHTCHQVVPYENYVALAERLNRLVPGNFVKKTVFVTTGAEAVENAVKIARAATGRSGVVAFSGAFHGRTFLGMSLTGKVVPYKMGFGSLVSDVYRVPFPVALHGISVEQTLNALDNLFKTDIEPTRVAAIIIEPVQGEGGFYPAPPELLKSLREIADRYGIVLIADEIQTGFARTGKLFAMEHHEVAADLTTMAKGLAGGFPLAAVTGRAELMDAVAPGGLGGTYGGNPVAIAAGHAVLDVIEEEKLAARATQLGERLKQCLNELRPRVPQIADVRGLGLMIAVEFNRADSQEPDAGFTNAVRQKALERGLILLACGIHGNVIRFLPPLTIQNDVFDEALNVLESVLLD

SEQ ID NO: 21271 - protein, 478 aa, Xenorhabdus nematophilus
VSMPVPTFKHFINGQYIESQGSEYFDLVSPVTGKAYARSPNATVADVDDAYASAKEAFKIWGRSTPSARQQALLALADTVEKNAERLIESQSRNTGQLKHLIASEEIATSVDHIRFFAGAARFLEGKATAEYLSGMTSSIRREPLGVVGQVTPWNYPLMMAVWKIAPALAAGNTVVLKPSDTTPESTLLLAELSAPFFPAGTFNVVLGNASAGSLVVSHKTPAMVSITGSVRAGLQVASSAAANLTRAHLELGGKAPVVIFADADIDKAVGTIVTAGYFNAGQDCTAASRVLVHESVYDIFVTKLVAAAKATRFGDPEDKEALYGPLNNVRQLEQVTGFLARLPAHARIETGGRQADRSGYYFEPTVITGLEQEDEMIQTEIFGPVITVQKFLTEQDAIEKANDVKYGLASSVWTRDHGRALRLSRELDFGTVWINTHIPLTAEAPHGGFKNSGYGKDLSAYGFDEYTRIKHVMSSND

SEQ ID NO: 21272 - protein, 171 aa, Xenorhabdus nematophilus
MSNTQQPNHVFVLMGVSGSGKSAVASGVARKLGAAFLDGDFLHPRANIIKMAQGHALNDDDRQPWLKALNDAIFAMQRTNNISLLVCSALKKNYRDMLRNGNKNLSFLYMQGDFYLIESRLKARKEHFFKPQMLISQFEVLEEPTDDEKDVHHIDIRPDLDEVIKNTMTTI

SEQ ID NO: 21273 - protein, 433 aa, Xenorhabdus nematophilus
KPIKIAVIGGGSSYTPELVEGIIQRSQIIPLSELALVDVEAGRHKLETIAALTRRMLDRHDLEHVTVTAHYSPDEAIKGASFVLTQLRVGQLPARAADERLGLKYGLLGQETTGVGGFAKALRTIPVLLDIAHKVERLAPEAWIINFSNPAGVVTEAVSRYSKAKIIGLCNVPISMHHMIANMLQRPYQDVQLRFAGLNHMVWVHQVLVNGRDETEQVLELLCNGAELTMNNIKEEPWPPEFLQALGAIPCPYHRYFYQTGKMLQEEKEIAASKGTRAEQVMQVERELFELYADPKLDHKPAQLSFRGGSFYSEVALELISAIHNNLGTQLVVNTENRGAIIDLPDDAVIEANCIVDAQGAHPLAFGHLPDSMSALTQQVKAFERLTIEAAVHGDRKVALLALVTHPLIGDVALDSTLLNEILEINRMYLPQF

SEQ ID NO: 21274 - protein, 273 aa, Xenorhabdus nematophilus
MADTDIRVAVVGAGGRMGRHLIQAAQQLDGATLGAALERSGSSLVGTDAGELAGIGKNGITVSDDLHDVIEHFDVLIDFTRPEGTLAYLAICRQYRKAIVIGTTGFDDAGKQAIEDASRDIPIVFAANFSVGVNLVLKLLEKAATVMGEYTDIEIIEAHHRHKVDAPSGTALAMGESIAHALGRDLKTCGVYAREGHTGERDPKSIGFATVRAGDIVGEHTAIFADIGERVEISHKASSRMTFANGAIKAAIWLNAKNNDLYDMKDVLNLKNL

SEQ ID NO: 21275 - protein, 379 aa, Xenorhabdus nematophilus
LIKSAILVLEDGTQFHGRAIGVEGVAVGEVVFNTSITGYQEILTDPSYSRQIVTLTYPHIGNTGINAADEESPAIQAQGLVIRDLPLVTSNFRSEENLSDYLKRHNIVAIADIDTRKLTRLLREKGAQNGCIIAGNEADAQVALEKAKAFPGLKGMDLAKEVTTEQSYPWLQGSWTLADGLPEVCKEQELPYHIVAYDFGVKRNILRMLVDRGCRVTVVPAQTPADEVLKMAPDGIFLSNGPGDPEPCDYAIEAIQAFLNTEIPVFGICLGHQLLALASGAKTVKMKFGHHGGNHPVKDLENNVVMITAQNHGFAVDESTLPTNLRVTHKSLFDGTLQGIHRTDKPAFSFQGHPEASPGPHEAASLFDHFIELIEQHRQ

SEQ ID NO: 21276 - protein, 1072 aa, Xenorhabdus nematophilus
MAKRTDIKSILILGAGPIVIGQACEFDYSGAQACKALREEGYRVILVNSNPATIMTDPEMADATYIEPIHWEVVRKIIEKERPDAILPTMGGQTALNCALELERQGVLTEFSVTMIGATADAIDKAEDRQRFDKAMKKIGLDTARSGIAHTMEEALAVAEDVGFPCIIRPSFTMGGSGGGIAYNREEFEEICERGLDLSPTNELLIDESLIGWKEYEMEVVRDKNDNCIIICSIENFDPMGIHTGDSITVAPAQTLTDKEYQIMRNASMAVLREIGVETGGSNVQFSVNPKNGRLIVIEMNPRVSRSSALASKATGFPIAKIAAKLAVGYTLDELMNDITGGRTPASFEPSIDYVVTKIPRFNFEKFAGSNDRLTTQMKSVGEVMAIGRTFQESMQKALRGLEVGVTGFDPKVNLDDPQSLTKIRSELKSAGAERIWYVADAFRAGMSIDGVFNLTNIDRWFLVQIEELVRLEEQVEEQGINGLTFDFLRHLKRKGFADAHLAKLVGVSGKEIRKLRHDYNLYPVYKRVDTCAAEFSTDTAYMYSTYEDECESNPNHDKPKIMVLGGGPNRIGQGIEFDYCCVHASLALREDGYETIMVNCNPETVSTDYDTSDRLYFEPVTLEDVLEIVRVEKPTGVIVQYGGQTPLKLARELEAAGVPIIGTSPDAIDRAEDRERFQQAVNRLGLKQPANATVSTIEQAVEKGNGLGYPLVVRPSYVLGGRAMEIVYDETDLRRYFQNAVSVSNDAPVLLDRFLDDAVEVDVDAICDGERVLIGGIMEHIEQAGVHSGDSACSLPAYTLSQEIQDVMRQQVEKLAFELRVRGLMNVQFAVKNNEVYLIEVNPRAARTVPFVSKATGLPLAKVAARVMAGQSLLKQGVTKEIIPPYYSVKEVVLPFNKFLGVDPILGPEMRSTGEVMGVGRTFAEAFSKAMLGSSSTMGKHGRALLSVREEDKERVVDLAAKLLKQGFELDATHGTAIVLGEAGINPRLVNKVHEGRPHIQDRIKNGEYNYIVNTTAGRQAIEDSKLLRRSALQYKVHYDTTLNGGFATTMALSADPTEQVISVQEMHAKI

SEQ ID NO: 21277 - protein, 236 aa, Xenorhabdus nematophilus
VGYRSIDTAAIYHNESGVGKALKEIDIPREEIFVTTKLWNDRHQDAKAALEESLDKLQLDYINLYLLHWPVPHQDQYVEAWKQLIELKESGLARSIGVCNFHIEHLQNLMSETSVIPAINQIELHPLMQQRQLHSWNATHHITTESWSPLSQGGKGVFDNPLVQHLAIKYEKTPAQIVIRWHLDCGMIVIPKSVTPSRIKENFDVFDFRLEKEDLTAMAELDIGKRIGPNPDIYTG

SEQ ID NO: 21278 - protein, 394 aa, Xenorhabdus nematophilus
MTEKKLETLLVSTGRKKKYTQGAVNPLIQRTSSIIFDTVEDLKHALKNRAKSELFYGRRGTLTHFAFQEAMTELEGGAGCALYPSGAAAITHSILAFVATGDHVLLTGSAYEPTQDFCNHILKKMGISTDYFDPMIGEGIASLIKPNTKVVFLESPGSLTMEVQDIPSIVRTIRQINPEIVIIIDNTWAAGILFKALDFGIDISIQSATKYIIGHSDGMLGTAVANARCWDQLRESSYLLGQIADPDTVYTATRGLRTLAIRLKHHEESSLHIAKWLAQRPEVAEVYHPALPSCPGHHYFQRDFTGASGLFSFLLKVELTPQQFAEYLDNLHHFKMAFSWGGFESLILGIQPDMLTSLRRYDPLKKTGTLFRVHIGLENPQDLIDDLAAGFARI

SEQ ID NO: 21279 - protein, 663 aa, Xenorhabdus nematophilus
MPLYLCEKPSQARDIARVLGVKQRGQGYLFGDSITVTWAIGHLLEMAAPEHYGEQFGPPWRMEPLPVLPVQWQWTVKKETADQFAVIRQLLKQADEVIIATDADREGEVIARELLEYCRFTGPVRRLWLSALDETSIRQALAAILLGEQTEPLWQAGLGRARADWLMGINLTRLYTLKAQAQGFGEVLSIGRVQTPTLALVVNRDNDIARFEPKPYWQVMAALQKDDISFRVKWLPAPDDCDEEKRCIREDIAQSVVQRCQQAQDAVVTELTQKREKTPPPLCFDLGMLQQVASRQWGMGAGQVLTIAQSLYEIHKATTYPRTDCGYLPVSMREDIPAVFTALTRTDPAMNAIISQLDASTLSRVWNDSQITAHHAIIPTRHTFDMTKLTADELKIYQLIRHYYLAQFLPVQETDVTDVTFTIGGQVFQAKGRVSVVTGWKTLFADEKQVQEQDDNTALPALKKEEICPVLRAEIQPRQTRPPAPFTEGTLIAAMKNAAAFIHDPQLKKVLRENAGLGTEATRAGIIEALFNRQLLARKKKNLHATPLAQELIAGLPDVLTHPGMTALWEQSLDDIARGRATLDGFMQKQAQWLAHLVEKGKTQPIRFTLPKTPACPRCGGPMQKRAGKTTPFWGCTRYPACKGMLNANAVTGSRKTRRGNSP

SEQ ID NO: 21280 - protein, 354 aa, Xenorhabdus nematophilus
MNELKNDRYLRALLRQPVDVTPVWMMRQAGRYLPEYKATRQEAGDFISLCKNTELACEVTLQPLRRFPLDAAILFSDILTIPDAMGLGLYFETGEGPRFHSPILNHTDVEKLPVPDPEMELGYVMDAVRAIRKALAGQVPLIGFSGSPWTLATYMVEGGSSKAFTKIKSMMYAQPATLHLLLDKLANSVILYLNAQIKAGAQSVMIFDTWGGVLSHRDYREFSLQYMHKIVDGLIREHDGRRVPVTLFTKGGGQWLEAMVATGCDALGLDWTTNIADARRRVGDKVALQGNMDPSMLYAAPARIEEEVSTILQDFGTGNGHVFNLGHGIHQDVPPEHAGAFVEAVHRLSEKYHR

SEQ ID NO: 21281 - protein, 178 aa, Xenorhabdus nematophilus
VIFDIDGVIVDSEQLHFDVLCELAPDHTRDVQPQQLIGLSLAETLNEIGVPLPEQQGITDRIISVYQEKLSAHYLRPGVTRLIAALQQNDIAFGFVSTAPRAVCLANLGLLDLFDEPALISGDDVERTKPFPDPYLAMLKLKRMDVQQTLVIEDTDLGIAAAKQAGIPWVYAWPHDLS

SEQ ID NO: 21282 - protein, 385 aa, Xenorhabdus nematophilus
YLEIDGEKHIDAASGTFNLPLGYTNHRVAEKLKQQIDRCTHLSSAYTREMSQYILTKLVKHTPEGIDRMWLRDVSGSGAVEGAIRIAQKATGRSGIISFFLAHHGQSLATAQISGNAFRIKDFHISIDGSIKIPAPASVMAEPDPNETENQYVDLEQFIQLGSSDNIACLIIEPIQGNGGNTVFPVEFYRKIREICHQHGIIIIADEIQTGFGRTGTFFASTGYAKELEPDIIVFAKGAGGIGIPTGGVLMRSSLDVLESFEHSSTSGANPLSLVALNEIIDIIEDDAILENVQQNEAFLRDGLLALQHKYPEITGVRGMGYMFGFDTPTPEFAAQVIETASRHRLILRGSRYGKGRALKVRPPLVCTQEHLHEILHKLDLAFAE

SEQ ID NO: 21283 - protein, 802 aa, Xenorhabdus nematophilus
MQQPKLDRAVFQAALTRQWQRFGLSSAQEMTPHQWWQAISAALLELLPSSSPNHGHQLHNSKRHVNYISMEFLIGRLTANNLLNLGWYDDVQAYLAEDGLTLSDLLEQEADPALGNGGLGRLAACFLDSMATIDQPATGYGLNYQYGLFRQSFDQGLQIEAPDDWKQGSYPWFRHNAQLKVDVGFGGKIVMTDEGHETWLPAFTLIGEAWDLPVVGYGNGVTQPLRLWQATHDNPFDLSLFNDGQFLNAEQQGIEATSLTKVLYPNDNHQDGKRLRLMQQYFQCACAVADILRRHQQAGRKVEELPRYEVIQLNDTHPTIAVPEMMRLLLDEHRLDWETAWEITGQTFAYTNHTLLPEGLERWDEHLVSELLPRHHRIIQEINRRFQKTVEQTWPGNQQVWEKLAVTHGNQVRMANLCVVACFAVNGVAALHSSLIVTDLFPEYYHLWPKKFHNVTNGVTPRRWLKQCNPALSSLIDQTLNHEWVNDLESLKQLEPYANDTAFCEAYRSIKQENKIRLSNYVNKVMGLKIDPHAIFDVQIKRLHEYKRQHLNLLHILSLYRQIQENPSLDVHPRVFLFGAKAAPGYYLAKNIISAINHAAEKINHDPIVRDRIKIAFIPDYNVSTAELMIPAADVSEQISTAGKEASGTGNMKLALNGALTIGTLDGANVEIAEQVGNDHIFIFGNNVEEAKALLKSGYNPRHILQQNPHLQGILDALASGEFSHGDTQAFNLMLHSLVDGGDPYLVLADFDSYCQAHKQIDTLYRNPQHWTHSTILNTARMGKFSSDRAIQDYQQRIWQAK

SEQ ID NO: 21284 - protein, 1407 aa, Xenorhabdus nematophilus
VKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRDRMGHIELASPTAHIWFLKSLPSRIGLLLDMPLRDIERVLYFESYVVVEGGMTSLERAQILTEEQYLDALEEFGDEFDAKMGAEAIQALLKNLDLENECETLREELNETNSETKRKKLTKRIKLLEAFIQSGNKPEWMVLTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPYLRLHQCGLPKKMALELFKPFIYGKLELRGLATTIKAAKKMVEREEAVVWDILDEVIREHPVLLNRAPTLHRLGIQAFEPVLIEGKAIQLHPLVCAAYNADFDGDQMAVHVPLTLEAQLEARALMMSTNNILSPASGEPIIVPSQDVVLGLYYMTRDCVNAKGEGMVLTGPKEAERVYRAGLASLHARVKVRITEEVRDGEGNVTTNTGLVDTTVGRAILWMIVPRGLPYSLINQALGKKAISKMLNTCYRILGLKPTVILADQTMYTGFAYAARSGVSVGIDDMVIPEKKEGIIAEAEAEVAEIQEQFQSGLVTAGERYNKVIDIWAAANERVAKAMMENLSTEAVINRDGEEEQQVSFNSIFMMADSGARGSAAQIRQLAGMRGLMATPDGSIIETPITANFREGLNVLQYFISTHGARKGLADTALKTANSGYLTRRLVDVAQDLVVTEDDCGTHNGILMTPVIEGGDVKEPLRERVLGRVTAEDVLKPGTADILVPRNTLLNEKWCDLLEESSVDSVKVRSVVSCETDFGVCANCYGRDLARGHIINKGEAVGVIAAQSIGEPGTQLTMRTFHIGGAASRAAAESSIQVRNKGHLKLFNAKYVTNSAGKLVITSRNTELRLIDDFGRTKESYKVPYGSVLSKGDGETVTGGETVANWDPHIMPVVSEVSGIIQFYDMVDGQTITRQTDELTGLSSLVVLDSAERTGSGKDLRPALKIVDAQGKDVLISGTDMPAQYFLPGKAIVQLEDGMSISAGDTLARIPQESGGTKDITGGLPRVADLFEARRPKEPAILAEISGIVSFGKETKGKRRLVISPLDGSDAYEEMIPKWRQLNVFEGEVAERGDVISDGPESPHDILRLRGVHAVARYITNEVQEVYRLQGVKINDKHIEVIVRQMLRKVTIANAGSSEFLEGEQVEYARVKVANRKLELDGKLAATFHRDLLGITKASLATESFISAASFQETTRVLTEAAVAGKRDELRGLKENVIVGRLIPAGTGYAYHQERIRRRHANEVVEAPPVSVDEATANLAELLNAGFGSSSDK

SEQ ID NO: 21285 - protein, 1342 aa, Xenorhabdus nematophilus
MVYSYTEKKRIRKDFGKRPQVLDIPYLLSIQLDSFQKFIEQDPEGQNGLEAAFRSVFPIQSYSGNSELQYVSYRLGEPVFDVQECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPASIILRAMNYSTEDILNLFFNKTIFEIRDNKLQMTLVPERLRGETASFDIEANGKLYVEKGRRITARHIRQLEKDQVDRIEVPVEYIAGKVVAKDYIDQNTGEILCAANMELSLDLLARLSQSGHKTIETLFTNDLDHGAYISETLRVDPTNDRLSALVEIYRMMRPGEPPTREAAENLFENLFFSEDRYDLSAVGRMKFNRSLDRTEIEGSGILSKEDITDVMKKLIDIRNGKGEVDDIDHLGNRRIRSVGEMAENQFRVGLVRVERAVKERLSLGDLDTLMPQDMINAKPISAAVKEFFGSSQLSQFMDQNNPLSEITHKRRISALGPGGLTRERAGFEVRDVHPTHYGRVCPIETPEGPNIGLINSLSVYARTNEYGFLETPYRLVRDGVVTDEIHYLSAIEEGNYVIAQANTVLDEEGHFVEDLVTCRHYDESSLFNRDQVQYMDVSTQQIVSVGASLIPFLEHDDANRALMGANMQRQAVPTLRADKPLVGTGMERAVAVDSGVTSVAKRGGVIQYVDASRIVIKVNEDEMYAGEAGIDIYNLTKYTRSNQNTCINQMPCVSLGELVERGDVLADGPSTDLGELALGQNMRVAFMPWNGYNFEDSILVSERVVQEDRFTTIHIQELACVSRDTKLGPEEITADIPNVGEAALSKLDESGIVYIGAEVKGGDILVGKVTPKGETQLTPEEKLLRAIFGEKASDVKDSSLRVPNGVAGTIIDVQVFTRDGVEKDKRALEIEEMQLRQAKKDLTEELRIFEAGLFARIHSVLVAGGVEAEKLSKLPRERWLELGLADEEKQNQLEQLAEQYDELKTEFEKKLDAKRRKITQGDDLAPGVLKIVKVYLAVKRQIQPGDKMAGRHGNKGVISKINPIEDMPYDENGTPVDIVLNPLGVPSRMNIGQILETHLGMAAKGIGDKINAMLKQQQEVAKLREFIQKAYDLGDDTRQKVDLNTFTDEEVLRLAENLKKGMPIATPVFDGAKETEIKELLQLAGLPTSGQITLFDGRTGEQFERQVTVGYMYMLKLNHLVDDKMHARSTGSYSLVTQQPLGGKAQFGGQRFGEMEVWALEAYGAAYTLQEMLTVKSDDVNGRTKMYKNIVDGNHQMEPGMPESFNVLLKEIRSLGINIELEDE

SEQ ID NO: 21286 - protein, 421 aa, Xenorhabdus nematophilus
KLETLSIHAGYSPDPATKAVAVPIYQTTSYAFDDTQHGADLFDLKVEGNIYSRMMNPTNDVLEKRIAALEGGIGALSVASGMAAVTYAIQAIAQAGDNIISVAKLYGGTYNVMAHTFPSIGIETRFVDHNDIAAIEALIDEKTKAVYCESITNPGGHIIDIQAMADVAHKYGIPLIVDNTVATPYLCRPFEHGADIVIHSLTKYIGGHGTTIGGIIVDSGKFPWAEHQDRFAILSTPDASYHGIIYTEHFGAAAYIARCRVGPLRSTGATLSAFSAFLILQGLETLALRMERHTENTLKVAQYLNEHPQVSWVKYAGLPEHPEHELAVRYMGGKPSSVLSFGIKGEEEAGTRFIDALELIVRLVNIGDAKSLACHPASTTHRQLNDAEMVKAGVSRDLIRLSIGIEHSDDIIADLSQALDA

SEQ ID NO: 21287 - protein, 554 aa, Xenorhabdus nematophilus
VFWTIGLFTAFINLLMLVPSIYMLQVYDRVLPSSNEMTLLMLTLITLGMFAIMGGLEYIRSMVVIRIGSQFDMCLNQRVYTASYESNLKNGSTDAGQMLNDLATIRQFLTGNALFAFFDVPWFPIYLWVIFLFSPYLGLLALVGAIILITLAVLNQWLSQSPLSEASHLSLRSANLASTNLRNAEVIEALGMLPALRQRWFSLHERFLNFQRIASERAASITALTKTVRMALQSLILGLGGWLAIEGNITPGMMITGSILMGRALSPIEQLIQAWKSWSAARLSWQRLDKLLKAQPERKSGMSLPAPKGILLLEKVAAIPPSKTQARQTAGNHKQVLQDISFSLNAGDVLGVIGPSASGKSTLARLLVGIWPSQEGVVRLDDADIYQWNKDELGASIGYLPQDIELFGGTIAENIARFNDVDPEKVIEAAKKAGVHELVLNLEQGYDTVIGTGGMGLSGGQKQRIGLARALYGNPSLLVLDEPNSNLDDIGEKALSQAITQLREQGKTVVVITHRPSLLSQTNKILLLVQGKMKMFGPSQQVMAALSQSKTVER

SEQ ID NO: 21288 - protein, 754 aa, Xenorhabdus nematophilus
MTVLNHTLGFPRIGLKRELKKAQENYWAGKISQQELLETGRELRARHWQQQKEAGVDLVPVGDFAWYDQVLTTNLLLGNVPPRHQNEDGSIDLDTLFRIGRGRAPTGTPAAASEMTKWFNTNYHYIVPEFQQGQEFKLTWTQLLDEVDEALALGHKVKPVLLGPVTYLWLGKVKGKAFDRLSLLTDILPVYQQVLAELAKRGIEWVQIDEPALVLELPKEWLEAFSTAYQALQGQAKLLLTTYFDSISHNLATIKSLPVQGLHVDLVAGKDSLDELNKSLPETWLLSLGVINGRNVWRADLSAKYQLVASLAGKRDIWIGTSCSLLHSPIDLNDETGLDEEVKSWFAFALQKCAELSLLAQALNAPEGSKQAELDAYSAPIRARRSSTRVNNPTVTERITAIKPQDSERNLVYPERAKLQRERYNLPLWPTTTIGSFPQTTEIRSLRLDFKKGRVDNTHYRTNISEHIKQAINEQENLGLDVLVHGEAERNDMVEYFGEHFDGYVFTQNGWVQSYGSRCVKPPVIIGDISRPEAITVNWATYAQSLTDKPVKGMLTGPVTILCWSFPREDISRETIAKQIALALRDEVDDLQKAGIGIIQIDEPALREGLPLRREEWQEYLEWAVDAFKLSAAIAEDDTQIHTHMCYCEFNDIMLSIAALDADVITIETSRSDMELLDSFEDFSYPNEIGPGVYDIHSPNVPSVEWIEALLRKAADRIPVERLWVNPDCGLKTRGWTETRQALANMVEAAKRLR

SEQ ID NO: 21289 - protein, 540 aa, Xenorhabdus nematophilus
MTPSEIKRLYFIVRVFLSYGLDELIPNIRLTWPLRFGRYFLFWLPNRHKDKPLGERLRLALQELGPVWIKFGQMLSTRRDLFPPAIADQLSMLQDRVVSFDGAVARKSIEIALGGPLETWFDDFDSQPLASASIAQVHTARLKENGKEVVLKVIRPDILPVIKADVRLMYRMAHLVPLLPDGYRLRPREVVREYEKTLLDELNLLREAANAIQLRRNFEDSSMLYVPEIYPDYCRENVLVMERIYGIPVSDIAMLEARNTDMKLLAERGVQVFFTQVFRDSFFHADMHPGNIFVSYERPEDPTYIGIDYGIVGSLNKDDKRYLAENFIAFFNRDYRRVAELHVDSGWVPADINVEDFEFAIRTVCEPIFEKPLAEISFGHVLLNLFNTARRFNMAVQPQLVLLQKTLLYIEGLGRQLYPQLDLWKTAKPFLEDWLHDQVGIPAIVRAFKEKAPYWAEKLPEFPELVYGALQQHKRLQTSIDQISQQLQKQQVSQKKSLYLLGIGATLFICGSLFFMTDKIHLSWWLMGAAVISWIFGWRR

SEQ ID NO: 21290 - protein, 325 aa, Xenorhabdus nematophilus
FPGRRMRRVRRHDFSRRLVAENQLTVNDLIYPVFVMEGINQRQEVSSMPGVYRLTIDLLLKEAEEIARLGIPVLSLFPAIEADKKSLDAQESYNPDGLIQRSIRALKNEVPELGLLTDVALDPFTTHGQDGVIDQDGYVINDITKEILVKQALSHAEAGAEIVAPSDMMDGRIGAIRDQLEVDGYINTQIMAYSAKYASCYYGPFRDAIGSSGNLKGGNKMTYQMDPANSDEALQEIAQDLQEGADSVMVKPGMPYLDVIRRVKDTFGVPTFAYQVSGEYAMHVAAIQNGWLKEQPAIMESLLCFKRAGADGVLTYFAKRVAQWL

SEQ ID NO: 21291 - protein, 386 aa, Xenorhabdus nematophilus
ENVVIIDGIRTPMGRSKGGVFRQVRAEDLSAHLMKSILKRNPSVQPEHIDDISWGCVQQTLEQGFNIARNSALLAGIPHSVPAVTVNRLCGSSMQSLHDGARMIMTGDASIAMIGGVEHMGHIPMTHGVDFHSKLNRNVAKAAGVMGLTAEMLAKMHGISREMQDEFALRSHLRAAQATESKAFSNEIAPIHGHDADGNLKFIDFDEVIRPDTNLKNLAGLRPVFDPVTGSVTAGNSSALSDGASAMLIMSESKAKELGLKARARIRSMAVVGCDPSIMGYGPVPATQMALKKAGLSLADIGLIELNEAFAAQSLACMKGLNLLDSMDDRINLNGGAIALGHPLGCSGARITTTLLNLMERKDVQFGLATMCIGLGQGIATIIERV

SEQ ID NO: 21292 - protein, 644 aa, Xenorhabdus nematophilus
MEKLASLYHEHIKILQRRAREILARNQLDALLIHSGESLRVFLDDCDYPFKVNAHFKAWVPVTKVPNCWLWVDGVNKPKLWFYSPVDYWHSVEALPNSHWTEEVELIHLAKADDIKAELSGLSKQNTAYIGEQTERAKNLGILEHNINPKMVLDYLSYHRSYKTDYELVCMREAQKTAVNGHLAAYDAFTSGVSEFEINMFYLMATGHRDTDVPYNNIIALNENAAVLHYTKLQQTLPSEIRSFLIDAGAEYNGYVADITRTYAAKHNNDFASLIKDLNGEQQAIIGSIKAGIRYTDYHINMHRRIAKLLKKHGIINGITEETMVEKGLTTPFFPHGLGHSLGLQVHDAAGFMQDDTGTHLAAPTLHPYLRCTRILEPRMVLTIEPGIYFIETLLAPWRENEYSKHFDWKKIDMFKLYGGIRIEDNIVIHDGKIENMTRDLQLSVMKPYLIPAASVNFTEEIKKSRFITLLEHTSGVNEAKLFIQSIKEQYPDARHHCWAFVAGAPDDSQQLGFSDDGEPTGTAGKPMIAQLIGSGMGEITAVSVRYFGGIKLGTGGLVKAYGNGVQQALKLLETEYKVPQKLYQLQCEYAYISMVEQLLQKFSGQVIASEYAENVTLQVSLPATLAGEIGDKLRDLSRGALFL

SEQ ID NO: 21293 - protein, 146 aa, Xenorhabdus nematophilus
MADKFRILLLNGPNLNLLGTREPETYGKLTLDDIVSKLSKEAHQSGVELSHLQSNAESELIERIHTARGDTDFILINPAAFTHTSVALRDALLAVDIPFIEIHLSNVHAREPFRHHSYLSDIAVGVICGLSADGYSFALQAAVNRL

SEQ ID NO: 21294 - protein, 452 aa, Xenorhabdus nematophilus
MVEQAEQSTLKRGLKNRHIQLIALGGAVGTGLFLGIAQTIKMAGPSVLLGYAIGGFIAFLIMRQLGEMVVEEPVAGSFSHFAYKYWGNFAGFLSGWNYWAMFILVGMAELTAVGMYIHYWWPEIPTWISAAIFFVLINAINLINVRLYGETEFWFSIIKVTAIIGMIIFGAYLLISGTGGPQASVTNLWQYGGFMPNGVSGLIMAMAVIMFSFGGLEMVGITAAEAEDPEKNIPKATNQVVYRILLFYIGSLSILLSLYPWMNVVEGGSPFVLIFDHLDNFWVSNILNVVVLTAALSVYNSGVYCNSRMLYGLAKQGNAPRILTKVNQRSVPVLSIGLSALATSIGVLVNYIMPGKAFELLMALVVTTLVINWIMICLAHLKFRTAKNAEGIKTKFQAFWYPFGNYLCLIFLAFILVIILMTPEIRISVILMPFWIGMLWGGYLFSKAKKAK

SEQ ID NO: 21295 - protein, 239 aa, Xenorhabdus nematophilus
RFENKVVVITGAGSGIGEATAKRFSQEGAIVVLVGRNVDKLNRVYSELSSSYARVIQADVSDQDSVKMMIDETIEHFGKIDILVNNAGLYIPSTILDTSLDDGKKVLAANLDGVIYCSHFALPHLLKSKGCIVNNASVSGIRADWGNAYYCTAKGAVVNLTRAMALDHGSQGIRVNAVCPSLIITPMTEYMSDDVLQKFDSRISMKRAGTPAEVASAIAFLASEDASFINGVNLPIDGG

SEQ ID NO: 21296 - protein, 424 aa, Xenorhabdus nematophilus
GRLTRATGLVLEATGIQMPLGATCLIERQNGSTVEEVESEVVGFNGEKLLLMPLEELEGIVPGARVYARSYGEDSAGGRRLPLGTELLGRVLDGSGRPLDGFPAPDTGYRALLTTPPINPLQRTPISDVLDVGVRAINSLLTVGRGQRMGLFAGSGVGKSVLLGMMARYTQADVIVVGLIGERGREVKDFIENILGVEGLARSVVVAAPADVSPLLRMQGASYATRIAEDFRDRGKHVLLIMDSLTRYSMAQREIALAIGEPPATKGYPPSVFAKLPALVERAGNGVSDGGSITAFYTVLTEGDDQQDPIADSARAILDGHIVLSRSLAESGHYPAIDIEASISRAMTSLIDNDHYRRVQQFKQLLASYQRNRDLINVGAYAAGSDPLLDRAIQLYPHMAQFLQQGMSERSEYDAACIQLQQLL

SEQ ID NO: 21297 - protein, 369 aa, Xenorhabdus nematophilus
LSPLQNEWLQVFEQFSATEIAPYADEWDLAEAIPATVVQKLAHNGWLGGLAKPENGGLGFDVTTFGLLNMAIGAGSGSLTGLLNVHAMVLKTIEDWGSQDQKQRFLAPLVKGEIIGAFAQTEVSAGGDSKNLSTQFAEDGNYLRANGQKSWITFAQIADLFLVFGKYQGLDTAVLVPKDTPGLKVTAKKNMLGFKSAYLAVLDFKDCRVPKTNIVGKPGFGQNLISNNALDYGRISVAWAALGIQQAALAASARRANSRITFDTLLADQGIIRGYLAEMSSSLLASQLICLSATKAKETRDEDALEQILQAKLFSSHEAGIAAAKAVQIHGGHGCDESNGISRLYRDAKILQVVEGSNELQKMLIGKAV

SEQ ID NO: 21298 - protein, 330 aa, Xenorhabdus nematophilus
VFLFPGVGAQQPDMFAAFRTYPEYRACLEEVSELSQVDLFSVIHGEQRDTLKQVRIAQLALTATTVAIAGILRTRCGLVPEFMMGHSLGQYPALCAAGYLDLATLTKVVNLRSEVVEACARRYEQGDMCWVLHLPAEVVVQAVDKARKDDGIELYVSAIDAFDQVTVSGVMADIRRFAPRMEALGGLLYPLKIGGPFHSPLMMEAQEKLAALLDFLPDTDKQGTLLSRLVCNVSGAELPAEDLKPSILQHLTSPVQWLRSLQYAAQNGVTRYLEISPKTVLSYLNQRAGLPMQPLCEPDEIFTFAEALSTAESRLERFFRHCYFHLYSSR

SEQ ID NO: 21299 - protein, 151 aa, Xenorhabdus nematophilus
MYHHYLNTPEGFPKPYVHITADDEGVTSIYFVNEKKELESKNTITKQCVKELQEYFKGKRHTFTVPLSMKGTEFQKRVWQQLCNIPFGDMWSYKQLALTLGSVNYCRAVGMANSRNPISLIVPCHRVIGHDGKLVGYTGGLDIKGWLLEHE

SEQ ID NO: 21300 - protein, 390 aa, Xenorhabdus nematophilus
IKLEVRNLYKIFGDHPEPAFKLLESGFNKEQIFEKTGLAIGVQNANLAIEEGEVFVIMGLSGSGKSTLVRLLNRLIEPTRGQVIIDGKDIAAISDTQLREVRRSKISMVFQSFALMPHLNVLENTAFGMELAGIPKKERHYKALETLKQVNLENYALSYPDELSGGMQQRIGLARALANDPDILLMDEAFSALDPLIRTEMQDEVLRLQGEHQRTIIFISHDLDEAMRIGDRIAIMQGGIIVQVGTPDEILNNPANDYVKTFFRGVDISHVFSAKDVARRRHEALLHIATGFGPRSALKVLDDEDRNYGYLIEKGQKFIGVVSVCSLQKALTEKQPIEYATLKEPAAVSADMPLHELISIVAQSPCAVPVVGDNDRYLGVISKGILLQAL

SEQ ID NO: 21301 - protein, 151 aa, Xenorhabdus nematophilus
LDMKRLSIFTILLFPITSFAVPNMWASGFGQGITEYLIISPENVVFNLNCTMNPDEQNILQHNVLIDLPDGTRLDSRDDKTTITVVTDDQQFPLPASLGWRNGDNAWIQFIDALGHAATFDVYVNDKKVGSFTPGIKNTEKELDDLSGCRN

SEQ ID NO: 21302 - protein, 535 aa, Xenorhabdus nematophilus
GITAQELAVYGICDVSEIVYNPSYELLFSEETQPSLQGYERGTLTHLGAVAVDTGIFTGRSPKDKYIVRDDVTCDTVWWADQGKGKNDNKPLSQETWSQLKGLVTQQLSGKRLFVVDAFCGANADTRLKVRFITEVAWQAHFVKNMFIRPSDEELVNFTPDFIVMNGAKCTNPQWKEQELNSENFVAFNLTERMQLIGGTWYGGEMKKGMFSIMNYLLPLKGIASMHCSANVGGEGDVAIFFGLSGTGKTTLSTDPKRKLIGDDEHGWDDDGVFNFEGGCYAKTINLSKEAEPDIYHAICRDALLENVTVLADGTVDFNDGSKTENTRVSYPIYHIENIVKPVSKAGHATKVIFLTADAFGVLPPVSCLTPEQTQYHFLSGFTAKLAGTERGVTEPTPTFSACFGAAFLSLHPTQYAEVLVKRMQASGAKAYLVNTGWNGTGKRISIKDTRAIIDAILNGDIEDADTIELPIFDLAVPTALPGVDTGILDPRNTYADKSEWDVKAKDLAQRFVDNFDKYTDTAAGAALVKAGPNL

SEQ ID NO: 21303 - protein, 375 aa, Xenorhabdus nematophilus
KPKKSVALSGVTAGNTALCTVGKNGSDLHYRGYDILDLATYCEFEEIAYLLIHERLPSRAELAAYKTKLKALRGLPSSVKAALEALPAVAHPMDVMRTGVSVFGCTLPEKEDHNLTGARDIADRLLASLGSILLYWYHYSHNGRRIDVETDDDSIGGHFLHLLHGQKPRDSWEKAMHASLVLYAEHEFNASTFTSRVIAGTGSDTYSAIIGGIGALRGSKHGGANEVSFEIQQRYDSPDKAEADILTRLERKEVIIGFGHPVYTVSDPRHKVIKEISLHLSKEAGTTQMFDIADRIESVMRDNKKMFPNLDWFSAVSYHMMGVPTAMFTPLFVIARTAGWAAHIIEQRIDNKIIRPSANYTGPENLPFTPIDQRK

SEQ ID NO: 21304 - protein, 621 aa, Xenorhabdus nematophilus
FQDFYQYSIDDPNAFWAEQARRIHWQHPFAQVLDYNNPPFARWFSGGKTNLCYNALDRWLETQPDAKALIAISTETNSEEVFTYQELYQEVNRAAAMMLSLGVKKGDRVVVYMPMVAEALFVLLACARIGAIHSVVFGGFASHSLATRLDNAEPVLVVSADAGSRGGKIIPYKPLLDEAIELAQHTPRHVLMVNRGLAAINWLEGRDIDFASLRQIHLDADIPVTWMESNETSCVLYTSGTTGTPKGVQRDVGGYAVALATSMDTIFGGKPGGVFFCTSDIGWVVGHSYIVYAPLIAGMATIMYEGLPTRPDASIWWQIVEKHRVNRMFSAPTAIRVLKKYPTDCIAKYDISSLEALYLAGEPLDEHTARWVAEIINVPVIDNYWQTETGWPIMAIARGLDDRPSRFGSPGFPMYGFNVKLINELTGQECGDNEKGMLVAKGPLPPGCIQTVYGDDTRFINTYWKHFAQQIYSTFDWGIRDSDGYYFILGRSDDVINISGHRLGTREIEECITSHEDVAEVAVIGIKDEVKGQAAVAFAVLKEGRKIQSADHFAALEKALMDLVDKQLGSVGRPARVYFVTQLPKTRSGKMLRRTMQAICEGREPNDIALIENSASLEMIR

SEQ ID NO: 21305 - protein, 378 aa, Xenorhabdus nematophilus
MAKKDYYEVLGISKPTEEKEIKKAYKRLAMKYHPDRNQGDKEAESKFKEIKEAYEILTDAQKRAAYDQYGHAAFEQGGMGGGAGGFGGGADFSDVFGDVFGDIFGGGRRQQRSSRGSDLRYNMDLTLEEAVRGVTKEIRIPTLESCDTCHGSGAKAGTNPETCSTCHGAGQVHMRQGFFTVQQPCPQCHGRGKVIKETCGKCHGHGRVEKYKTLSVKIPAGVDTGDRIRLGGEGEAGEHGAPAGDLYVQVQVKAHHIFERDGSNLYCEVPINFATAALGGEIEVPTLDGRVSLKIPAETQTGKLFRMKGKGVKSVRGGAQGDLLCRVVVETPVKLNDEQKDLLRKLGESLGGKSGETNSPRSKSFIDGVKKFFDDLTK

SEQ ID NO: 21306 - protein, 634 aa, Xenorhabdus nematophilus
MGKIIGIDLGTTNSCVAIMDGTTARVLENSEGDRTTPSIIAYTQDGETLVGQPAKRQAVTNPQNTLFAIKRLIGRRFQDEEVQRDVSIMPYKIIGADNGDAWLEVKDQKIAPPQISAEVLKKMKKTAEDYLGEPVTEAVITVPAYFNDAQRQATKDAGRIAGLEVKRIINEPTAAALAYGMDKEVGNRTIAVYDLGGGTFDISIIEIDEVDGEKTYEVLATNGDTHLGGEDFDSRLINYLVDEFKKEQGFDLRNDPLAMQRLKEAAEKAKIELSSAQQTDVNLPYITADATGPKHMNVKVTRAKLESLVEDLVKRSMEPLKVALNDAGLSVSDIQDVILVGGQTRMPMVQKTVADFFGKEPRKDVNPDEAVAMGAAVQGGVLSGEVKDVLLLDVTPLSLGIETMGGVMTALITKNTTIPTKHSQVFSTAEDNQSAVTIHVLQGERKRSGDNKSLGQFNLDGIQPAPRGMPQVEVTFDIDADGILHVSAKDKNSGREQKITIKASSGLNEEEIQQMVRDAEANAEADRKFEELVQIRNQADQLIHGTRKQVEEAGDKLTADDKAGIEKAVSELEVAVKGEDKAETEAKIQALVEASKKLLEIAQQQAQEGAAEAGTAKKDDDVVDAEFEEVKDKK

SEQ ID NO: 21307 - protein, 368 aa, Xenorhabdus nematophilus
YRKSCREFLESEIVPEHQAWEYNGLMARSFWERLGKAGLLGISVSPEYGGLGKHDYRFAVILTEELIRAGVTVPGIVAHNDIIASYIFALGSGEQKQKWLPELCLGKRVAAIAMTEPGGGSNTADIKTVAKRQGDHYLVNGGKTYITNGINADLIVVAVKTEQGQQGQGISLLVIERDMAGFSRGEPMKKIGWNGSDTAELFFHDCKVPVTNLIGRENLGNYYFMSAMPRERLSISAVAVASAEHILQSTLAYVKERKAFDQPIGSFQYNRFILAQLDTEVKIARIYLDNAVEQFSKGLFSLVDAARIKWWTTELQMKVADRCLQLYGGAGYMRDSVAGKNWLNSRAQTIYGGTSEVLQEMISKSMGL

SEQ ID NO: 21308 - protein, 534 aa, Xenorhabdus nematophilus
DYIVVGGGSAGCVAASRLSENGTKSVLLLEAGHASDVNDPASPLRDASRLVLEGYNWDYEANVRSEDRFADLISPSHYLQDEKKQEHKHRGRKLFNYRVGKVLGGSSAVNGAIAFRGFPSDFEQWVKMGCSRWSWEQVLPWFKHLENDVDRTGDDNHGSLGPMCLRRPQHEEIHPLDMAFAHACEQSGVPYVDDLNAGESPAVGPVPANVINGAERVDVYRSYLEPVLHRKNLRVMTDVLVAQIIFNGTVAAGVKVIQAGEEQIYHAEHIVLCAGAIGSATLLQRSGVGDPGHLRALGIPVIAELPAVGRNLTDHASVVLWSLPKTGVCTTGLPWRQIAARISSGYDTKVDVQIGLLNNVASETVPGFKDRVAYPMLVGASVMLMRPQALGRVFISTADPTVLPQIDLPLTRNPADIARLVGGVRKIWEVLRHPEVDAFLDGIQFWSHSMIYNDEIMNSAIKNLVNPGWHASGTLRMGADSDPDCATQEDGQVYGITGVTVADASLFPTIPSMPTNLTTIMTAERITSFLMERE

SEQ ID NO: 21309 - protein, 555 aa, Xenorhabdus nematophilus
LAQYVYSMHRVGKIVPPKRHILKNISLSFFPGAKIGVLGLNGAGKSTLLRIMAGIDNDIEGEARPQPGIKIGYLPQEPKLNLEHTVREAVEEAVGEVKNALTRLDEVYAAYADPDADFDKLAKEQGQLEAIIQSHDGHNLDNQLERAANALRLPAWDAKIEHLSGGERRRVAICRLLLEKPDMLLLDEPTNHLDAESVAWLERFLHDYEGTVVAITHDRYFLDNVAGWILELDRGEGIPWEGNYSSWLEQKDARLAQEASSEAARRKSIEKELEWIRQNPKGRQAKGKARLARFEELNNVDYQKRNETSELFIPPGPRLGDKVLEVTNLTKSYGDRVLIDNLSFALPKGAIVGIIGPNGAGKSTLFRMLSGQEQPDSGSITLGETVTLASVEQFRDSMDDKKTVWEEVSGGQDIMRIGNFEIPSRAYVGRFNFKGVDQGKRVGELSGGERGRLHLAKLLQVGGNMLLLDEPTNDLDIETLRALENALLEFPGCTMVISHDRWFLDRIATHIIDYQDEGKVAFFEGNFSEYEDYKKRTMGAEALEPHRIKYKKISK

SEQ ID NO: 21310 - protein, 819 aa, Xenorhabdus nematophilus
MRVLKFGGTSVANYQRILSVADIAESELSLGQVALVLSAPAKITNHLVAMIDKTVAGQDIVSNMSDVSQIFADLLSGLKEHQPNFGYEYLKGVVEREFAYLKQTLHGISLLKQCPDSINAALICCGEKLSIAIMGAVLQARGHKVTVIDPVKNLLAHGHYLESTVDIHESSKRIAALNIPAGHIILMAGFTAGNDNGELVVLGRNGSDYSAAVLAACLRADCCEIWTDVDGVYTCDPRAVPDARLLKSLSYQEAMELSYFGAKVLHPRTIAPIAQFQIPCLIKNTANPDVPGTFIGEGQKDENLPVKGITNLNNMAMINVSGPGMKGMVGMAARVFSVMSRKGISVVLITQSSSEYSISFCVPQKELTKAQKALTEEFYLELKDGVLDPIDVIDNLAIISVVGDGMRTQRGISARFFSALTRANINIIAIAQGSSERSISAVIDNDTATTAVRFCHQMLFNTAQVVEVFVVGVGGVGSALIEQIRRQQSWLKQKHIDLRVCGIANSRAMLTDMQGIGLDNWQQSLSEAIEPFSLSRLIRLEKEYHLLNPVIVDCTSNQSIAEQYASFLGDGFNIVTPNKKANTLSMAYYRQIRQAAEKSKRKFLYDTNVGAGLPVIENLQNLLNAGDELVQFNGILSGSLSYIFGMLDEGMTLSQATLLAKEKGFTEPDPRDDLSGMDVARKLLILARESGYELELEDIHVEPVLPAAFDASGDVGRFLQRLPQLDQEFTHRVADAAKQGKVLRYVGIIEQGRCRVKIAAVDGNDPLYKVKNGENALAFYTRYYQPIPLVLRGYGAGNDVTAAGVFADILRTLSWKLGV

SEQ ID NO: 21311 - protein, 317 aa, Xenorhabdus nematophilus
MTDKLTSLRKLTTVVADTGDIAAMKLYQPQDATTNPSLILNAAQIPEYRQLINEAIEWARGQSDSREQQIIDAGDKLAVNIGLEILKLIPGRISTEVDARLSYDTEASVAKAKRLIKLYNEAGISNDRILIKLASTWQGIRAAEQLEKEGINCNLTLLFSFAQARACAEAGVYLISPFVGRILDWYKANGDKKEFAPHEDPGVISVAEIYQYYKEHGYNTVVMGASFRNSGEILELAGCDRLTISPALLKELSETAGEVECKLGYEGEIKARPARLTEAEFYWEHHQDAMATEKLAEGIRKFAVDQGKLESMIADLL

SEQ ID NO: 21312 - protein, 578 aa, Xenorhabdus nematophilus
KVLIANRGEIAVRIIRACRDYGVQTIAVYADADINAQHVQLADEAYGLSGNSPAATYLNIPRLLAIAKQSGATMVHPGYGFLSERAEFARAVMDAGLIWIGPNPETIDELGDKVNARKIAHKVGAPLVVGTSEPVKDAQEVVAFAEEHGLPIAIKAAFGGGGRGLKVAWRLDEVAELYHSAVREATAAFGRGECFIEQFLDKPRHIEAQIIADKQGHVVVVGTRDCSLQRRNQKLVEEAPAPFLTQQQRERIHQAAKAICAEANYVGAGTVEFLLSADGTLSFLEVNTRLQVEHPVTEETAGIDLVIEQLRIAEGHPLSIQETPVPRGHSFEFRINAEDAGKGFLPMSGVISEFTPPSGPGIRLDSGVISGSTIPATLDSLMAKLIVTGTTREQAISRARRALREFRIRGVASVLPFHQAVMEHPDFVSDEIFNVHTRWIETDFANEIEALPRQIVTEDNSITRTYIEIDGRRHELGLSADLFAGFSHLAPVREQQSSQSAIKEKMPADSRQVKAPISGILHSWIVKEGEQVNEGELIAVMEAMKMEVQINAHRAGKITFCVQAGDYQDAESTLAHIE

SEQ ID NO: 21313 - protein, 242 aa, Xenorhabdus nematophilus
EMKNLKMEVMRYNPEIDSEPHFVTYEVPYDEQTSLLDALGYIKDNLAPDLSYRWSCRMAICGSCGMMVNRVPKLACKIFLRDYPQGMKIEALGNFPIERDLVVDMTHFIESLEAIKPYIIGNDRKPADGPNVQTPAQMAKYHQFSGCINCGLCYAACPQFGLNPEFIGPAAVTLAHRYNLDNRDHGKKERMPQINSDNGVWSCTFVGYCSEVCPKHVDPAGAIQQSKAESAKDFLISMLKPQ

SEQ ID NO: 21314 - protein, 598 aa, Xenorhabdus nematophilus
VQTFNADLAIIGAGGAGLRAAIAAAEANPQLKIALISKVYPMRSHTVAAEGGSAAVTQSHDSYDFHFNDTVSGGDWLCEQDVVEYFVKHCPTEMIQLEQWGCPWSRKEDGSVNVRRFGGMKIERTWFAADKTGFHMLHTLFQTSLKYPQIQRFDEHFVLDILVDEGQVRGLVALNMMEGTKVQIRANAVIMATGGAGRVYRYNTNGGIVTGDGMGMAFRHGIPLRDMEFVQYHPTGLPGSGILMTEGCRGEGGILVNKDGYRYLQDYGMGPETPLGQPENKYMELGPRDKVSQAFWHEWQAGRTIATPRGDVVHLDLRHLGEKKLLERLPFICELAKAYVGVDPVKEPIPVRPTAHYTMGGIETNPQCETRIKGLFAIGECASVGLHGANRLGSNSLAELVVFGRLAGEEAVRHIQQTTPANENALDAQARDIENKLNKLLNQKGIESWAKIRDELGISMEEGCGIYRTPELMQKTMDKITELKERFRHIEITDRSSVFNTDLLYTIELGFGLDVAECMAHSAMNRKESRGAHQRLDAGCTERDDENFLKHTLAFYNPEGAPRLEYSDVKITISKPAKRVYGGEAAAQDKQQKEQANG

SEQ ID NO: 21315 - protein, 365 aa, Xenorhabdus nematophilus
MLKVIQSPSKYIQGPGALSHIGQYTKILADHVFVIADNFVMSLIGDAVSKSLEAHAVTSHFEIFNGECSRGEIKRLSDISASHQCQAVIGIGGGKTLDTAKAIAHACRLPVIISPTIASTDAPTSALSVLYTELGEFDGYLLYPQNPNIVLMDTRIIAKAPVRLLVAGMGDALATYFEARANSAAHKPTMAGGATSNTGLALAKLCYDTLLAEGYKAKLAVEAGVSTPAVENIIEANTYLSGIGFESAGLAAAHAIHNGFTVLEECHHLYHGEKVAFGTLAQLMLENSPNEELETVLDFCVQVGLPVTLEQLGLRDSEKLHQKIMEVAKASCAEGETIHNMPFKVTPEQVYAAIMAADRMGMDWL

SEQ ID NO: 21316 - protein, 709 aa, Xenorhabdus nematophilus
CSHDHAPTIQDTTPLELTANQRFNWIIHGMDCPSCAGKIENAVKKLPEAKQVRVLFTTEKLVVDADSDIRAAVEQAVKQAGFEIKQTDSTIRLPPAANHWKTFSPILILIALMVISWGITKINPPAGQIAFIVTTLIGLYPVATKAIKLIRSGTPFAIETLMSVAAIGALFIDATAEAAMVILLFKVGEVLESYAAGRARRGVSALMALVPEQALRVTGGEKKTVPAADLRPGDIIEIAPGARLPTDAELLSPFASFDESALTGESIPVERQQGEKVAAGCLSVDSAVQMRVFSEPGHNAIDRILQLIEEAEERRAPIERFIDRFSRIYTPLIILFSVLVVVIPPLLLAEPWETWIYRGLTLLLIGCPCALVISTPAAITSALAAATRRGALIKGGAALEQLGSVTTIALDKTGTLTEGKPRVTEIEPVENISVETLLALAGAVESGSHHPLAKAILNAAENKGVTVVEAEHRKALAGIGVEGRLSGQKILVAAPGRLPENTLSTAWKQRVTELESNGKTAVAVVQGEQFVGLIAMQDTLRQDAIDAIRALKKQGVNAVMLTGDNPRAAAAIAAQLGIDYRAGLLPEDKVKAVTELNEKHHTMMVGDGINDAPAMKAASIGVAMGSGTDVALETADAALTHNRLTGLPEMIALSRTTHYNIRQNITIALGLKAIFLITSLLGITGLWMAVLADSGATALVTANAIRLLR

SEQ ID NO: 21317 - protein, 513 aa, Xenorhabdus nematophilus
IPSPVLQSDRYTEETYEKVKYKPDGSGTNLSYTATRVCKPMYNQYERDPAKPKLSAYITDWCQYDARLDDKNENPEDRGRGFNLSTIDPTTYDKLIFSFLGICGDIGVKKEKVKEVWDGWNSQTDQKITEGHIVPLDPYGDLGTARNVGLPESSKNTSINAGTFLPYYQQSKAAGLLGGLRELQKRARAAGHKLELAFSIGGWSLSSYFSKMAENEGQRTVFINSVVDFFERFPMFSCVDIDWEYPGAEGDVHNIISENDGKNYALLVKELRTALDNRFGTGSKEISIACSGVKAKLAKSNIAELVKNGLDNIFLMSYDFFGTGWANYIGHHTNLYSPNEPDPNGEYDLSAEAAINYLHQDLGIPLSIINLGYANYGRSGKGAKLETRLYDKPGDALGTMEKGAPEFFDIVNNYMDSEHTLSTGKNGFVLMTDTNADADFLFSEKQGHFISLDTPRTVKQKGEYVTGHQLGGIFSWSGDQDCGLLANAAREGMGYIAKSNHETIDMGPLYNPG

SEQ ID NO: 21318 - protein, 511 aa, Xenorhabdus nematophilus
TQKTYQLNGYDPATSTDILTYTATRMAKTVFNTYHDDDEFSIACYFTDWAQYDGRAVEASPSDEVFRNQGGRSADLTRIKGDSTNGSPFKKLIFSFAGIVGDEGPKGNIILKAAKDWGFGADEAETLKNYTGWPIPIDPWGDVSTYFNCGFDSGASGAAKDVYNQEKATGLLGGFNSLKKADPNLEVSVSIGGWSMSGAFYEICRSDAYRKQFIDGVKNLFCRFSMFNHIDIDWEYPGSAGMGNPFDKDDYVYYKKLIEELTAAKIPNLQGISIAASADPQKIDDAHIPELMEAGVTGINLMTYDFFTLGDGKLSHHTNLYRNKNDQHSKYSIDDAVQHLITQGVDKKKIFIGYAGYTRNAKGANITSKSPLQGTYNGQGNIVGTFESAVIEWTDIIYNYVDFENGIGRNGYEIIQDNVAKADYLYNQDLKVFMSLDTPRSVREKARYVKEKGLGGLFIWSGDQDNGLLTNAAHEGLGRPVKKSVIDMSPFYFDNDDLPSYDKPKEPQCKD

SEQ ID NO: 21319 - protein, 295 aa, Xenorhabdus nematophilus
VVVMGSATGDIVLRLSELPHSGEYWEAEEVDRQVGGCAFNVVRALCRLQIPVINGIFVGNGVWGERVTEEMEMLGLTVTLRHPKRDNSWCIAMMTPDDKRIYVSVPGCDDSWNADILATIPLPEQGHIYSSGYELANPKADVLREWLLASPSGLTLVLDFGPRLPDIDREFIQALPAERTILSLNLDETAMLCGAGDPVVQAGRYVNERGFTAIVRLGAEGAWICQPGCEPEYIPAYQVNVADTIGAGDAHCGGMLAGLSQGMSLRDAVELGNRVAAVTVSRSGSDGAPTKDELM

SEQ ID NO: 21320 - protein, 373 aa, Xenorhabdus nematophilus
MKSLRLAIVRQKYRPDGGAERFVTRALEALNHQQLELNIITRSWQGESNPNWNIHLCNPIKFGRISRERGFAKAARNLWQKEQFDLVQSHERIAGCDIYRAGDGVHQRWLHQRARILPKWKAHWLLNNPYHRYVMNAEEEMYSSPSLKQVICNAEMIKKEIIEEFSLAEDKISVIYNAIDSTKFFPAHEQTRLQLRQQYNIPTTAKCLIYVGSGFERKGLSAAIKTIAKTGDYLLVVGKDKEQVKYEELANTLGCQHRIRFMGLQKNTLLLYQMSDALLLPTLYDPFPNVILEAMACGLPVITSTTCGGAEFITEGKNGFICDALDIGKLEEAVYCLPNNILGTDMSISARNQVINSTPENLSQQLIQLYQRV

SEQ ID NO: 21321 - protein, 398 aa, Xenorhabdus nematophilus
MSASFYQKMNEQLEQTRAEGLFKNERIITSAQNADITVADGSQVINFCANNYLGLANHPDLIAAAKAGLDSHGFGMASVRFICGTQDSHKELENKIAEFLGMEDAILYSSCFDANGGLFETLFGPEDAIISDSLNHASIIDGIRLCKAKRYRYANNDMQELRAQLEKAKADGAENILVATDGVFSMDGVIADLKSVCDLADEFDALVMVDDSHAVGFVGKGGRGTHEYCDVMGRVDIITGTLGKALGGASGGYTAARKEVVEWLRQRSRPYLFSNSLAPSIVAASIKVLDMLKHGDELRDRLWRNANLFRAKMTAAGFTLAGADHAIIPVMLGDAKLAQEFAAELLKEGIYVIGFFYPVVPKDQARIRTQISAAHTEEQIEHAVAAFIRIGKQLNVIA

SEQ ID NO: 21322 - protein, 341 aa, Xenorhabdus nematophilus
MKSLSKLKPEEGIWMADVPTPELGHNDVMIKIRKTAICGTDVHIYNWDDWSQKTIPVPMVVGHEYVGEVVAIGQEVKGFNIGDRVSGEGHITCGHCRNCRGGRTHLCRNTTGVGVNRAGAFAEYLVIPAFNAFKIPDNIPDELAAIFDPFGNAVHTALSFDLVGEDVLVSGAGPIGIMAAAVCKHVGARHVVITDVNEYRLDLARKMGVTRAVNVSKENLTDVMKELGMTEGFDIGLEMSGAPQAFRTLLSTMNHGGRIALLGIPPSDMAIDWNQVIFKGLFIKGIYGREMFETWYKMAALIQSGLDLTPIITHQFSIDDFQKGFDIMRSGQSGKVILNWD

SEQ ID NO: 21323 - protein, 330 aa, Xenorhabdus nematophilus
ASMTVIGAGSYGTALAITLARNGHEVVLWGHNPQHIHALQQARCNQAFLPDISFPDNLLLEADLKNAVSTSSNILIVVPSHVFGDVLQQIKPYLQPDSRIVWATKGLEAETGRLLQDVAREILGNEIPLAVVSGPTFAKELAAGLPTAIAVSATTPEFGEELQQLFHCGKSFRVYKNPDFTGVQLGGAIKNVIAIGAGISDGMGFGANARTALITRGLAEMSRLGIALGADPSTFIGMAGLGDLVLTCTDNQSRNRRFGMMLGQGISVDDAQREIGQVVEGYRNTKEARALAERAGVEMPITEQIYQILYCNKNVIEAAQTLLGRATRDE

SEQ ID NO: 21324 - protein, 388 aa, Xenorhabdus nematophilus
MDITIAGIGYVGLSNGILLSQKHKVIALDISEEKVNLINKKKSPVVDKEIEFYIKEKKLDLIATLDKKLAYENADFVIIATPTDYDPKTNYFNIKSVESVIEDVLYYNPTAIMIIKSTIPVGFTKQMREKYNTDNIIFSPEFLREGRALYDNLYPSRIVIGEKSERAQLFSDLLLEGAIKKDIPILFTESTEAEAIKLFSNTYLAMRVAYFNELDSYAEINELNTRQIIEGVSLDPRIGNHYNNPSFGYGGYCLPKDTKQLLANYQKVPNNIINAIVEANRTRKDFIADSILSKNPKIVGVYRLIMKSNSDNFRASSIQGIMKRIKAKGIEVVIFEPEMTDEYFFNSKLIRDLEYFKSISDIIISNRMSEELKDVKEKVYTRDLFGND

SEQ ID NO: 21325 - protein, 193 aa, Xenorhabdus nematophilus
NVVWHSHTLDRKQREVVNGHPALVIWFTGLSGSGKSTLAGALEQALFSRGIKTYLLDGDNLRHGLCSDLGFSETERRENIRRIGEVSKLMVDAGLVVLTAFISPHRAERQKLRELMGADRFIEVFVDTPLAICEARDPKGLYKKARAGELLNFTGIDSAYETPEQPDIYLDGSLPVESSIEKLLAALHNHNFL

SEQ ID NO: 21326 - protein, 243 aa, Xenorhabdus nematophilus
MSQLHLAELLALNHDQRAEALADINQQLELLDARQRVSWALEHLSGEFVLSSSFGIQAAVCLHLVTQEYPDIPVILTDTGYLFPETYQFIDKLTDELKLNLTVFRAELSPAWQEARYGKLWEQGVEGIERYNQINKVEPMNQALKSLHAQSWFAGLRRQQSESRANLPVLAVQRDVFKILPIVDWDNRRVHQYLAQQGLEYHPLWEQGYLSVGDTHTTQKWQPGMSEEQTRFFGLKRECGLHE

SEQ ID NO: 21327 - protein, 572 aa, Xenorhabdus nematophilus
NMSNEKQGPLKVEGKLADSERMKLNSDYLRGTISEDLKNGLTGGFEGDNFLLIRFHGMYQQDDRDIRAERTEQKLEPRHAMMLRCRLPGGIITPSQWLGIDQFATEDTLYGSIRLTNRQTFQFHGILKSNLKPAHQLLAKMGLDSLATANDVNRNVLCTSNPVQSALHQQAYEWAKKISEHLLPRTSAYAEIWLDKEKVATTDEEPILGSTYLPRKFKTSVVIPPQNDVDLHANDLNFIAIAENDQLIGFNVLVGGGLAMTHGDKKTFPRLASEFGFIPLKHTLAIAEAVVTTQRDWGNRTERKNAKTKYTLERVGVDTFRQEVEKRAGVHFEAIRPYEFTGRGDQIGWLKGIDDQWHLTLFIENGRLLDYPGKPLKTGIAEIAKIHKGDFRLTANQNLIVAGVPESEKARIEEIARTHGLIDNSVTFLRHHSMACVSFPTCPLAMAEAERFLPTFVDYVDALMEKHGVSDEHIVLRVTGCANGCGRAMLAEIGLVGKAQDRYNLHLGGNRIGSRIPRMYRENITSAEILVILDELIGRWSAERNVHECFGDFLVRADIIKPVLNSALDFYD

SEQ ID NO: 21328 - protein, 122 aa, Xenorhabdus nematophilus
IMSTTIFKDFQFEAAHRLPHVPEGHKCGRLHGHSFMVRLEITGEVDPLSGWIMDFADVKVAFKPIWERLDHNYLNEIPGLENPTSEVLAKWIWEKLKPTLLPQLSAVMVKETCSAGCIYRGE

SEQ ID NO: 21329 - protein, 467 aa, Xenorhabdus nematophilus
  unsure (1)..(467): unsure at all Xaa locations
MQHNENQLKQGLSVRHIRFMALGSAIGTGLFYGSAAAIQHAGPAVLLAYLIGGAAVFMVMRALGEMAVHHPVSGSFSQYASHYLGPLAGFLTGWIYVLEMLFVCLADITAFGMYMRLWFPHVDQWIWVLGIVCFIGALNLCHVKIFGEMEFWLSIVKVTAIIAMIIGGIIIMIYGFGQSTEHATGISNLWEHGGFMPNGISGVVASFAIVMFAFGGIEVIGITASEAKNPEKTIPKAINAVPFRILIFYVLTLCILMCIYPWNQIDQNASPFVQIFSNLGINSAANILNVVVITAAISAINSDIFGAGRMMYGMAQERQAPEAFKKLTRNGVPWMTVLVMTIVLLLGVWLNFLIPNDIFILIASVATFATVWVWLMILISHVAMRRQMSAKDIKSLKFPVPMWPIAPAITIVFMVGVIMLLGYFEQTRDALYVGIGWVLVLTLAYFFLCEEEIIKKSSFYXPIRLEK

SEQ ID NO: 21330 - protein, 642 aa, Xenorhabdus nematophilus
LYSMKETAMNDNIARKMRQTYNIAYWGGGYYYVNDLGNVSVCPNPDLPEAQVELTELVKKVQEEKKQLRLPSLFCFPQILQHRLRSINAAFKRARESYGYKGDYFLVYPIKVNQQRRVIESLANAGEPIGLEAGSKAELMAVLAHAGMTRTVIVCNGYKDREYIRLALIGEKLGHKVYLVIEKMSEIAMVLEEAERLSVIPRLGVRARLASQGAGKWQSSGGEKSKFGLAAAQVLQLVETLRSAGKLNSLQLLHFHLGSQLANIRDVATGVRESARFYVELHKLGVNIQCFDVGGGLGVDYEGTRSQSECSVNYGLNEYANNVIWGIGDACEEHGLPHPTVITESGRALTAHHTVLISNVIGVEHNEFTETTPPAEDASRPLASLWDTWQEMQDGGYSRSLREWLHDSQFDLQDVHTQYAHGMLNLSERAWAEELYLNICRHIQRDLDPSNRAHRPFIDELQERMADKFYVNFSLFQSMPDAWGIDQVFPVLPIEGLDKPLDRRAVLLDITCDSDGIIDHYVDGDGIAATMPMPAYDPENPPLIGFFMVGAYQEILGNMHNLFGDTAAVDVYVSEHGEVTYLQSEEGDSVANMLQYVKLEPQVLMSRFCDQVKAADLDENLQEQFLQEFESGLYGYTYLEDE

SEQ ID NO: 21331 - protein, 384 aa, Xenorhabdus nematophilus
MTTHLFTSESVSEGHPDKIADQISDAVLDAILEQDPKARVACETYVKTGMVMVGGEITTSAWVDIEEITRRTVREIGYTSSDMGFDANSCAVISAIGKQSPDINQGVDRADPLEQGAGDQGLMFGYATNETNVLMPAPITYAHLLVERQAQVRKNGILPWLRPDAKSQVTFQYDNGKIVGIDAVVLSTQHSEDIQQKELQEAVMDEIIKPVLPAEWLTPMTKYFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPTSTLIQLVREFFDLRPYGLIKMLDLLHPIYRDTAAYGHFGREHFPWEATDKAEILRSAAGLK

SEQ ID NO: 21332 - protein, 415 aa, Xenorhabdus nematophilus
KKPLYQILYIQVIFAILLGIALGHFYPDIGESLKPLGDAFIKIVKMIIAPVIFLTVVTGIAGMNNMKAVGSVVGKSMLYFLTFSTLALIIGLIAANIIRPGDGLNISPESLDSSKVIGYVEKAHESSIVGFLMNIIPETVVSPLVNGNILQVLFIAVIFGIALASTGKKGEPILVFLQNFSEPVFKMVGILMKLAPIGAFGAMAFTIGKYGISSIGNLMMLIVTFYMTSLLFIFVVLGAVAKYNGFSIIKLIKYIKDELWLVLGTSSSEAALPSLMRKMENAGCEKSVVGLVIPTGYSFNLDGTNIYMTMAALFIAQATGIELSFTEQISLLLVAMISSKGAAGVTGAGFITLAATLSVVPSLPVAGMALILGIDRFMSECRALTNLVGNACASIVVARWENALDKDKMHQALNG

SEQ ID NO: 21333 - protein, 491 aa, Xenorhabdus nematophilus
KLHNIAKEMLPAKSYKMLINGEWVDSVSRETRKSYNPATGELLTEYAAGNAQDVELAVKAAQKALPAWSKESATEKQSLLLKIADLLEAESERFITLEALDAGKTLNLCRTFDIPFAVDHFRYFAGVIRAHSDEADVIDADTLSLVIREPIGVVGQIIPWNFPLLMAAWKLAPALAAGNTIVINPASLTSISLLEFGRILNQVLPAGVVNIVTGRGSSVGQAILDHEGIDKVAFTGSTEIGYNVAAAAARRIIPATLELGGKSANIIFPDANMKKAVKYAADGILLNQGQACESGARLFLHKDIHDEFLKSLKAVFESVRVGDPMMTETEMGCQISQEQMDFILGYIDLAKQEGATVLTGGNRITGAGYDDGFFVQPTIITNVTNKMRVAQEEIFGPVLCVIPFSSEEEVVEMANDSEYGLGGAVWTQDINRALRVAKAVQTGRMWVNTYHALPAHAPFGGYKKSGLGRETHKMSLDAYTQVKNIYISTKE

SEQ ID NO: 21334 - protein, 446 aa, Xenorhabdus nematophilus
SNKRGLIILALDIILLVALLKFLPYGEKTNAGLALMAFVGVLWLTEAIHVTITALCIPILAVGMGLMNTGDALQSFANPIIFLFFGGFALATALHIQGLDRLIANRLLMIARGRLSVAVLLIFGITAVLSMWISNTATAAMMLPLILGILANLDVRTERNTFVFVLLGVAYSASIGGLGTLVGSPPNAIAAAQLGMDFFTWMKYGVPMVIILLPVMVAVMYIMLRPNLKHKFDLKLEHLEWNSKRIITMAIFLLTVFSWIFSSIISDAFGGIKDLDTIIAVSAAILIGITGVSTWSQIQNNTEWGVLMLFGGGLTLSAVLKNSGASEVMANGMAATFGASHWFVIILAVTAFIIFLTEFTSNTASAALLVPIFATVAEALGMPVMALTMIIGIGASCAFMLPVATPPNAIVYGSGYIKQIEMVRVGMVLNVVCIAIISVVAWFFWL

SEQ ID NO: 21335 - protein, 424 aa, Archaeoglobus fulgidus
MAVIVGAARTPVGRFGGSLKDVAAYELGAVAIKGMLKKLGVAPKPTPESIEFYPEKLEKGRIDLESAYDYDGVEVEIDEVIMGNVLQAAQGQNPARQASILAGIPKEIPAYTVNKVCGSGLKAIALAYHAVKAGDAKAIIAGGMESMSNAPYALPKARWGYRMSVTAKDEILDLMVYDGLWEKFYGYHMGMTAENIVERYGISREEQDQLAYESHMRAVRAIDEGKFAQEIVPVEVKQKKGAVVVDTDEHPRRDTSLEKLAKLPPVFKKDGTVTAGNASGVNDGAAAVLVMDEKAAKDYGLEPKVRILAVASAGIDPAYMGLGPIPAIRKVLKKAGPEIKDIGLIELNEAFAAQALACIKELGLDMEKVNVNGSGISLGHPIGCTGARITTTLIYEMERRGVDYGLASLCIGGGQGMAMVVERV

SEQ ID NO: 21336 - protein, 165 aa, Archaeoglobus fulgidus
MSELSKLTFVHDRRKCIGCYACVIACKVEHSSENFDDPGRIRVFHDGPRITGEKVQQHFKVVVCRHCLSAPCVDECPTGALRKSEDGMTVLDLDLCIGCKICMEVCPFGAPQLGDDGKVRIYDLCMPRIEEGKKPACVSACVAQCLQVKSVEDLKKKSKTRKPEG

SEQ ID NO: 21337 - protein, 741 aa, Archaeoglobus fulgidus
MDGADNRPHVHLFWLRILRSQKKKVIPSIFLRGAEMSEHVVKTTCKSCHGGCRVLVKVKSGKIVHIEGDPSSLTRGTMCPKGLASIKEVYNPSRLKYPLKRVGERGEGEWKRISWKEALDTIAEKMKEYIEEYGPSSILIGQGTGRGYNRYTFRFARSIGSPNVLLPAHFCYAPRLAAFGITVGGRLYCDYHGWGGEYPKTIVHWGKQLEYTNADGEMAVWFLRALEEAEHFILVDPKATPVAHRADLWLPVRPGTDAALALGMLNVIISEELYDKDFVEQWTHGFDRLRERVEEYSPDKVSRITWVPEDKIKLAAEWFATSRPGCIQIGQALEAGNNSIQTLRAIICLMAVTGNIERPGGMVNWVPPETGEMEEFALEVPPPEELPIGADRYKLLALPPFAMCHFESVCEDLLNGERRIKMMHLQGTNPVLAYANSKDVLKALLNVEFISVVDLYMSPTAKYADIVLPAAHWLETDDIYDMHPRFFVSAIVRAVEPVGEALPDNVIFNELGKRLAPKYWFSDVYEMLNYQLRKAGITWEEFKEIGVLARTGKEHYYKYKTNYWREGGGFPTPTGKIELYSTILENLNYDPLPHYREPNESPYSTPELSEKYPLILSTGGRVPYYFHSQYRQNPWLRELQPDPVALIHPETAEKYGIKDGDWIWIETPRGRIRQRARLFEAMNPRYVFAQASWYYPEKPDLGIFESNANVLTSNKPPFDPCIGSTTFRAMLCRIYRCDGGE

SEQ ID NO: 21338 - protein, 315 aa, Archaeoglobus fulgidus
MGVKVACIGAGTVGASWASLFAWRGCDVAVYDPFPEALNRAEASIARTVSTLSEIFSGSEDDVKSALSRVKFTENLEEALKGAYYVQESAVEKLEVKRDLFEKMDAIAEPETILATSTSGLSISEIQTAARKHPERCITAHPYNPPHLIPLVEVVPRKQTDESCTEKTVEFMERMGKKPIVVKKDVPGMVANRLAAALWREAVNLVYQGIATPEEIDVAVKYGPGIRWAITGVYLTYHLGGGQGGMKYFLEFFDDHYRRLWSDLANWSEYPEGSFDAILKSMEGYDIIKRMSYDELAKWRDDQLAKILKLILEDG

SEQ ID NO: 21339 - protein, 281 aa, Archaeoglobus fulgidus
MVKEVFESIEDYEKSLEERIQSGSMGYRKMFDLTGKVAIVTGATGGLGGPIALGLADFGCDVVVVGRRLEVLEKLKESIEKLGQRALAVKCDITSEEDVANLVNRTVEEFGRIDILVNCAGINIPKPAEEYPLEDWNKVMDANVTGVFLVCREVGKVMVKQNGGKIINVSSVRSSYGMPKNYIAYCSSKAAVNMITKQLACEWAKYNILVNAIAPTVIATPLTAHIMKDPELSKTMKSRILLGRWGYPDDLIGAVVFFASDASNFVTGQILYIDGGVTSWA

SEQ ID NO: 21340 - protein, 103 aa, Archaeoglobus fulgidus
MEFCPKCKSLMIYQGDKLVCRKCGYEKEADDSEELVIKVERNKEDVPVIEGENLKTLPTTKAICPACGHNEAFWWLRQLRAADESEVRFFRCTKCGKTWREYD

SEQ ID NO: 21341 - protein, 418 aa, Archaeoglobus fulgidus
MKLDKSRKLYAEALNLMPGGVSSPVRAFKPHPFYTARGKGSKIYDVDGNAYIDYCMAYGPLVLGHANEVVKNALAEQLERGWLYGTPIELEIEYAKLIQKYFPSMEMLRFVNTGSEATMAALRVARGFTGRDKIVKVEGSFHGAHDAVLVKAGSGATTHGIPNSAGVPADFVKNTLQVPFNDIEALSEILEKNEVAALILEPVMGNSSLILPEKDYLKEVRKVTAENDVLLIFDEVITGFRVSMGGAQEYYGVKPDLTTLGKIAGGGLPIGIFGGRKEIMERVAPSGDVYQAGTFSGNPLSLTAGYATVKFMEENGVIEKVNSLTEKLVSGIADVLEDKKAECEVGSLASMFCIYFGPTPRNYAEALQLNKERFMEFFWRMLENGVFLPPSQYETCFVSFAHTEEDVEKTVEAVSESL

SEQ ID NO: 21342 - protein, 289 aa, Archaeoglobus fulgidus
MKLIVGTRGSKLALAQTNKVAERLKERYEVEIRIVKTAGDIMKDKPLYEFKGMGAFVRALDTALAEGKVDVAVHSFKDVPSQRVEGTVVAAVIERDSPCDVLISRDGSTLEELDEGAVVGTSSLRRRAQLSRLRGDLRFENLRGNLDTRLRKLREGNYDAIVVAEAGLKRLGLDREVEYQPFPPEVIVPPANQGIIAIATRKGEEDLVAFLNDEKTWLEAMVERAVIKELGVGCAVPVGVYAEAQSRVRLICEILDKKYLRVEEKLSKDTAVEEAAEIGKDLRKEIYGG

SEQ ID NO: 21343 - protein, 307 aa, Archaeoglobus fulgidus
MKHLLSMADLEKDELFEILKLAEKLKEERYKGVVTDYLKNKSLAMIFELPSTRTRVSFEVAMTDLGGHALYLGWDELQLGRGEPIKDTARVLSRYVHAVMMRVREHSTIEEFARYSTVPVINGLSNLEHPCQVIADLLTIYEYRGDFKDVTLAWVGDGNNVCNSMILAAALTGMKMVISTPENYDPNPEIVKKAEEMGAKLRFVRDPKEAVKEADVIYTDVWTSMGQEAEKEARLKAFQPYQVSDELLKFSKDDVVVMHCLPAHRGEEITDEVMEGKHSIVFDQAENRLHAQKAILLKLLGKESEVY

SEQ ID NO: 21344 - protein, 358 aa, Archaeoglobus fulgidus
MKAALALEDGTYLEGKAFGAERGGLGEIVFCTSMTGYVEALTDPSYKGQILMMTYPLIGNYGVNREDFESDGVKVEGFVVKELCKNPSNWRSEMSVDELLKQYDVPGIEGVDTRMLTRKIRIYGSMKAAIGIGDVDREKLVRKAVEQPFISDIDLVDKVCVKEAKRFESDGDLEVVLVDCGVKMSIVRQLLKRGVNLTVVPYDFPAEKIKEMNPDGVFISNGPGDPARVKPTIETIRKLAGQIPMAGICLGHQLTALALGAKTFKLKFGHHGSNQPVKDFETGRVFISSQNHNFAVDTKTLPKEFEVTQINLNDHTVEGMVHKDFPLITVQYHPEAGPGPHDTYFFFDRYVDMLREYR

SEQ ID NO: 21345 - protein, 1076 aa, Archaeoglobus fulgidus
MPKREDIRKIMVIGSGPIVIGQAAEFDYSGSQACKALREEGYEVVLVNSNPATIMTDPEMADRVYIEPLDAEIVAKIIERETPDALLPTLGGQTALNLAVQLTEMGVLDKYGVELIGAKFEAIKKAEDRELFKEAMRKIGLDVPKSDVAHDVSEALAIADEIGYPVVVRPAFTLGGTGGGIAYNREELREIAERGIKMSMINQVLIEEGVLGWKEFELEVMRDLADNVVIICSIENFDPMGVHTGDSITVAPAQTLTDVEYQYLRDAAIKIIREIGVETGGSNIQFAVHPENGRVVAIEMNPRVSRSSALASKATGFPIAKIAAKLAVGYTLDEIPNDITKETPASFEPTIDYVVVKIPRFAFDKFPTANQVLGSQMKSVGEVMAVGRTFEEALQKAIRSLEIGRYGLGCDGKDKEVTMEEIRERLRYPNASRVFYIRYALQKGMSVNEIYELTKIDPWFIDKIKNLVEFEEQLKQIAERMSIEEVPKEILKKAKELGYSDRQLAVIFNTTEREVRRVRKGKGLRVVYKMVDTCAAEFEAKTPYYYSTYEDENEALRSERKKVMILGAGPNRIGQGIEFDYCCVHAVFSLKDEGYETIMVNCNPETVSTDYDTSDRLYFEPITHEDVMNIYENEQPEGVIVQFGGQTPLNIARELEDSGARILGTSVDSIDIAEDRERFAELLERLNIPQPENGIAHSLEEAKEIARKIGFPVLVRPSYVLGGRAMEIVYDEETLERYITEALEVSPEKPILIDKFLEDAIEVEVDALCDGEEVVIGGIMEHIEEAGVHSGDSACVLPPVSLDEVTINTIVDYTRKLALALNVVGLINIQYAVKDGKVYVLEANPRASRTVPFVSKATGIPLAKIAAKLMMGKKLRELGVKEKLKLKHVAVKEAVFPFIKLPGVDPVLGPEMKSTGEVMGIDYDFGLAYYKAELAAGMKLPLKGTVFISVRRKDKNDRLLYLARKFKELGFRIIATDGTRDFLVQNGIEADLILKISQGRPNILDAIVNGQVDLIINTPSGKRGRTEGYMIRRAAVDYGVAHITTLAGAMAAVRAIEAVKSRKMVVKSIQEYHEES

SEQ ID NO: 21346 - protein, 290 aa, Archaeoglobus fulgidus
MENVELLIEALPYIKDFHSTTMVIKIGGHAMVNDRILEDTIKDIVLLYFVGIKPVVVHGGGPEISEKMEKFGLKPKFVEGLRVTDKETMEVVEMVLDGKVNSKIVTTFIRNGGKAVGLSGKDGLLIVARKKEMRMKKGEEEVIIDLGFVGETEFVNPEIIRILLDNGFIPVVSPVATDLAGNTYNLNADVVAGDIAAALKAKKLIMLTDVPGILENPDDKSTLISRIRLSELENMRSKGVIRGGMIPKVDAVIKALKSGVERAHIIDGSRPHSILIELFTKEGIGTMVEP

SEQ ID NO: 21347 - protein, 352 aa, Archaeoglobus fulgidus
MAKRETAELRYLIVRPLGYPLKASYHEYPQVDNPKVFDVYAKDQWKGEFVHKNKLIFDMRMFPDFAFEVIDCDPPSGYISDSTIILVESDPRVIETEIVRDITLDDVVGQEEAKRKAKVILEYLRNPEKFGKWAPKNVLFYGPPGTGKTMMAKALSNEAKTPFLSVKSTKLIGEHVGDGARRVHELYERARQLAPCIVFLDEFDAIALDRGYQEIRGDVSEIVNALLTELDGTNSNEGICTIAATNRVELLDASIRSRFEEEIEFRLPSYEERLEILRRNLEEFPVPVKARLELVAAASEGFSGRDLVEKVIKASLHKAIAEGKDKIETEDLLTAAEKVKMPSRQPPKQMFV

SEQ ID NO: 21348 - protein, 586 aa, Archaeoglobus fulgidus
MKMEEIYREFIELTKLPDNETKEKAMEEFFRKLNTMQLPEYFNWAEEIFEGVHVKDRGNQKALIWSNIETGEKKEYTYEQFAAEGNRIVNFLRGHGVEKGDSFYMMIPLLPPIWFATFATVKGGFIGVPTATTMTVRDLEYRFKVYPPVAIMADEASAKTIDEALSNVGAEPKVKIVIGDRSGWESYDSLSKESSEAEAAKTKWDDIIFSFFTSGTTGLPKRVAHTATSYPVGHLMTACIINVQPGDIHHNLSAPGWAKYAWSSFFAPLNVGATATGFYYTRLNGDLYLQAVSEFKVNTFCAPPTAWRLFMFADIGKYDYSALRDVVSAGEPLNPELYEQWKKYTDTEIRDFYGQTESTAMIGNPPWFKGGKIIPGSFGRPTFMYDVTLVDDEGNEITKPNEVGHIVVRLDRWRPIGLFKEYMGDPEKTAKVFVGKYYYTGDKAFFDEKGYWWFVGRADDVIKTSDYRVGPFEVESALIEHPAVAEAAVVGSPHPIRYQLVKAFVILAPGYEPSRELALELFMHCKNILARYKIPRIIEFVPELPKTISGKIRRVELRQIEEEKRKKGEKGEHEYFYDDFPELKSS

SEQ ID NO: 21349 - protein, 392 aa, Archaeoglobus fulgidus
MAVLGVGMTKFGKHPDKSLVDLFAEAFYEAFEESNIELKDIQALYYGNFVGEMTDGSGNLSGFMADEIGLRGIPAIRYEGACASSSVAFREAVRAVAAGYYDIVAVGGSERLYTAGTEIGTRALATAVDGVYEITAGLTFPGVFALAARLYSKKYEIPLEELREMMAMVSVKNHRYGAINPKAQFYGKLGDLKVEDVLNSRMISSPLTLLDCCPMTDGGSAAIIAAADLAEELVDTPVYVRGTGQSSAGGLFRQKEDIIRAIPRRKASEMAFKEANMTPKDIDFVEVHDCFTIAEIIALEAMGFFEYGQGCYAVKEGVTSIDGDLPVNPDGGLIGKGHPVGATGVSQVYSVVKQLRGEFKENPVKDAETGMTDTLGGDFGTLVNIILSVHRR

SEQ ID NO: 21350 - protein, 384 aa, Archaeoglobus fulgidus
MKMNFELDEDHRMLQNAVREFAEKEIMPYGKEYDEKREYPMEIFRKAAKLGYVGASVPEEYGGAGLDYLGEAIISEELTRADSSIGTAVDLAILGVPMVLRYGSEEQKEKYIPPVVQGKAPSAIAITEPDCGTDVAAMRTKAVKEGEEWVINGSKTFITNGSVAGHTIVLAKTAEVEPPHRGISAFIVEPAWEGYEARRIEKMGLNCHDTAEITLKNVRVPAENLLGEENRGFYQLMEFFNESRVKIAALHLGMAVGAYERALEYAKQRKAFGKALIEHQAIQFKLADMWKDIEAARLLVYKAAWLIDQGKPVPAISSAAKLFASEAAVKVTYEALQVFGGYGYSKEYDIERYYRDARVGTIYEGTSEAQRIVIARSLMGRVKR

SEQ ID NO: 21351 - protein, 733 aa, Archaeoglobus fulgidus
MSDKKGEEITLRVAEAFYRDVGRGVARIDPAVMEKYGLQSGDIIEIIGKSTVPAIVWPSYPEDRGTGIIRIDGSIRSNAGVGIDDKVRIRKVTAKPAEKVTLAPTEPVRLMGGEAYLLRLLEGRPVIKGQKIRVEVFGHTLTFVITATRPSGVVVVTRNTAIELKEKPAEEVKRAVPDVTYEDIGGLKRELRLVREMIELPLKHPELFQRLGIEPPKGVLLYGPPGTGKTLIAKAVANEVDAHFIPISGPEIMSKYYGESEQRLREIFEEAKENAPSIIFIDEIDSIAPKREEVTGEVERRVVAQLLALMDGLEARGDVIVIAATNRPDAIDPALRRPGRFDREIEIGVPDKEGRKEILEIHTRKMPLAEDVDLEELAELTNGFVGADLEALCKEAAMHALRRVLPEIDIEAEEIPAEVIENLKVTREDFMEALKNIEPSAMREVLVEVPNVKWEDIGGLEHAKQELMEAVEWPLKYPEVFRAANIKPPRGILLFGPPGTGKTLLAKAVANESNANFISVKGPELLSKWVGESEKHVREMFRKARQVAPCVIFFDEIDSLAPRRGGIGDSHVTERVVSQLLTELDGLEELKDVVVIAATNRPDMIDPALLRPGRLERHIYIPPPDKKARVEIFKIHLRGKPLADDVNIEELAEKTEGYSGADIEAVCREAGMLAIRELIKPGMTREEAKEAAKKLKITKKHFEEALKKVRPSLTKEDVEKYEKLIEDFHRMYA

SEQ ID NO: 21352 - protein, 326 aa, Archaeoglobus fulgidus
MAEVEKVREKEVEKEVERKEIEREEDVEVCPECGSPRLIRDYRRGEFICQDCGLVIEDTYIDAGPEWRAFDSEQRDKRSRVGAPVTYTIHDKGLSTIIDWSNKDYYGKAISVRNRAQLFRLRKWQRRIRISNATERNLAFALSELDRMASALGLPKSVRETAAVIYRKAVEKNLIRGRSIEGVVAAALYAACRQAGVPRTLDEIATYSRVDRKEIGRTYRFITRELGLKLMPTSPADYIPRFCAALGLSGEVQKKAIEIIKKAEERELTSGRGPTGVAAAALYVASILLGERRTQREVAEVAGVTEVTIRNRYKELAEKLGIEIIL

SEQ ID NO: 21353 - protein, 303 aa, Archaeoglobus fulgidus
MRAVECRDVWMVYRTFMERGIVALRGIDLDIEDGVIFGLLGPNGAGKTTLISILSTILIPTKGEVRILGMDAFKNTRKVRERINISSGVRMPWGMKVYECLRFYAMCYGITDRRVVDRVISEFELEEHRNKRFDDLSTGNKQKANLARAFLNDPEVVFLDEPTANLDPDMAKKIRQMILRIKEEKDVTIVLTTHNMREAEMLCDRIAFIKEGKIVAEGTSEELKKYTKMSERVILKLKGNAKKLHIPYPYRMDGNTLIAFVEDAEKALPSIVVRLAEQGVFVESAKMEEITLEDVFIELAEGS

SEQ ID NO: 21354 - protein, 505 aa, Archaeoglobus fulgidus
MASILAVDVGTTSIKAGIVSTENFEAESTQSTRAVVEYPKKHWAEKDPEKLWNSIVEVCKPLAEKANPDAIVFGAHMAGVVPVDGEGNALRNIITWLDERAAGLPEDVWKGLIKIQGYSLTKLIKFLRLTGGAPSRTGKDPISKIVWIRENEPDVFGKTFKMLDVRGYLVARATGNFVTSPDEAHLTWLADTRGGKARWSESILKDYALSASLFPEIKNCTEIAGYLRPEVRKEFGLEGDVPVMVGSGDVAAAAVGSGAVKDYECHIYVGTSDWVAAHIPQRKTDIFHFIGSLLSAIPEKYLLIAEQEVAAGALEWAMRLVGIQGEYELVKELVEKAPAGKLIFMPWFYGERAPIDDPYVRGGLVNVGLDSGREEVLRAMMEGVALNIKWVFGYVEKMTAPQQMVSIVGGGALFDIWCQIISNAVRRPLRRIKHPEETGLRGLATMAAVGLGEESFESAAAKFEVDRVFKPDDEEAKVYDRLFEYYKELYSKLKKVYRKLNSAEY

SEQ ID NO: 21355 - protein, 372 aa, Archaeoglobus fulgidus
MKDGLEDVIACKTTISRIALENGRAILEYRGYDIRDLARKASYEEVAYLLLYGELPKKYELQDFKIELAERRELPPQIIGLLTHLPPYTHPMVVLRTATSYLGSLDKKIAVRTREETFNKAKDLIAKFPTIVAYYHRIRTGRNIIPPALEFSHAANFLYMLHGEEPTKTAERALDMDLILHAEHELNASTFAARIAASTLADIYACVVAATGTLMGPLHGGAAQEVMRMLREVASPRRAEEYVKRKIEAGERIMGFGHRVYRGVMDPRAELLRYLAKRLAAEGSTKWFEISEAIAKAAYKYKKLLPNVDFYSASVYANLGIPDDLFVNIFAMGRISGWTAHIIEQYENNRLIRPRAEYVGEKEKKFIPLSKR

SEQ ID NO: 21356 - protein, 388 aa, Archaeoglobus fulgidus
MIEIGIAGKPNAGKSTFFKAATLADAEIANYPFTTIKPNVGIGHVRVKCVCQELGVKCNECVDGWRFIPVKLIDVAGLVPDAHKGRGLGNEFLDNLRQSEAVIHVVDASGSTDEEGNEIGVGERNPVEDVKFLYREIDMWLFGILKRNWDKIIRRMKAEKRDAAKFLTEQLAGLGFEEWMVREAMRSFGDVSTLSDEQLRDFAVELRKRRMQMVIAANKADKAPKNLLEELMKLDEIVVPTSAAYELILRTAAKNGYIKYLPGDSDFEIVKELNEKQMKALEKIREFLREFGSTGVQEAINRVVFDLLDYIVVYPVEDENKFTDSKGNVLPDAMLVKRGTTAKELAFKIHTDIGKHFIYALDARTKMRVADDYELKNNDVIKIVSGAK

SEQ ID NO: 21357 - protein, 648 aa, Archaeoglobus fulgidus
MKEFIEGLIRLTEVERDAQISAMMDEIRRLSGEKRERKGRAVLGLRGKVVGEELGFKLVRYGRRKAIETEISVGDEVLISRGDPLKSDLRGVVVEKGSRYLTVSLESVPEWALRDVRIDLYASDLTFKRWIENLENLTENGKRALKFALGLEEPSKTECEDFKPFDSSLNRAQLKAVGCAVSTDDFFLIHGPFGTGKTRTVVEVVRQLVKRGERVLVTAESNTAVDNLVELLSDMKIVRLGHPSRVEKRLKEHTLASLVLNHPDYKRIEEIKGKIEEIERRMERLTKPSPQLRRGLSDEEILRLARSNRGARGVAAKKIRSMAEWIEARKALDQLYTEMKEEEERIVKEIIEESDVVISTNSSAFLLEESFDTAVIDEASQATIPSVLIPINRARKFILAGDHRQLPPTVMKAEKLSETLFEKLIELYPEKSQLLNVQYRMNEKLMEFPSREFYGGRIVAHESCTAIALSQIAKREAEKLREILGDEPLVFIDTSKCKNRWEGKLADSTSRYNRLEAEIVTEIVTELLKMGLKKEQIGVITPYDDQVDLLREKVDVEVSSVDGFQGREKEVIIISFVRSNRKREIGFLDDLRRLNVSLTRARRKLIMVGDSETLSVNGTYARLIDHVKRKGVYVELDKNGKLGGNPKG

SEQ ID NO: 21358 - protein, 271 aa, Archaeoglobus fulgidus
MKIIPCPSSPLLARRVAEAAGIEIGGAVFKKFPDGELYVRVMEKEGVVVGSINSNEDLIALIFALDVLENAKAVVPYMGYARQDKVFQEGEAVSIKIVAEMLESRADEVVTVNIHSSDAASHFSKLKNLDAMPLVGEYFAGKDVVMISPDKGSMERVKTAAKHAGCEWDYMEKRRIDATTVEITPKTIDVEGRDVVIVDDIISTGGTVAEAARILYGLGAKSVSAACVHAVLAENAAIKLFNAGIKDIIATDTVECAFSRISVAELIAENI

SEQ ID NO: 21359 - protein, 545 aa, Archaeoglobus fulgidus
MATLQGQPVLILREGTQRTVGRDAQRMNIMAARVIAEAVRSTLGPKGMDKMLVDSLGDVVITNDGVTILKEIDVEHPAAKMIIEVAKTQDNEVGDGTTTAVVLAGELLKRAEELLDQEIHPAIIANGYRYAAEKALEILNEIAIPISKDDDEILKKIATTAMTGKGAEVAIDKLAEIAVNAVKMIAEESNGQVEVNTDYIKIEKRQGGSIEETELVDGIVLDKEVVHPGMPKRVENAKILLLDSALEVKETEIDAKIRITDPEKLQKFIEQEEAMLKEMVDKIVNAGANVVFCQKGIDDLAQYYLAKAGVLAVRRVKKSDMEKLAKATGAKVLTDLRDISSEDLGEAALVEERKVGDEKMVFVTGCKNPKAVTILVRGGTEHVVEEIARGIEDAVRAVACAVEDGKVVVGAGAPEIEVSLKLREWAPSLGGREQLAVEAFATALEIIPRTLAENAGLDPIDVLVELKAAHEKGQKYAGVDVDTGKVVDMKERGVFEPLRVKTQAIGSATEVAVMILRIDDIIAAKGLEKEKGGGGEGGMPEMPEF

SEQ ID NO: 21360 - protein, 741 aa, Archaeoglobus fulgidus
MEYVTHPLIKENTIERRMYQISIAATALTKNTLVVIPTGLGKTTIAALVIASRLLNEDGKVLFLAPTKPLVEQHARFLKRVLKVEEIVSLSGEVPPEKRKELWEKARIVVSTPQVVENDLLAGRISLEDVILVVFDEAHRAVGNYAYVFIAKEYLRTAKKPLILAMTASPGSDPERIMEVIQNLGIEAIEVRTEWDSDVAPYVGKKRIEWIKVDIPEEMKEVKERLKECIKIRFKRLRELWIEVPENSSKRDLLALQEALQAEAASSQSSEIFEALSILAEIMKLQHAVELIETQGVKAVKSYLRKLVREATSKGGSKAAKSIVGDPIFKKAVIALSKCKVEHPKLEKLKEILKEQFEKNPDSRVIVFTNYRDSAEMLVNELSPLFPVAKFVGQASRDNDKGMRQKEQIETIDKFRRGVYKVLVATSVGEEGLDIPSTDLVVFYEAVPSEIRAIQRKGRTGRGREGRIVVLVTKGTRDEAYYYSSMKKERKMYDKILEIKRIIDRKQRSIGDYVLPEETGIKVIVDSRELRSEVVKHLREIGAKIEIRNLEVADYVVSDRVAVERKTVEDFLNSIIQKERLFSQVARLKSAYSRPVIIIEGENFYRGGVHPNAVRGAIASLIIDFGIPVLRSSNARETAELIFAMARREQEERKRGVVEHTAKTKRTLKDEQEYIVSAISNVGNVIARNLLDYFQTIENIATADEEELAKVPKVGKKIAKRIRRVMTTPYSEAGFYDSESF

SEQ ID NO: 21361 - protein, 416 aa, Archaeoglobus fulgidus
MDVIVRKGEIRGKAKPPASKSYTHRAFIAASLSPSARVVNPLISEDTISTLNACKRIGAAVLKKGNEWLFSGVDGVEAEGYFNFANSGTTLRIFTGLLSLSPFRSVVDGDESLRKRPNGELVLALSKLGARFKGREPYTPPFSVQGVIKGGEVEIEAPSSQFVSSLLFALSLAEGDSSLRVEKVKSQPYIDVTLDVLRESGVKVEREGNFYHIPGSQSFKLRRYDVPADFSSASYLIAAGLIAGEVVLEGMFESAQGDRKIVDICREMGGSVEWDKKRGVIRAERSELEGVEVDASDIPDLVPTIAVLAAVAKGKTRIYNAEHLRIKEIDRIEGIHQNLKALGVESKPLKDGLIIKGGKGEFRGVVDSFGDHRMALAFSLLGLLGEVKCRNAEVVSVSFPGYFRVLESLGASVIRL

SEQ ID NO: 21362 - protein, 343 aa, Archaeoglobus fulgidus
MRYSVGVLGATGMVGQKFIQMLAEHPWFKLTSLAASERRVGKKYGEEVDWIVSREVPDIAKDIEMVPMDPKHVDADIVFSALPSDIAREVEPKFAEAGFVVASNASAYRMAEDVPLVIPEVNPEHLGLIEVQKKNRGWDGFIVTNPNCTTIVLVLSLKPLMDLGLRTVRVASMQALSGAGYPGVPSLAITDNVIPFIKGEEDKVEEEPLKLLGKFNGRKIEFADIKVSASCHRVPVIDGHTEAVWVEFDREVSVEEAKAAFESLKPLDLPTSPEKVIIVREEPDRPQPRLDRDAGNGMSITVGRIRKDGERGLKYIVLGHNTVRGAAGASILNAELMIKEKII

SEQ ID NO: 21363 - protein, 552 aa, Archaeoglobus fulgidus
MKPWFRHWPPLLTKTLDYPRVPLFEFVETSARRFGDKAAIIYYGREITYNELLDAVERFATFLSNAGVEKGDRVAIYAQNSPQFVIAFFGIMRANAAVVPVNPMLVERELEYVLSDSGSKLVVATSELAGRVLPVAKKLGIQVVCGNLSDFIPEQPTLPVPDFAKLKIDVEGTTSWSEAMKERNPPEVMVGSDDLALIPYTAGTTGLPKGCMHTHFTAIANVLSSVHWFNLTPSAISLATLPFFHVTGMVHSMLAPVYIGATMVLLTRWDRETALQAIERYRCTHWVNITTMVIDLLSDPKIAERDLSSLLVVGGGGAPMPKAVAEKLYQLTGIRYMEGYGLTETISQTHMNPPQNPKLQCLGIPDFGVDALVIDIETGKPLPPNEEGEIVVSGPEIFKGYWNKPEETEKAFIEIDGKRYFRTGDLGYMDEDGYFFIVDRIKRMINRSGFKVWPAEVEAVLYKHPAVKEVCVIGVPDERVVEEVKAFIVVNPEYRGKITEEEIIQWAKQQMAAYKYPRIVEFDDELPKSGAGKILWRLLQEREKEKLEKGGG

SEQ ID NO: 21364 - protein, 291 aa, Archaeoglobus fulgidus
MMDVAILVDENTRVIVQGITGFQGSFQAKRMLDYGTKVVGGVTPGKGGSEVHGIPVYNTVEEAVAETNADTSIIYVPARFATDAIFEAFDAGLRLVVCVTEGIPLYDEMLIHRKLREVKSMLLGPNCPGVISPGRSKVGLLPDRSFTQGNLGVVSRSGTLTYQICENLTKAGIGQSTVVGIGGDPMPGLTFVDVLKMFEEDEETKAVLLVGEIGGTAEEKAAEFIKQMSKPVVAFIAGRTAPPGKRMGHAGAIIEGSTGTAEAKMAALRDAGARVAETLLDVVKEVRRVLE

SEQ ID NO: 21365 - protein, 383 aa, Archaeoglobus fulgidus
MMRLHEHQAKQIFAKHGIRVPRGEVATSPEEAEKIAEKLGGRVVVKAQILVGGRGKAGGVKKANSPEEAKEVAKKILGMTIKGHRVEKVLVEEQLNMRKEYYVGYVVDKSSRLPTVIFSRMGGMDVEEIAAKHPDAIHRIYFDPLWGLKDYEVRKALFRAGFEGEEFKQMFDIIKKLVDIAFAYEAELTEINPLAVTDEGFLAADARLNTDDNALYRHPELAELREATEEDPLEREARLKGINYVHLGGNVGVIANGAGLAMATMDIINLMGGKPANFLDTGGGLADPVKMKNCLLHVLKDPNVRVVFINIYAEITRCEKVAEGIILALDEAPRKVPLVVKLAGTNEEIGREMLERYSSEKGAEIHFVESIEEGARKAVELAG

SEQ ID NO: 21366 - protein, 292 aa, Archaeoglobus fulgidus
MIDTWEEYRIFEDSLKKFVESVEATPKIKKGLAYAITAGGKRSRPVIVLLSAKLCGGDYADVMNLALSVELIHTASLVHDDVIDKAEKRRKREALHKKYDISLAIVLGDWLISKSVELTSKYGEEIIRDFSNVGMMMSEGEVLDIYSIKENFTEKDYFECIEKKTAALFAYSAKSACKIVCEDRIAADKLFDYGLNLGIAYQIVDDLLEYLRLLDDKHSVFESRTLPQIYEEKYGKEEGVNKVMEKISTFVERSLSSLEYFDESPEKEKLRKIVDFMTYDMIRNKAEKKAIF

SEQ ID NO: 21367 - protein, 1156 aa, Archaeoglobus fulgidus
MHIEKIRLKNFKSFGKKAEIPFFKGFTVITGPNGSGKSNIIDSILFCLGLSTSTKQLRAERLTDLVHNGRSEAEVAILFSENGKKYEIARKVKITEKGYYSYYYLNGKSVSLSEIHSFLSQFGIYSDAYNVVMQGDVTRIIEMSPFQRRKIIDDVAGISEFDEKKEKALEELERVRESIEKLEAVIAEVNDRLQTLERDRNEAIRYKEILSKKEEYEGYLRAHNYLTAVKSKEKVERELERLERQKDELTSKIPEINARIAELNEKINELAAKISELGDERSAEIQSRILELSSELESLRRAERFYLDEAKRLEEESVKIISEISKIKEEMESLDGELEEYAIKRIQVGEIVDELAAKMELLRQRLEEVDKKHRELRDRLVSRKEELEMYKERRGEILRERDKLIELLRRIDMDVEDIKNEIASIESKLKEFETEKKAKQEEVWKQEEELMSAKKMLSSADKKLFDIRAKISDVEDELKKAELELAKVKATLSTLRTYSKPVEILLDARNRRELPGIFGTVAQLGEVDEEYVAAIEAAAGNALQFVVVETEDDAVSAINFLKAVRGGRATFIPLRRIKSFKLSLDKSILKEDGVIDFAVNLVRCDKKFQPVFRFILRDTVVVDRIETAKRLMDRGFRFVTLDGDIVEKSGLMTGGSAEKRGILVSRELLEKERMLSDKIYELQREKEGLFAELNRAESLRKQYKDEVDRLTGMISELRNRISLLDEKIRTESGRIEELREKISQKSREKENYISSLKDYNSKLAEMEEAIGELEAEIEEIERMLRGSEVPKIVEELDKIKEEHQRNREILISIEKKIESLEFKREQLESSMQEKQVYLDEIKDRIDEIRRTIEEGKARVEEINSELEELRKEERELGKELKGLRKERDELIKQLRNAEEEKRKIEAEIDRLEERIKLQKERLEIAESEIAEIGEVEVPENLPPLEKVEKVLDEVLVELSTFGDVNLKAIQEYEEVKARRDELVEKKMVLEKERADILDRIEKYERMKREIFFEVFTAINRNFAEIIRELANGEGELYLDSDDPFNSGLYIKVKPNNKPVQKLESMSGGEKSLVALALIFAIQMYKPAPFYAFDEVDMFLDGVNVGRVAKMIKKRSKDAQFIVVSLRKPMLEQADAIVGITLGRDNVSQVTGIKLKT

SEQ ID NO: 21368 - protein, 199 aa, Archaeoglobus fulgidus
MMVKVCGVKSLKELDAVERYADFTGVVVKSDSKRCVELDVAKELIGSSSIPVFAVSTASSYAEWEEILAKTECSFAQVHSEMPLEDFERLKAEVKVMKAFIVEGPAEKIAAKIELYSPHLILLDSGCGSGKTHDWNVSKALAERYGVFLAGGLNLDNVREAIRFVRPMGVDVSSGVERDGLKDEMLVREFVRRAKNEVR

SEQ ID NO: 21369 - protein, 345 aa, Archaeoglobus fulgidus
MVGYAVELEGISKSYDSTTVLEDINLRIQQGEFFSLLGPSGSGKTTIIRIIAGLTFPDQGFVRINGEDCTSLPPYRRNVGMVFQNLALFPHLNVFENVAYGLRLRKIPEGEIKDRVYRYLELVNLDPEIYAKRKVEQLSGGQQQRVAIARALVTEPSILLLDEPLGALDLKIRQHMISELKRIQKTLGTTFIYVTHDQSEALLLSDRLAVLNEGRIHQIGTPREIYERPKTRFVASFIGETNFLEARVVNGEVITEIGKVRVFGLDGAREFCISIRPEKLKINQQAENTFEAVVEEIGYLGSFLMLKLRAGDVVVKAFAPPQENVREGERVIVGWDSRDAVILEA

SEQ ID NO: 21370 - protein, 390 aa, Archaeoglobus fulgidus
MRKTGGLPLSRRLARRVEELKPSGIRRFFDLVVGRDDVISLGVGEPDFPVPWRIREEMIYSLEKGYTSYTSNLGLPELREGIAEYYTRFGVKALPEQVMVTSGVSEGVDIAIRALIEPGDAALIPEPCYVSYKPLVEICGGEAVTIPTAPEFRLTYEMLMQYRDAKAKILVLNYPANPTGVSYSKKELEEIADAVNELDLIVLSDEIYAELTYTGRHVSMAALNGMEDRVVIFNGFSKAFAMTGMRVGYVIAPPDIFAGMLKIHQYCMLCAPITGQIGAIEALRSLDEVERMRAEYMRRRNFVVKRLSEIFEIKKPEGAFYAFPKISSTGMSSEEFAEKLLLEKSVAVVPGNAFGECGEGYVRLAYAVKFEKLKEAMDRIKEFVEEHGEG

SEQ ID NO: 21371 - protein, 752 aa, Archaeoglobus fulgidus
MKLNRTAETVLRKRYLLKDDEGNVIETPEEMCWRVARAIAKAEENYGNNAEEWAEKFFKLLWEQKFMPNSPTLMNAGTELNQLSACFVIPVEDSIDGIFKALWDMAKVQKSGGGTGFSFSRLRPKGDIVKSTMGVASGPVSFMKIFDAATEQIKQGGRRRGANMGVLNVHHPDIEEFIKAKWEEGVLRNFNISVAATDAFMEALKKDDDYDLINPRTGEVVRRVPARKIFNLIVEGAWRNGEPGMIFIDTINRFNPTPHVGQIEATNPCGEQPLLPYESCNLGSINLAKFVKDGEIDWDGLREVVWIAVRFLDDVIDVNSYPIPEIEQMTKANRKIGLGVMGWADMLFLLNIPYDSDEAIQLAEKVMKFIQEESHRASQQLAEERGVFPNWKGSVWEKKGIKMRNATTTTIAPTGTISIIAGCSSGIEPIFALAYKRTNILDGEEFFEINEIFEEVLRRRGLYTDELIEKVAEKGSIQEIEEIPEDIRRVFKCALDISPEWHVRMQAAFQKYTDNAVSKTINMPNSATRKDVEKAFLLAYELGCKGITVYRDGSREEQVLRIKKAEEEKKEAKPRPPAKYIEPRPRPRITTGRTIETRTGCGSLYVTINEDEYGIAEVFVQLGKSGGCAASQTEAMGRLLSVALRSWIDPEVLIRQLKNIRCPSPGFDNGEVITSCADGVAKVLEKHLKGEYKKIKFEVEGIKPLTAFTGEAEEREEPRTKQIGGVCPECGNVLEYGEGCATCRFCGFTRCG

SEQ ID NO: 21372 - protein, 459 aa, Archaeoglobus fulgidus
MEEMPLIKTPPPHGGKLVERVVKKRDIAEKMIAGCPTYELKPTTLPDGTPIRHVYREIMSVCYGFFSPVEGSMVQNELERVLNERRLLSEWIFPYPILFDISEEDYKALDVKEGDRLLLMLKGQPFATLDIEEVYKIDPVDVATRTFGTPEKNPEVVREPFDDKHPGYVIYKMHNPIILAGKYTIVNEPKFKEPYDRFWFPPSKCREVIKNEKKWRTVIAHQTRNVPHVGHEMLMKCAAYTGDIEPCHGILVNAIIGAKRRGDYPDEAILEGHEAVNKYGYIKPERHMVTFTLWDMRYGNPIESLLHGVIRQNMGCTHHMFGRDHAAVGEYYDMYATQILWSQGIPSFGFEAPPNEVDYGLKIIPQNMAEFWYCPICQEIAYSENCGHTDAKQKFSGSFLRGMVAEGVFPPRVVMRPEVYKQIVKWWKVYNYPFVNRKYLELKNKELEIDLPAMEVPKA

SEQ ID NO: 21373 - protein, 643 aa, Archaeoglobus fulgidus
MVYYPKKYELYKADEVPTEVVETDILIIGGGFSGCGAAYEAAYWAKLGGLKVTLVEKAAVERSGAVAQGLSAINTYIDLTGRSERQNTLEDYVRYVTLDMMGLAREDLVADYARHVDGTVHLFEKWGLPIWKTPDGKYVREGQWQIMIHGESYKPIIAEAAKMAVGEENIYERVFIFELLKDKNDPNAVAGAVGFSVREPKFYVFKAKAVILATGGATLLFRPRSTGEAAGRTWYAIFDTGSGYYMGLKAGAMLTQFEHRFIPFRFKDGYGPVGAWFLFFKCKAKNAYGEEYIKTRAAELEKYKPYGAAQPIPTPLRNHQVMLEIMDGNQPIYMHTEEALAELAGGDKKKLKHIYEEAFEDFLDMTVSQALLWACQNIDPQEQPSEAAPAEPYIMGSHSGEAGFWVCGPEDLMPEEYAKLFPLKYNRMTTVKGLFAIGDCAGANPHKFSSGSFTEGRIAAKAAVRFILEQKPNPEIDDAVVEELKKKAYAPMERFMQYKDLSTADDVNPEYILPWQGLVRLQKIMDEYAAGIATIYKTNEKMLQRALELLAFLKEDLEKLAARDLHELMRAWELVHRVWTAEAHVRHMLFRKETRWPGYYYRTDYPELNDEEWKCFVCSKYDAEKDEWTFEKVPYVQVIEWSF

SEQ ID NO: 21374 - protein, 351 aa, Archaeoglobus fulgidus
MRFKTVDLPYHVYIGENVISKLPKVLRSLDANYFLLLTDEVVKNLVVVNLKETLKDFEYDMMLVESAKMEEARKIVLRGGFADYDAVVGVGGGKVLDVSKVVSSELNASMISVPTTASHDGIASPVASFKENGKPISISTNPPSAVIADLNIIKNCPIRLLRSGYGDLVSNISSVKDWQLARDLVGEDYNEVAASIAVMPAQLMVSKADELDLTLPPHLLMLLRGLIMSGVAIAFVGSSRPASGAEHKFSHALDYLGYGNGTHGEQVALGTIIMEYLHEKYYGRGDWEQIKMSLEKVHAPTTAKEIGLTREQVIEALMLATKLRKKRFTILEAVKPTKEEFELVVEKTGVA

SEQ ID NO: 21375 - protein, 456 aa, Archaeoglobus fulgidus
MYRVKTFKYYSTYKICMIEEVFELTQNGRAKKWHAFYGGKIEILPKVPIRTLDDFSIWYTPGVAEVCNEIAEDEEKAYDYTNKWNLIAIITDGSRTLGLGNIGPKAAMPVMEGKALLFKFLGAVDAFPIALAEQDADRFIEIVKAISPTFGGVNLEDISSPKCFYILERLQKELDIPVWHDDQQGTATATLAALINALKIVGKDISEVKISIIGVGAANFATIRLLKAAGADPKKMFVVDSKGILHPDRADLKEKKGYKWQVAIETNGERRTGGMEEAIRGTDVLIAASKPGPDVIKKEWIAEMNDDAIVFPLANPTPEIWPWEAKDAGARIVGTGRSDFPNQVNNSLVFPGVFRGALTVRARKITDEMCLAAANALAEFAERNGLSEDYIIPRMTEKEVFPEVATAVGVKAVELGLARLELREEEIYEIAELMISATQRKIKKLYELGFIKEPPS

SEQ ID NO: 21376 - protein, 356 aa, Archaeoglobus fulgidus
MKVVLLSSYFPPHIGGVEVHVERIAHHLHRRGFEVVVVTSTASGREKFPFRVEYVPSIPIPYSPITPFLGRFLEKIDGDIFHSHTPPPFFSCSLRKSPHVITYHCDIEIPEKYGRFPIPRALSKLIIRRTDDMLSEALDRADAIVATTKSYAETSRLLAGRDYHVIPNGIELSEFEGVEAEKEPTVLFLGRLAATKGVDVLLKAMKHVDVEARCVIIGDGEERSSLERLARELEVNAEFTGFLPRKKVIEYLSRASLLVLPSLSRLEAFGIVLLEAMACGTPVAASDLPGVRDVASEAGFVFPPGDYMRLSEIINEVLSDERKVKAIGESGRRIVREKYSWDVVVKSLIRLYESLI

SEQ ID NO: 21377 - protein, 340 aa, Archaeoglobus fulgidus
MMKVKVAINGYGTIGKRVADAVSLQDDMEVVGVTKTRPDFEAKLGAKRYPLYVAKPENVELFERAGIEIQGTIEDLLPKADIVVDCSPNKVGAENKAKYYEKAGIKAIFQGGEKKDVAEVSFNALANYDEAVGKSYVRVVSCNTTGLTRLIYMLKTNFSIGRIRATMLRRVVDPKEDKKGLVNGIMPDPVAIPSHHGPDVKTVLPDVDIVTTAFKLPTTLMHVHSLCVEMREAVKAEDVVSALSEEPRIMLISAEDGFTSTAKVIEFARELRLRYDLYENIVWRESIGVDGNDLFVTQAVHQEAIVVPENIDAIRAMFELAEKEESIRKTNESLGIGKVF

SEQ ID NO: 21378 - protein, 436 aa, Archaeoglobus fulgidus
MQVLRLDRRHYKSGKIRRAMSSRIPGFYKLSVEERLKKVAEFAGLSDEEVKAVLSQGLPLDVADRMIENVIGTFELPLGIATNFLIDGKDYLIPMAIEEPSVVAAASNAARMARESGGFTTDYTGSLMIGQIQVTKLLNPNAAKFEVLRQKDEIIERANECDPMLVNLGGGCKDIEARVIDTIMGKMLIVHLIVDVKDAMGANAVNTMCEKVAPFIERITGGKVYLRIISNLAAYRLARAKAVFDKDVIGGEEVVEGIMLAYAFAAADPFRCATHNKGIMNGISALMIATGNDFRAIEAGAHSYAAIGGYKPLTTYEVDRKGNLVGTIEIPMAVGVIGGATKVNPLAKISLKILGVNTAEELARVAAALGLAQNFAALRALATEGIQRGHMELHARNLAIMAGATGDEVDRVVEIMVRDGKIRLDYAKEVLERLRS

SEQ ID NO: 21379 - protein, 493 aa, Archaeoglobus fulgidus
MDRGGDLVHFLGIDAGTTGVTVGVYDADGNLVAKSYSEFETYYPQPGWVEQDAEHWWNSIIDACRQAVKIAKASDSIAAIAVANQRETIVPVGRDGEPVSRAIVWQDRRCREEVELIKERIGEERVAKITGLKPDPYFSLPKILWWMRNRPEVIEKSWKLMLVHDYIVYRLTGEVVTDYSNASRTMLLDLNSRKWCDEIAAEFNLDLSLMPDLVNSGEVVGEIRGNVAEKLGISSNPVVVAGGGDQQCSALAQGVVEEGSVKSTTGTGTFMVAPVEKVRGHGDIIYSAHVLPGINVGEVSIFTTGSLLSWVKKAFYHGEGYDVINEEAEKSGVGARGVFILPFFSGAGCPHWNPEAKGVIFGLTLAHNRGDIARAVMEAVAFEVRSNIEVMENKGISIEELRLDGGAANSRLWNQIFADVTGRKCLVSSDVEATARGAAILAASGSDSFNGIDDALTTFLPDFTEVMPSEDGMGKYEEIYSKYVQIRDAYLKG

SEQ ID NO: 21380 - protein, 266 aa, Archaeoglobus fulgidus
MTLRTKDGLTLYTRRWDVESPRAVICLVHGLGEHSGRYEHVARFFNENGISFAAFDLRGHGRSEGKRGHAEYQQLMDDITLFLQSLDYDCPKILYGHSMGGNLALNYILRYDPDIAGGIISAPFLALPKELPKHLFFILKLLNVVAPSIQLSNGIDPNLISRDREVVEAYVSDPLVHDKISPRFILQSLEAGKWALENADRLRKPILLIHGTADQITSYRASQEFAKRAGELCKFVSYEGFYHEPHNEPEKERVLADMLKWIEEVI

SEQ ID NO: 21381 - protein, 569 aa, Archaeoglobus fulgidus
MLGVEGKSITEIDEKEINRIWLKHYDEGVRPNIDYPEIPLYQLLEDTAKKYPDKTALIFFGKKITYRELDEMSDRIAGFLKSLGIKKGDRVILDLPNVPQYVAAYYGILKVGATVVQCNPLYTEREIRYIQENSEAEYGFFVEFVYPRIKGLLAEGKLKKAVICKIEDYLPFPLNILYPLKKEKVRIEKSDKVVYWKDALKSPLTKERPEINPKDDVAIFLYTGGTTGVPKAVMSTHFNLVANVYQTLEWVVDRTPDDVFIGVLPYFHSFGMTTSMNAPIANGSTIVLIPDPRDIKRILESIQKYRASIFCGVPTMYAAIINHPDVKKYDLSSVKACISGAAPLPVEVKRRFEEITGGKLVEGYGLSETSPVALGNPVYGLNKEGSIGIPFPDTYAVVIDDEGKVLPIGEVGELVIKGPQVMKGYYKMEEETKKVLVNGWLLTGDMAKMDEDGYFYIVDRKKDMIIAGGYNIYPREVEEVLYEHPAVVEAAVVGVPDPYRGETVKAYIVLKPEYKGKVTEQEIIQFCKERLAAYKVPKLVEFRDELPKSAVGKILRRVLREEEIKKIKG

SEQ ID NO: 21382 - protein, 663 aa, Archaeoglobus fulgidus
MVMSWLIITEKDNTARRIASILFKDVKTLKKGRVSYYHSPSNDAYVVGLKGHIVELDFPKELNNWTKTPLEKLLQAELVKKVKERTISSILKEIAKKADRVTVATDYDREGELIGVEALEIVKSVNPTVKVDRVRYSAVTEKEIRSAFSKPVKVDFNLANAALARQKIDLIWGATLTRLISVHSGRMGKDFLSVGRVQTPTLRLIVDRELEIQNFKPEKYYEIFAEFEGFIAKHPKRYGSKEEAEKLFAKIGETAKVEEFTRRRMEENRPTPFNTTEFLREASKFMSPHKAMNIAETLYMNGYISYPRTDNTVYPPTINLIEIVSALSSVFPREAQIVLSQDKITPSRGRRETKDHPPIYPTGVAKRGELSKDEWTIYELVVRRFLATLAPKAVWDVRRVVLDSNGVKFVANGRQLVEAGWRDIYIYSKAEETELPLLKKGDVLRILKKRLEEKETKPPGRYSASSLIKMMEKLNLGTKSTRHEIIQKLVSRRYIHGNPFRPSETAFSVINVLKETAETITLPDMTAKLENEMDLIAEGKKREPEVVDESREMLLQILRAIDYRKLSKDLREGVKKDKIVGKCPECGGELVVRQSKAGKRFIGCSNYPDCTFTLPLPQNGTLYITAKQCKEHEIKEVKIRTKKGYWNLGCPYCNYLNWKKENS

SEQ ID NO: 21383 - protein, 424 aa, Archaeoglobus fulgidus
MGFTGRRGKAEIIEAFSKHVSPYKAKFFSMVGIDFVPARREGVWYWDLDGRKLMDCHCNGGVFNLGHRHPEIVKTLVEALDELDIGNHHLISEQRARLAEKLAELMPGDISRTVFGVGGGEAIDFAIKLARGHTGRKKIIYAKGGYHGHTGFALAAGDEKYRKPFEPLAPGFVEVPFGDAEAVEKAVDDDTAAVLFETIPATLGMPLPPEDFYRRVREICDEKGCLMIMDEVQTGLGRTGKMWGIEHYKVVPDVIVTAKGLSGGVYPISATCFKEGLDDFMAENPFIHVSTFGGAELGCVVAEKVLEITSRESFLENVRKTGEALSEILGKLKDEYDFVDEIRQKGLFIGIKMVEEGWGPLLSISCYHSGILAVYANNDTSVMQFLPPLIVGEKEVDYIREKLAGAMEIASQRREMVEFIRKML

SEQ ID NO: 21384 - protein, 557 aa, Archaeoglobus fulgidus
MVVLYGKDVVDRYVAEGWWDNVTLFERFRRNCKRNPERTAVVDPPNKEELVGFKPERLSYAELSDFDDRLASFLLDNGVFKDSCVLVQLPNTVELIAAYLATWRASAFISPVPMQWREHEMGHVCRVLQPKVFITADTFKGFDHAQMASRIKEAFPSIEKVVTYSQLYEICRNYRIREDLDEASSFASGNDIAVVQWTSGTEAEPKACPLSHNNWGFLRFLYDGERYRGGLLSDGDVIMNPAPIVNMTGIGVGLIPWIMCSGTFVLHHPFEPMLYVRQLIEEGVNFTLAPPAVVVAILKHPMASQLSFDKLKYFAQGSAPPPPWTFVELKNRGIEPMNIWGQNEGTGLFSYDRTIPDLEKRARSFPIPDKVRDLPFFRAIEIKIVDESGKEMKEPGSVGELCYRSPLTMPCYYRQPELTKKSFDADGFFHTGDLFEVVDDTTIAFFDRKKDIIIRGGFNVSSAEVEDVVKKHPNVLDAAAVGVPDERLGERVGLYVVPKPGTTVTLEDIKKHMEESGVAVYKWPEVVVVVDEIPRNPVGKVLKSRLRKEIVERMKAG

SEQ ID NO: 21385 - protein, 448 aa, Archaeoglobus fulgidus
MCIMKYDVLIIGGGPAGIVTATTAKKFYPAKSVAIIKKEETSLVPCGIPYIFKTLGSVEADVMPTKPAENLGIEFIIDEVEDVDVKAKVVRTKGGKSISYEKLVFATGSTPVMPRIEGVEKKGVFTVSKNIEELRKLHEAVKKAEKVVIVGGGFIGVEVGEQIAKAGKKFTMVEMMDQLLPAAFDKEFARIAEEELKKLGVEVYLNSTVKRITGNSSVEAVELADGRKIEADVVIMSVGYRPNIELAKKAGLRISIGNRIWTDEYGRTSEKDVFAVGDCSEEKDFFTRETSRVMLASTATFEARIVGANLYSLKVVRVNKGTVGVFSTFVGDVALGAAGLTEEMAKKEGFEVVAGYGESLNRHLASIPGAAKTKVKLIFAKESGVILGGQVTGRYEVGEMVNQIAMAIQNNLTASEIDTLQIGTHPLLTSAPTTPPVILAAEDALRKM

SEQ ID NO: 21386 - protein, 398 aa, Archaeoglobus fulgidus
MWSCSLNFMLILLFLNTGSTGFEPATDGLKARRSAWLSYEPSSISDGEDLNLFRALKIQAKDRYIYRCIRDLRGKGMYAIEVENLVKKFGDFEAVRGVSFKVKRGEIFAFLGPNGAGKTTTVHILTTLLKPTSGKAFVAGLDVVREAREVRRRIGIVFQDPSVDRDLTAYENMLVHGGVYGLKGKELKEKIERLLKFVELWEFRDKLVKYFSGGMQRRLEIARSLLHHPEVLFLDEPTIGLDPQTRAHVWSYIEAMKEEQDMTIFLTTHYMEEAEKLADRVAIIDHGRIIAEGSVEELKRLVGSDVVYLKVENGAECFETGLGNCVVLPDGRIRIDVSNASEAIPKIFEIAREKGVRILEVTYHRPTLNDVFLHLTGREIRDEGGELRKAIIRARMRR

SEQ ID NO: 21387 - protein, 604 aa, Archaeoglobus fulgidus [sequence omitted]

SEQ ID NO: 21388 - protein, 180 aa, Archaeoglobus fulgidus
MKITISGPPGSGTTTVAKIVAEKLGLKLISAGDVFRQLAAKKGMTVEEFSQYAEENPEIDRLIDQTQKEMAEKEKNVVVEGRLSGWFVKNADLKVWIFADPEVRYSRIAKREGKDLTVVRQETRLREEFEKRRYWKFYSIDIDNWTIYDLIINSGSFDAEGVVEIILKAVEVKKIKVDQK

SEQ ID NO: 21389 - protein, 509 aa, Archaeoglobus fulgidus
MVREFDYIWQYLDHWADVDEKYPAIKFKDKEISYGELKENANRLAASLLKLGVGKGDRVATVLPMTPEYVCTFLACSKIGAICVPMDVRYRTAELRRFLSHAEPKVIISVESFQENNQRKILDEIKEEIGNPEIFFVGEFDELLKSEPLGKAVEQEPNDDILIIFTGGTTGVPKATLLSHINIVSMALGELKSIIRYIGREERMNMLVHLPPSHVGGTTELLATGLVNGSKMVLIDHWRPDTVLKELKEEKIAFFGAVPTMFALIFSLNVPLPPVELLVTAGEKLNPELLKRMMQWCEKIGVGYGSTETAGFATFSLPEDDPLKFTEGYVGVPFEGVDVRIVDDEGNELPDGEIGEVLVKGPMVSKGYFRQPEETEKGFRDGYWVSGDLGFKKGKELYIVGRKKEVIRVGSYTVLPSEVEEVVMKNPKVGIAAAFGYPHEIYGEVVWVAVVPRAGEVVSEEEIIEACKKELADFKVPRKVLIMDSIPLTRLGKADRIKLKEIILKEFFE

SEQ ID NO: 21390 - protein, 453 aa, Archaeoglobus fulgidus
MEEFEGEAIVEAENVVSIMLRREAAERADEILHFSYWSGEIKELDAPGYLDRWQKKCYHATCSLDEGEILLVVGPPGSGKTTFIAEAARKLSEEERVWVTSNTNIAVDNVLEKLERALRIGHPSKITAGVRRHSVEYNLLSGIRFSDYREYASKVAEAYREIARIQNDMIRKGKIVVGSTILKGMMSALKNYDFDTVIIDEASNTCISTALLALEKAEKAVVVGDPYQLPPVYEVGGHKAAKFSAYNFLINIYGKNLWLRRHYRSNAKIAEFAARHVYGFLEIDEKCRRIKIEPCKTTIPEVGDPEKPLVFIDCNGVERREGRSKVNEEEAEVVAMIAEELAECVGEENVGVITPYVKQAELIRGILSEFGVMVEVSTVHSYQGREKDVVIYSITATGNPYFASEKRLFNVALTRARKKFIAVGNSKALEGKNLLLTRFMVAAIKEGGFVRLR

SEQ ID NO: 21391 - protein, 433 aa, Archaeoglobus fulgidus
MPTSKVFITPNFGFNMAQTLVEKIFSKASGKEVKAGEFVMANIDLAMIHDITAPLAIKAFREILGSDAKVWDKSKVIMAFDHQVPADSVHAAENHKMLRKFAEEQGILNYDVKGGIAHQIMVENHVEPGMLIVGADSHTCMYGALGAFATGIGSTDMGFVLAMGKLWFKVPESIRFNVHGKLEKHVYGKDIVLKLIGMVGADGANYKACIYSGEVVEKLGMSDRLTMCNMAIEMGGKAGIVEPDKTTLEYLKAMGRPYEGELLKSDEDAEFQEVELDVTGMEPQVAAPHRVDNVVGISEVEGTRVDQVFIGSCTNGRYEDLKIAAEILKGEKVASNVRLIVIPASHREYRRALKEGLIEIFVDAGALVEAPCCGPCMGGSFGLIASGEVSVSTSNRNFIGRQGSPEGKIYLVNPAVAAATAIYGEITDPRKIK

SEQ ID NO: 21392 - protein, 322 aa, Archaeoglobus fulgidus
MAEFPKVRMRRLRKANLRWMFREARLSPENLITPIFVDENIKEKKPIESMPDYFRIPLEMVDKEVEECLEKDLRSFILFGIPSYKDETGSSAYDQNGVIQKAVRRIKAEFPDAVIVTDVCLCEYTTHGHCGVVKDGEIVNDETLPIIGKTAVSHAESGADIVAPSGMMDGMVKAIREALDAAGFESTPIMSYSAKYASNFYSPFRDAAESGFKFGDRRGYQMDIHNAREAMREIELDVKEGADIIMVKPALPYLDIIRMVRERFDLPLAAYNVSGEYSMIKAAIKNGWLSEEAIYEVLISIKRAGADLIITYHSKEIAEKLQ

SEQ ID NO: 21393 - protein, 437 aa, Archaeoglobus fulgidus
MEIGCITISHKNAKVEEIEKIWLTVKPRLEDVISKCSFSEYAYIFTCNRFEIYLVGENLKSCLQDIAEELGITGKAEIFVGESCLRHLLRVASGIESMIVGEEQILGQVRQCFNLCREGGQAGEVLERVFGKAVQVGRRVRRETAISKGSVSIGSAAVEVAERVLGTLKGKKALLVGAGEMGTLVAKAIAGKEVEAVLIANRTYEKAEELAKRIGGVAVKFDKLVDYLKVCDVVISATSAPHAVITRGDVERAMRERSQKLLIIDIALPRDVDESVAQLDGVELLTIDDLRRISEENLARRREEIAKVEGIIEEELEQLKLLLKDISARDAIAAMYSLAERFVGEEVEELYAKLNARYGVSEDVKEILNDFANSLIKKFLREPTVRLREAARKDEFHVIESIKYVFGDGNGRVSEGKDAKVEEGKPEVDVQRSKAES

SEQ ID NO: 21394 - protein, 398 aa, Archaeoglobus fulgidus
MGDSEIQYLLEKLKKLEEDYYKLRELYRRLEDEKKFIESERIRYEREVRRLRSEVERLRSPPLLVGVVSDILEDGRVVVKSSTGPKFVVNTSQYINEEELKPGARVALNQQTLAIVNVLPTSKDPMVYGFEVEEKPEVSYEDIGGLDVQIEEIREAVELPLLKPELFAEVGIEPPKGVLLYGPPGTGKTLLAKAVANQTRATFIRVVGSEFVQKYIGEGARLVREVFQLAKEKAPSIIFIDELDAIAARRTNSDTSGDREVQRTMMQLLAELDGFDPRGDVKVIGATNRIDILDPAILRPGRFDRIIEVPLPTFEGRIQIFKIHTRKMKLAEDVDFKELARITEGASGADIKAICTEAGMFAIREERAKVTMLDFTKAIEKVLKKTTPIPDLKGVMFV

SEQ ID NO: 21395 - protein, 491 aa, Archaeoglobus fulgidus
MAMERENWATRAGFVLAAIGSAIGLGNIWRFGYLVYKNGGGAFLIPYFVALFVAGISLMILEFAIGHRFRGSAPASMRKLGGRGFEWIGWWAVTGGLIITMYYTVVIGWAIVYFTKSLTLAWGEDTGGYFFGTVLQLSDNPWDFGGFATEVLIATIIVWALNWLVDFRGIRKGIEKANLLLMPLLWLLAVILVIRAVTLPGAMEGIEWYLKPDFSKLGDYNIWLAAFGQIFFTLSLGMGIMIAYASYLPEKSDIANNAFIVSLANCAFSFLVGFAVFGTLGYMAYATQSDISDVVAQSVGLAFVVFPKALNMLPALKVFTAAVFFLALVVAGLSSSISLVEAVSSALMDKFGMERRKAVNIVVLVGFLGSIVYTTKAGLYWLDVVDHFINYYGLVLVGLLEVIAAAWLFDLTVLKNHINSVSEIKVGMWWDLAVKFATPLILAVLLILDIRGNLTENYGGYPTEVLLTGLSIIVLGMIVAAILSWRDKNVS

SEQ ID NO: 21396 - protein, 405 aa, Archaeoglobus fulgidus
MEGFRKIEWAERYMKVLGKIREQFRKERPLEGFTVGMALHVEAKTAVLVRTLVDAGAEVAITGCNPMSTQDDVADALRESGIACYAKRGMDVEEYYEALRNVIRAEPDIVIDDGADLIFLLHGEMESYAEKVKGASEETTTGVIRLRAMEREGVLKFPVIAVNDAYTKYLFDNRYGTGQSAIDGVIRATNLLMAGKIVVVAGYGWCGRGIAMRARGMGASVVVTEVDEIRALEAVMDGFRVMRMEDAAKIGDIFITATGNRDIIREEHIRLMKDGAILANAGHFNVEIDIPALERMAKAKREARKYVTEYDLGDKRVYLLAEGRLVNLVAADGHPVEVMDMSFANQALAAKYIAENWQKLERKVYRLPEELDRMVARMKLESMGVEIDQLTEEQVRYLSDWRCGT

SEQ ID NO: 21397 - protein, 319 aa, Archaeoglobus fulgidus
MVKLASNENPYGPSPKAIEAFRSYSDLHIYPNPEYRELREKISDYTGWDADRVVVGAGIDGILETLFRILIDEGDEVVIPIPTFPYYHILTKLSCGKEVLVRRGENYRIDESIFDAITQKTKIILICNPNNPTGNAEDAKLIEELVNSTNALIFLDEAYVEFSDVSFSVDAENVVIARTFSKAFGLANLRIGYALLPEWLVSPFRAAMTPFPLSTPAAKAAEAALDDVEWMRSCVGRIKAERERLYKELKKLVEVNLSQANFLFFESPVENLAEELLKRGVIVRDCSSFVGCGNHIRVTVGRPEENDMFLEALKEVLGC

SEQ ID NO: 21398 - protein, 401 aa, Archaeoglobus fulgidus
MGEFSKFEKLIVLLAAAIGWSHDAVGLTLLNFLAEPIMREFNVGTLEIGFIFSAQYIFCIFGAMLFGEMGDRFGRKNALILSILWVAVFSVLSAFAPNFWTLAILRLISGMGVTWGLAFTYMSEFYSPKRRGLFGGLIHATFVFGFILSALSVSLIYPIYGWRACFFVTLYPIPFLILFAKYLPESRIWEKHSAEMDKSLRLAEIVRESRYLRLLVLATFLFWLAEFAYHAIVDWSPTFIIRQFNYRPEEASMIVLRISLVALIVLPFFGLISDYIGRRSSFAISASIGLLGCLMLAYFTLVNYNPGLALLSLFVIPIGFGSHALFGVWSSEMFPTKVRATATSVIFSIARGLSVGGLIVGYVATFSSLLYGMLLGGIAFLLMCIFPWLLPETKGRELEEF

SEQ ID NO: 21399 - protein, 281 aa, Archaeoglobus fulgidus
MKVFVIGAGLMGRGIAIAIASKHEVVLQDVSEKALEAAREQIPEELLSKIEFTTTLEKVKDCDIVMEAVFEDLNTKVEVLREVERLTNAPLCSNTSVISVDDIAERLDSPSRFLGVHWMNPPHVMPLVEIVISRFTDSKTVAFVEGFLRELGKEVVVCKGQSLVNRFNAAVLSEASRMIEEGVRAEDVDRVWKHHLGLLYTLFGPLGNLDYIGLDVAYYASLYLYKRFGDEKFKPPEWLQEKIKKGEVGVKAGKGIYEYGPKAYEERVERLKKLLRFLGLE

SEQ ID NO: 21400 - protein, 371 aa, Archaeoglobus fulgidus
MRVVFGWGRLERIEEEVERLKGGKVVFIADRAVRKAVEELNLSFDYEIFSDVEPEPEIGIVDDIIEKFSFDTVVGVGGGSTLDVAKLTAVAAGEKAKAVELVGKKLPERKCKLLLCPTTAGTGSEVTKLAVFKIPKREVKYVFDDESLYADIAIIDPKLTLSCPPHVTASSGIDAFCHAIEAYTSLFSNPISDMFAEKAIAIIPKALREAYANGENVRARTDMSFASLLAGIAFNSAGTGLGHALGYAHNHIHNSPHGKSVGITMPYVLQYNAIADLEKHARIARALGESGSSLRETALRAGIGFAKLLKDLGMPHKLSDVGAGEDDIEKIVDRIFLSEKHVRRNPRVVRREEMYDVVRKSIHGILREEEY

SEQ ID NO: 21401 - protein, 342 aa, Archaeoglobus fulgidus
MRDVVRFINPYDPGLFPEDFPDKEVVNLSSNENPYEPSEEVREAYLRAVKYIPRYPKADYARLKKALAEYTGFEVENIAVGCGASELISCICNVLLEELDRVVIPMPSYTLYSIYAMLRSASISFPVFEGYRVDPDVIAEERPKLVFLCSPNNPTGNSLSREIVQKVAESAEYVVLDEAYVEFSDDSKIEMVRDYNNLIVLRSFSKFFGLAGMRVGYAVCSAEIAEAIEKVRLPFGISYPAVETAIAALRSLDYYKKVRDRIVRERERLIEKLKEIEWLEVYPSDANFVLVKANKEGVVEKLAEKGFIVRDASVMGLEGLYIRITVGKREDNDRLIEALREI

SEQ ID NO: 21402 - protein, 537 aa, Archaeoglobus fulgidus
MSEAYNYQLLLKHILESGVTYAPKQEIVYRDLKRFTYRDIYERVHRLASALEELGVKKGTKVAVLDWDTNRYLECFFAIPMMGAVLHTVNVRLSPEDILYTMQHAEDEVVLVYKDFVPLIESIADKLDTVKKYVVMTDDTMPETKLTDVEYEEMLKKASPNYDFPDFDENTMATLSYTTGTTGRPKGVWFTHRKLFLHTLAGCIAMTGYRSVLRLKEDEVVYMPLTPMFHVHAWGVPYMMWLLGHKHVYPGRYEPQMIVKLVMTEGVTYSHCVPTILQMIVDNLPEGFKFPGWKMIIGGAKLPKGLALRAREKGIITMAGYGMSETCPILTGGFLKPHLLNVDEETKVELSIKTGIPFPLVYVRVVHDDFTDVKPDEQDMGEVVVRAPWLTDSYLKDPEKTKELWEGGWLHTGDIAVMDEEGYITIVDRLKDVVKSGGEWISTLTLENLLSLHPKVREVAVIGIPDEKWGERPLAIIVPMPGEKPTPEELRAHLMKFVEEGKITKWAVPDRFEIVDEIPKTSVGKIDKKVLKQMYSR

SEQ ID NO: 21403 - protein, 409 aa, Archaeoglobus fulgidus
MRLLRQHRNIMVKRQILNFPVGRGFMDFELTQEQKDIKNAAREFAVNEFTKERAEEYDRNEEFPFDLWKKACELGFIGVHFPEEYGGAGMGVLENILIVEEFCRADSTIGSAIILSDFSSEVVMRFGSEEQKKEVLPKVAGGKAITAGCYTEPEAGSDLTAIKTKAEKDGDEWVINGSKTFITNGTIADYYVVLAVTDPNAQPRYRGFTTFLVKKDTPGLKTTKIGGKLGIRASPTAEVVFKDVRVDDSAVIGQLNRGFYQVLEFFDESRIEIAAQALGIAQGAFDRLVNYVKQRKQFGQPIAAFQALQHRIADLKTQLEAARLLIYKAAWNYDQGRIDPGLTSMAKYYAGKLAVKICDEAVQMHGGYGYIAEYEVERFFRDAKITEIYEGTKEVQLNTIARDILGKFR

SEQ ID NO: 21404 - protein, 319 aa, Archaeoglobus fulgidus
MENFEIWVEKYRPRTLDEVVGQDEVIQRLKGYVERKNIPHLLFSGPPGTGKTATAIALARDLFGENWRDNFIEMNASDERGIDVVRHKIKEFARTAPIGGAPFKIIFLDEADALTADAQAALRRTMEMYSKSCRFILSCNYVSRIIEPIQSRCAVFRFKPVPKEAMKKRLLEICEKEGVKITEDGLEALIYISGGDFRKAINALQGAAAIGEVVDADTIYQITATARPEEMTELIQTALKGNFMEARELLDRLMVEYGMSGEDIVAQLFREIISMPIKDSLKVQLIDKLGEVDFRLTEGANERIQLDAYLAYLSTLAKK

SEQ ID NO: 21405 - protein, 332 aa, Archaeoglobus fulgidus
MKVGIIGASGYTGSELLRILANHPEAEVIAASSRRYEGQKIWKVHRFLKGFYDLEFCSPELSNFGDCDLVFTAVPHGEAMKYVPQLLDSGIKVVDISADYRLDKETYERVYGKKHEGYVEAVYGLTELHREEIKKANLVANPGCYPTGTILAASPLAKLELIERVVFDCKSGITGAGESPSAFTHYPNLHESIVPYKITEHRHYYEMVQELGRFQSDIKISFTPQVYPGSRGILTNAHVFLRGELTREELYRIYEEFYEDSFFVRIQESVSLSQVRGSNFCDISIHPGEDRVVVVSAIDNLVKGASGQAVQNMNLMMGFDETLGLRTPPLFP

SEQ ID NO: 21406 - protein, 811 aa, Archaeoglobus fulgidus
MGDNMEITLKVNQAYPSDSGRGIARLDPDTMLKLQISPGDIIEIEGARKTVAKVWRAPKRDWGKNIIRIDRFIRENAGVGVGDVVKVRKVEYQPAKTVILAPLKKMDLRIYGVDIGEYLKHQFLKRPVVEGDLVPLVGSPALSGFGRYNQQNQAVVFVAVKTEPKGPVVIDETTKVVYRDRPAKGFERFGKAGITYEDIGGLKEELQKVREVIELPLRYPELFQRLGIEPPKGVLLYGPPGTGKTLIAKAVANEIGASFFTINGPEIMSKFYGESEQRLREIFEEAKENAPSIIFIDEIDSIAPKREEVTGEVERRVVAQLLTLMDGLEERGQVIVIGATNRIDAVDPALRRPGRFDREIEIGVPDREGRYEIFQIHTRNMPLEAKYSREFVLDAIERFKRQVDDPELIKNLDFLYDEIKNSETEEEVKGAVKNLLPQEVIDELEVEITKAMLRSLADQTHGFVGADIEALCKEAAMKALRRYLPQIDLNEDEIPIELLESIRVTWDDFMDALREIEPSAMREVFVEIPKVTWNDVGGLEDVKREIIEAVEWPLKYPEKFKKFGIKPPKGVLLYGPPGTGKTLIAKAVANESEANFISIKGGQILSKWLGESEKAVRKIFRKARQVAPCIIFFDEIDAIAQMRGIDEGSRAVERVLNQLLTEMDGLEELHGVVVIGATNRPDILDPALLRPGRFDRMVYVRPPDKKSRLAIFKIHTRDMPLSEDVDLEELADLTEGYVGADIEAICREAVMLAIRENINAEKVEMRHFLEALKKIKPSVNEAMLNFYERFEEKMRTERMQVAATKPFMGYG

SEQ ID NO: 21407 - protein, 402 aa, Archaeoglobus fulgidus
MRALVVELRLWKAALSLLLGKVTKSVYYSPLSLLKYYKNYPEPALPDEDWVKVKTRLCGICGSDLRIITLQESFYLAPLTSFPFIPGHEVVGEVVEVGKEADAQEGERVVINTALSCRVRGFDDCDACRKGHFAACHNVDRGRISPGIFTGTCRDTGGGWAEYFVAHESQLVRVPEGIRDENAVFAEPLTIGIHSALRSFPDDGEVVAIVGCGVIGICTIIALRHLGFRGEIIGIDISERQAELARKFGADGVVTENPVERIAEMTGGRVYRPPRDKPMFIGGGVDVAFECTGIPQTVDTALRITKPLGRVVIAGTVAKMGVDWAPVFAKELSVLGTFGCGIEEVNGEKRDAFDIAFEILKKVDLSSLLTHRFTIEDYKKALRAAIEKGKSGAVKVAFDFTL

SEQ ID NO: 21408 - protein, 379 aa, Archaeoglobus fulgidus
MMQRGANRIEVVQPSATLRVSTMAKELKREGKDVVDMSVGEPDFPTPDFIIEAAYKAMKEGKVFYTPTKGVPELIDAIVEKLRNENGIDVGAENIIVTPGAKYAIFEAMMCLLQEGDEVILLDPSWVSYEACILMAGAKPVWVPHEEGFEDAPIEDYITSNTKMIVVNTPSNPLGVVYPKEFLKKVRDLAVDKDILVMSDEIYEKIIFEGEHYSLAAMDGMLERTITINGFSKTYSMTGWRLGYAAAPEWIIKLMNRMQSHSVSHPTSFVQYAGVAALKGDQSFIKEIVEEFRARRDMIMAKLDEMGIEYAPPKGAFYIFMNVGRDSNEFCEEFLKREYVALTPGSAFGVAYKSWVRLSYATSRERIGEFLSRLERFLG

SEQ ID NO: 21409 - protein, 355 aa, Archaeoglobus fulgidus
MGPMSIEQQIRELEEEIKRTPYNKATEHHIGRLKAKLARLREEAEKQKAKAARQAFSLKKEGDATAVLIGYPSVGKSTLLNKLTGAKSEVADYDFTTLKPVPGILNYKGASIQIIDVPGIIEGAASGRGRGKEVISAVRVADLIIIVADVFNLHTIDIVKRELYEGGIRLDQKPPDVVIRKKERGGVRISSTVPLSIDEATITSVLKEYKIHSADVVIREDITIERLIDALAGNRVYIPSLTVVNKIDLMDVDVADAIKVSAEKGINLDLLKEQIYRKLEFIRVYLKPPGGKVDFSEPMILRRGATVEDICRKLHRDFVENFRYAKVWGKSVKFDGQRVGLEHVVEDGDIITIYA

SEQ ID NO: 21410 - protein, 287 aa, Archaeoglobus fulgidus
MAIIVDERTKVVVQGITGYQGKFHTERMLNYGTKIVAGVTPGKGGTEVLGVPVYDSVKEAVREADANASVIFVPAPFAADAVMEAADAGIKVIVCITEGIPVHDELKMYWRVKEAGATLIGPNCPGIISPGKTHLGIMPVQIFKPGNVGIVSRSGTLTYQIAYNLTKLGLGQSTVVGIGGDRIIGTDFVEVLRLFEDDKETKAVVLVGEIGGRDEEVAAEFIREMSKPVVGYVAGLTAPPGKRMGHAGAIIEGGVGTAESKIKALEAAGARVGKTPMEVAELVAEIL

SEQ ID NO: 21411 - protein, 380 aa, Archaeoglobus fulgidus
MRLHEYQAKQIFSKHGIRVARGELATSVEDVRGIAEELGGKVVLKSQVLVGGRGKAGGIKKAYSVEEAVEKAKEMFGSVLKGHIVEKIYVEEMIEVQREMYAGLTIDRANKGIAAILSSVGGMDIEEIAVKHPEKIARIAVNPKWGLWDYQIRELLLNSQMPREYWKEVASILKTLYRIMVHYEAELVEINPLVVTPDGLVAADARLNIDDSALFRHRDLEKLRDYTEADQMERIAMEKGLNYVKLDGNVGVLANGAGMAMATMDLIYIYGGKPANFLDIGGGASAEVVREAINLILSDKNVKVVFINIFGGITRCDEVAKGLKEALADVSTPVVVRLAGTNEEEGRKIMDEFAKDRPNFHIVETMEEGAEKAVKLAEEV

SEQ ID NO: 21412 - protein, 416 aa, Archaeoglobus fulgidus
MGKTIAEKILSEKSKSDAYAGDIVVAEIDQIALQDGTAPLAIRQLMELGTEVRAADRTHFFVDHAAPSPRRELSNDQKFIYEFAKKVGADFNPPGEGIIHQIMVERYVKPGDLAVGADSHTCTYGGIGAFSTGMGSTDVAVAIALGKNWFRVPESFRVQLDGSLPKGVFAKDVILKLIGDLGVDGATYKALEFHGECAENMTVEERLTIANMAVECGAKAGIFESDENTRKFLAELGREGDFREVKADEDAEYEKEIYMDVSSLVPVVSKPHNVDNVAEISEVEGTEVNQVYIGTCTNGRLSDLEVAARILKGRKVKEGVRLIVVPASRRVYLQALDKGLIRVFVEAGGMVLNPGCGPCVGIHQGILADGEVCISTQNRNFKGRMGNPNAEIFLASPATAAASAVKGYIADPREFL

SEQ ID NO: 21413 - protein, 741 aa, Archaeoglobus fulgidus
MMRQGGVMVGARKRWITDWWPNRLNLKILRQNLQNPYGEDYDYVEEVENLDIDAVIRDLKELMRSSQDWWPADFGHYGPLFIRLAWHSAGSYRIFDGRGGARDGSIRFPPRINWPDNINLDKAIRLLWPIKKKYGRKLSWADLIILAGTVAMEDMGVKLFGFALGREDIFEPDESPDWGPEEEMLTAKRGEKEELERPFAATEMGLIYVNPEGPGGNPDPLGSAQEIRVAFRRMGMNDEETVALIAGGHAFGKCHGAGPADYLGPDPSSSPIEMQGLGWKYNYGKGKGSDTFTSGLEVTWSPTPTKFGINYLRILFTYEWELEKSPAGKNQWVAKDAPEIIPDAHDPNKKHRPRMLTADLALRFDPEFSKIARRFLENPEEFEKAFAIAWYKLTHRDMGPKDCYIGKYVPEETFVWQDPLPRRDYELVDEKDVEELKRRILASGLSLSQLVYFAWASASTYRNSDRRGGANGARIRLKPMSVWEVNHPEELKKVIAAYEKIQQEFNEGAKGSEKRISIADLIVLGGIAAVEEAARRAGFSVKVPFIPGRVDAQQEHVDEEFYRVIEPFADGFRNYFRYPERINERDVYTTPEYFLVDKANLLTLTVPEMVVLIGGMRALGANYSHSDYGVLTERPGVLSNDFFVNLLDMSVEWRAADDYRYTFEGYDRKSGELRWRATRVDLILGHHDELRAVAEVYGCDDAKEKFVKDFAAVCAKVMHLDRFDLWRSNRKLYKEITAGLR

SEQ ID NO: 21414 - protein, 545 aa, Archaeoglobus fulgidus
MATLQGTPVLILKEGTQRTVGRDAQRMNIMAARVIAEAVKSTLGPKGMDKMLVDSLGDVVITNDGVTILKEMDVEHPAAKMIIEVAKTQDNEVGDGTTTAVVLAGELLKKAEELLDQDIHPTVIARGYRMAANKAVEILESIAMDIDVEDEETLKKIAATAITGKHSEYALDHLSSLVVEAVKRVAEKVDDRYKVDEDNIKLEKRQGGSVADTKLVNGIVIDKEVVHPGMPKRVKNAKIAVLKAALEVKETETDAEIRITDPDQLMKFIEQEEKMLKEMVDRLAEAGANVVFCQKGIDDLAQYYLAKAGILAVRRVKQSDIEKIAKACGAKIITDLREITSADLGEAELVEERKVGDEKMVFIEGCKNPKAVTILIRGGSEHVVDEVERSLQDAIKVVKTALESGKVVAGGGAPEIEVALKIRDWAPTLGGREQLAAEAFASALEVIPRALAENSGLDPIDILVELRKAHEEGKTTYGVDVFSGEVACMKERGVLEPLKVKTQAITSATEVAIMILRIDDVIAAKGLEKEKGPEGESGGEEDSEE

SEQ ID NO: 21415 - protein, 444 aa, Archaeoglobus fulgidus
MIVHPIDYRYGTPEMKRIWSEDSKIKRMVRVEMALLRALAKKGYLSEEEAKEAKKKAYSVTPERVKEIEAEIKHDIMALVKAITEATGCRWVHFGATSNDIIDTATALQLRDSLKILEVKIKRLAKVLADKALEYKDVVCLGRTHGQAALPTTYGFRFALWAAEVARHYIRLQQMKDRLLVGQMSGAVGTQAAFGKDGFEIEEEVMRLLNLKPALISSQIIPRDSYCEYLEFLANLAATLEKIALNFRLLQRAEVGELMEKFEAKQVGSSTMPHKRNPIDCENVCGLARVVRGFVEPQHQSAILWEERDLTNSSAERITLVESTVLADHILTKMIKVVSSVSLNLENIRRNLEMQRGLNLSEAVMIEMTKRGVGRQEAHEILRQAAMRAYENNSSLLDELLKDERVMKYFKEDELREILKPENYLGTARERVERVVRWVNEVLK

SEQ ID NO: 21416 - protein, 414 aa, Archaeoglobus fulgidus
MEEVYIVDFLRSAFSRSRPKQPEKDVFNKIDMPAVAAMLIKEMVNRTGIDPKEIGDVITGCTMQMKENWLYGGKVVPLLAELPVEVPAHGVERVCNSSTTAVHHGTMEIMLGYSDIVIACGFEHMTHLPMQMDLNPHIGISPTLMSRTDLIQKYDLMTAMSMGLTAEKLFEVAKDEMGWTKRDLDEWGVRSHKLAAQAVKEGWFLEGEGYPMKWKGEILPIEVEQADGSKKVIDVDQSIRPDTTLEQVEKLPPAFKPGGVITAGNSSPLNAGATALMLMSKKKMKEYGLEPMAKIVSMGWASIDPSIMGASPVPASLKALQKAGLEAKDIDYWEINEAFSVVPLYTIKKLGLDPERVNIKGGAIAIGHPLGASGGRVLGTLARILLVQEAKYGCATLCGAGGQGGATIIENPYI

SEQ ID NO: 21417 - protein, 402 aa, Archaeoglobus fulgidus
MRWLKMLADFILTEDQKAIKEAAREFAEKEFPNYVEECDREEKFPFELWKKAAQLGFIGMAIPEQYGGQGLGVLDSCLVVEEFWRVDGGLGMILATTFGSEQIIAFGNEEQKKKYLPPLAKGEKICAACYTEPQAGSDVAGIKTRADKDGDEYVINGTKMFITNGSIADYYIVLARTDPNPPKRHHGMSVFLVERDMPGVQANKLKNKLGIRASDTAEVVFKNVRVPKENLIGQEGQGFYQTMMFFNITRIPVAFQALGLAQGAFELAYHYARNREVFERKLADFQVTQEKLAKMRTELEAARLLAYQAAYFQDKMGMPDPGLTAMAKYYTAKAAQFIVNEALQIHGGYGFMGEQHISRMYRDVRILEIYEGTREIEMEVIARSLLGKIPSRLGVVRKHPLQ

SEQ ID NO: 21418 - protein, 390 aa, Archaeoglobus fulgidus
MKVVLSYSGGLDTTVCIPLLKEKYGFDEVITVTVDIGQPEADIKQAEERGKKYADKHYTIDAKKEFVDSLFMLIKANGNYEGYVLGTALARPLIAEKVVEVAKKEGAEAVAHGCTGKGNDQLRFENIFRQHGFKVIAPVRELNLTREWEIEYARQHGIEVPATKEKPYSIDENLWSRSVEGGKLEDPSFEPPEDIYEWTASPEKAPDKPEIVKIDFEKGVPVALNDERMGGFELIKALNEIGGKHGVGRTDMIEDRVLGLKARENYEHPAATILITAHRDLENLVLSRRELKFKKFVEEEWAELVYYGLVNDPLFDALNAFIDKTQERVTGWVKVKLYKGSAVVVARNSPYALYSEELVSFDTESIDQRLAEGFAAFHGLQGRLFRRLFQ

SEQ ID NO: 21419 - protein, 368 aa, Archaeoglobus fulgidus
MKEVNKVEFEDLGISENGLNAVRRKGFEKPTEIQREIIPRFFEGEKDMVGQAQTGSGKTAAFALPILDLVDERSKDVQAIVITPTRELALQVKDEIESLRGGKKVHVLAVYGGQPIFPQIERLRKGVQIVVGTPGRVIDHLERRTLSLEKVRFFVLDEADRMLDMGFIDDIERILRHAGAERRVLMFSATMPPEVLRLARRYMRDYEVVRVHSKITPENVEHRCLKVNPEKRFEHLCRILDENNFYGIVFCQTKKETRELGRRLRARGYKADALNGDIPQHKRESILRNFRKGYTRVLVATDVAARGIDVKDLTHVVNYSIPQDPEAYIHRTGRTGREGKRGKAITFVAPWESRKLKIIERTAKVRFR

SEQ ID NO: 21420 - protein, 668 aa, Archaeoglobus fulgidus
MPRRVKQVINMDVRERIKTVAVLGAGLMGHGIAEVCAMAGYNVTMRDIKQEFVDRGMNMIKESLAKLEQKGKIKSAEEVLSRIKPTVDLEEAVKDADLVIEAVPEVVEIKKQVWEEVDKLAKPDCIFTSNTSTMRITMLADFTSRPEKFAGLHFFNPPVLMRLVEVIRGEKTSDEVMDLLVEFVKSIGKTPVRVEKDVPGFIVNRVQAPASVLLMAILEKGIATPEEVDATVRRLGLPMGPFELVDYTGVDILYNALKYYAQTISPDYEPPKFLEEMVKANKLGRKTGQGFYDWSKGRPQIDSSKATDKINPMDFTFVEINEAVKLVEMGVATPQDIDTAIKLGLNRPFGPFELAKQFGAEQIAKRLEELAKQFGKKIFEPAKTLKEGKLEELLKAGKAEAEEKKEDEFKTIKIEKLDGGITKLVLNRPDRLNTISPEVLDEIDRAITQLWNDKDTRVIVITGAGDRAFSAGADLGGSIITHPFDFLEHNRKGERVFTRLREIPKPVIAAINGYALGGGLEIAMNCDIRLAKKSAVLGLPEVGLGILPGWSGTQRLVKLVGISRAMQLALTGERITAEEAERWGLVNKVFDDDKFEEEVMNYAKNIAERCAPISMALIKRLINKGGEVPMDIGLEWECTAAGLLFATEDMREGISAFLRKDKPQFKGR

SEQ ID NO: 21421 - protein, 411 aa, Archaeoglobus fulgidus
MCSGDKMEMELSQEHRLFRDSLREFLAKEVEPIADERDRKGPLSKGEVLEFFAKFRKLGIGYDPESLSVYFEDPFYYGIASEEISRVWASLNVVLGMSFPVVFVNLASDQTKDAMMPKLEKNQLIGCLAATEPEAGSDTTKLKTTAELDGDEWVLNGTKTWISNATVADVALVVATNREMRMQDMFLVDQVNSPFETSELHKLGWRAAPTGEIYLRNCRVPKDNALSVMIQKALSSGGMVEALPIAASISKLYAYMSPLSAVFCLMRSGMALMATGISQAALDASIAYARQRKAFGKPIGKFQLIQDMLYKMAAITESSRLLGYKALYMIQKGDPKARYMSSLAKGYACEGCVEVTYNAIQIHGGLGLSDEYPLERYFRDARVMTIPDGTTEIQKLIVGRELLGKGFSAYT

SEQ ID NO: 21422 - protein, 326 aa, Archaeoglobus fulgidus
MDRFQRLIAMLKEEIAKRAEIINKAIEELLPEREPIGLYKAARHLIKAGGKRLRPVISLLAVEALGKDYRKIIPAAVSIETIHNFTLVHDDIMDRDEMRRGVPTVHRVYGEATAILAGDTLFAEAFKLLTKCDVESEGIRKATEMLSDVCIKICEGQYYDMSFEKKESVSEEEYLRMVELKTGVLIAASAALPAVLFGESEEIVKALWDYGVLSGIGFQIQDDLLDLTEETGKDWGSDLLKGKKTLIVIKAFEKGVKLKTFGKEKADVSEIRDDIEKLRECGAIDYAASMARKMAEEAKRKLEVLPESKAKETLLELTDFLVTRKK

SEQ ID NO: 21423 - protein, 240 aa, Archaeoglobus fulgidus
MSELKSDVTILKIGGSVITDKSRGAFEKLKERELREVCRAISEKWRNLIVVHGAGSFGHPHVKKFGLSPLGASKVHLGCLRLSERFCSVLTEFEVPAYPIHPFLAYSVEIVDKAMKSGFLPVLHGDVVMAEKIEVLSGDDIVAHLAEAFKAEKIGFATDVEGVYDFNGNVIDRLDRSLLEEMIAKGGVAKGKEDVTGGMLRKLQKLYEMGHGCKAYVFKGNYENLKKFLQGEKVGTEVII

SEQ ID NO: 21424 - protein, 284 aa, Archaeoglobus fulgidus
MIASAPGKIILFGEHAVVYGRHAVVSAINLRCRVSVRKSDRFLIRSSLGESGLDYQRHPYVVQAVKRFGELRNIPGAEIEIESEIPIGSGLGSSAAVIVATIAALNAEFDGDMDKEAIFQMAKQVEIDVQGRASGIDPFISTFGGSWLFPERRKVEMPFKFFVINFGSRSTAEMVAKVAELRERHPEVVDKIFDAIDAISLEASDVGSAERLEELIAINQSLLRAIGVSNPEIDRTIAELERMGLNAKITGAGGGGCIFGLFKGEKPKGSFIVEPEKEGVRIEE

SEQ ID NO: 21425 - protein, 219 aa, Archaeoglobus fulgidus
MDYDEKRERLAERLRQELNLSRKVYEAIRKVPRHLFVPESYKNEAYVDTPLPIGYGQTISAPHMVAIMCELLDLREGDKVLEVGTGCGYHAAVTAEIVGKSGKVISIEYIPELAERARAILKALGYDNVEVIVGDGSKGYEKEAPYDKIYVTAAAPDIPKPLIEQLKPRGRMVIPVGDSVQWLIIVEKDESGNVRKKNWGSVRFVPLRGEYGFKSVRYD

SEQ ID NO: 21426 - protein, 269 aa, Archaeoglobus fulgidus
MLYLGVIGYPIKHSVSPAMHNAALQHEGIEGIYLAFEVKPDRLRDAVFGAKALGFRGLNVTIPFKESVVEFVELEGEAAKIKTVNTIDLVEMVGYNTDVYGVKAALSGTELGGKTALVVGAGGAGKAAALALLDMGSTVIVANRTEEKGREAVEMLRRYGECIFWPLSRVEELKGKVDVVVNATPLGMRGFKAEIPVPPSMLDGVELVFDTVYNPMETPLIREAKKRGCKVVYGIEMLVHQGAKAFEIWTGIEPDVGVMREAALRALRF

SEQ ID NO: 21427 - protein, 373 aa, Archaeoglobus fulgidus
MREAARLSQISTSMIRRMFEIVERAKKEGREIISLTIGEPDFDTPQEVIERACRAMNAGFTHYTSNFGLEELRSAIAERYGVDSSNVMVTAGGSEALLNASLAFIEEGSKVVIPSPNFLSYFTYAKMCGGQIVQLRTHNNGFLPDVEKLNEIIDRNVSVIFLNYPNNPTGAVIDEKDARAVVEIAADNKAIVVSDEIYDQIYYDVKPTSLAGYENVVCVNGFSKSLSMTGWRIGFTIADEKLLDPMLKVHQVNGVCAPAFAQKAVAEVMAERLFDSIVSRMVKEFRQRRDYLYSELSKIYDVVKPEGAFYMFVNVNQDCMEYAENLINLGVAVTPGLPFGDGNETYVRISYANSLENLKKAAEIIREYESQRA

SEQ ID NO: 21428 - protein, 562 aa, Archaeoglobus fulgidus
MSGILGIEGQNIRETDGSGINRIWVKHYDEGVRDRLDYPVMPAYRILEMAAEKYGNKVGTIFFGNQITYRQAKEASDKVAGFLFDIGIEKGDRVIFALPNTPHAAPIMAGILKVGGIIVQCNPLYTQREIKFLAEDSGAKTMFCMDMLYSNVSPLLDDGTLDTVITCSLQDFMVGATMPDPPEKRKGLYSWKNVMEAEKTERRAEINPKEDVAMLQYTGGTTGFPKGVMLTHFNIVANAYQAANWDPKASSADVGIGMLPVFHSYGMTMMNVGILVGATIIPMPDPRNYPMVLQAIQTFKVTTLAAVPTMYIGMLKLLEENGYDLSSLRVCTSGAAPLPIEVKRRWEELTGKRITEGYGLSEASPITHGNPIYGLNKEGSVGLPYPDTIAVVIDDEGNILPPGEVGELVIRGPQVMKGYWNRKEETENTLINGWLLTGDMAKMDEDGFFYIVDRKKDMIIAGGFNIYPREIEEVLYEHPAVAEAAVVGIPDPYRGETVKAFIELKPGWKGKVTEEDIIKFCKERLAPYKVPKLVEFRDELPKSLVGKVLRRVLREEEMRKQG

SEQ ID NO: 21429 - protein, 182 aa, Archaeoglobus fulgidus
MARYGMVIDLEKCLGCEACVTACIEENNVPYETGLRTQVHRVVTGKFPNVSTMYMHRICQHCEHPGCVHVCPTGASYVNEDGIVLIDYDLCIGCKYCMVACPYLARYIHPERHTPDKCTFCVHRVKEGKLPACVETCPANARIFGDLDDPNSEVAKLVAENRAIPIGAEYGTKPKVFYIRPR

SEQ ID NO: 21430 - protein, 384 aa, Archaeoglobus fulgidus
MRRVAVVGVGQSKFGELWEKGFRDIVLEAGREALEDADLEGREIEAMFVGNMSGGRYLGQEHVAALIADYAGLAEFGIPATRVEAADASGGLAVRQAYMAVASGLHDIVIAAGAEKVTDVDDPMQILSSSVDVEWENFVGGSLPALYAIIARLHMDSFGTTEEDLALVSVKNHRNGAKNPKAQFRKEIRVEDVLNSPYVAEPLKLLDCASVSDGAAAVILASEDVAREITDTPVFIEACTQASDYLALQSRKDILSMRAVVKASRDAYELAGVGPKDIQVAEVHDSFTIAEILAYEDLGFAEKGKGAELVREGVTEIGGKIPVNPSGGLKACGHAVGATGVRQIVELTLQLRGEAGERQVDAETGLALNIGGTGATAVVSILRR

SEQ ID NO: 21431 - protein, 375 aa, Methanococcus jannaschii
MISSRCKNIKPSAIREIFNLATSDCINLGIGEPDFDTPKHIIEAAKRALDEGKTHYSPNNGIPELREEISNKLKDDYNLDVDKDNIIVTCGASEALMLSIMTLIDRGDEVLIPNPSFVSYFSLTEFAEGKIKNIDLDENFNIDLEKVKESITKKTKLIIFNSPSNPTGKVYDKETIKGLAEIAEDYNLIIVSDEVYDKIIYDKKHYSPMQFTDRCILINGFSKTYAMTGWRIGYLAVSDELNKELDLINNMIKIHQYSFACATTFAQYGALAALRGSQKCVEDMVREFKMRRDLIYNGLKDIFKVNKPDGAFYIFPDVSEYGDGVEVAKKLIENKVLCVPGVAFGENGANYIRFSYATKYEDIEKALGIIKEIFE

SEQ ID NO: 21432 - protein, 539 aa, Methanococcus jannaschii
MKTDILIIGGGGAAARAAIECRDKNVIIAVKGLFGKSGCTVMAEGGYNAVFNPKDSFKKHFYDTVKGGGFINNPKLVEILVKNAPKELLNLERFGALFDRTEDGFIAQRPFGGQSFNRTCYCGDRTGHEIMRGLMEYISKFERIKILEEVMAIKLIVKDNRCYGAIFLDLKTGNIFPIFAKATILATGGAGQLYPITSNPIQKTGDGFAIAYNEGAELIDMEMVQFHPTGMVGTGILVTEAVRGEGGILYNKYKERFMVRYDKERMELSTRDVVARAIYKEIQEGRGVNGGVYLDVSHLPNEVIEKKLETMLKQFLRVGIDIRKEPMIVSPTAHHFMGGLKINERCETNIIGLFACGEVTGGVHGANRLGGNALADTQVFGAIAGKSAKEFVENHDFNNIDAEEDVAKILEEINSLKGDLNVYNLIEDLRKVMWDYVSIIRNEDGLKKALEKIDEIERNIDNVKVNGIIDLQNYFELKNMVVVAKLVTKSALYRKESRGAHYREDFPETKEEWRGNIIIKGKKMWFEKLDYSVFQNFLE

SEQ ID NO: 21433 - protein, 300 aa, Methanococcus jannaschii
MGMDMIEMIEKAEILMEALPFIQKFYGKIFVIKYGGHAMIDEKAKNWTAQDVVLLKYVGINPVVVHGGGPEINKAMEKMGKKPEFVHGLRVTDEETLDIVEMVLAGKINGDIVSKLSKFGGKAVGLSGKSGRIILAKKKLKKIKTEKGEEIEVDLGRVGETVEVNTELLEILINNGYIPVVSPIGLDEKGEAYNLNADTVAGDIAGALKAEKLILITDVDGIMDDINNPETLHRKLTASELKEMIEDGRIKGGMIPKAESALYALEHGVKSVHIINGKIPHALLLEIFTEEGIGTMITRD

SEQ ID NO: 21434 - protein, 302 aa, Methanococcus jannaschii
MLILGVGYFLLGLILLYYGSDWFVLGSERIARHFNVSNFVIGATVMAIGTSLPEILTSAYASYMHAPGISIGNAIGSCICNIGLVLGLSAIISPIIVDKNLQKNILVYLLFVIFAAVIGIDGFSWIDGVVLLILFIIYLRWTVKNGSAEIEENNDKNNPSVVFSLVLLIIGLIGVLVGAELFVDGAKKIALALDISDKVIGFTLVAFGTSLPELMVSLAAAKRNLGGMVLGNVIGSNIADIGGALAVGSLFMHLPAENVQMAVLVIMSLLLYLFAKYSKIGRWQGILFLALYIIAIASLRMG

SEQ ID NO: 21435 - protein, 663 aa, Methanococcus jannaschii
MQNWFKSGDSLNLVDLYVKKFMDLIEIERRCEMDFHKNEIIKLGKKRENVGRAILNLKGKFLGESLGCTIVRFGRKKPFKTEISPGDVVLVSKENPLQSDLYANVIYVGKNFIDVAFDVDVPKWVYKERVRVDLYVNDITFKRMKEALREFARKRDKLAYIILGIEHPEKPLREDIKLEFYDKNLNESQKLAVKKAVLSRDLYLIHGPPGTGKTRTITEVIVQEVKFNKHKVLATADSNIAADNILEYLIKKYPDLKVVRVGHPTRISKDLIQHSLPYLIENHEKYQEILALREKIKEIKEQRDKFLKPSPRWRRGMSDEQILKVAKRKKSYRGIPKEKIVSMAEWIIRNKKIKRIINNLDEITEKIMNEILAEADVIVATNSMAGSEILKGWEFDVIVIDEGSQAMEPSCLIPIVKGRKLIMAGDHKQLPPTVLSENEELKKTLFERLIKKYPEFSSILEIQYRMNEKIMEFPNKMFYNNKLKADESVKNITLLDLVKEEEIDEVDRDIINEIPVQFINVEGIERKDKESPSYYNIEEAEKVLEIVKKLVKYKIPTNVITPYDAQVRYLRRLFEEHNIDIEVNTVDGFQGRENEAIVISFVRTKNFGFLKDLRRLNVAITRAKRKLILIGNENLLKQDKVYNEMIKWAKSVEEEHKNKIIQK

SEQ ID NO: 21436 - protein, 447 aa, Methanococcus jannaschii
MVGMMRKTKILVTLGPSLENKLDKAINLIDGVRFNMSHATTDYCEKFLNILEKNNIAKVMDLKGIKIRIKEVKLKNKILKMGEKVVIGEDIKLNYNIDTIEEGHFILINDGKIKLRVVEKTDKIIAVVEVGGEIKEGMGVNLPDTRIELPIIDETDLKNIKFAVEKDFEYIALSFVRNKEDVKELKDIISEYKGDCEVISKIETKEGLKNIKEIARESDGVMVARGDLGVEVPIENIPIEQKNILRIANRYGILSITATQILDSMINNPFPTRAEVTDIANAIYDGTDCLMLSNETTIGKYPIEAIKVLNKVAKVADEHYEEFGDRVCLEVESIDEGLVYAVYELYKKLNTKLVITPTYSGRTAKLISKLRINSKIIAPTPNIRTLKRLRLVWGVESCLMEEFDDMEKIINTCREMAKKEIGKGIYLITLGHPIGQKKTNTIKVESI

SEQ ID NO: 21437 - protein, 266 aa, Methanococcus jannaschii
MFIMRREFPEEGDIVIGTVKDVKPYGAFVELLEYPGKEGMIHISEVTSGWVKNIRDHVKVGQRVVAKVLRVDERKGHIDLSLKRVTEQQKRAKVQEWKRFQRASKMLERAAEKLGKSLEEAWEEVGYLLEDEFGELYNAFETMVIEGKEVLDDLEISEEWKNVLYEVAKESIELTNVEVEGVIEMKSYAPDGIKQIKKALTTALKANPYEDVEVKITYIGAPKYRVVVIAPDYKSGEEVFKKVCEKAVATIKKLGGEGTYYRESKK

SEQ ID NO: 21438 - protein, 230 aa, Methanococcus jannaschii
MIIIGIDEAGRGPVLGPMVVCAFAIEKEREEELKKLGVKDSKELTKNKRAYLKKLLENLGYVEKRILEAEEINQLMNSINLNDIEINAFSKVAKNLIEKLNIRDDEIEIYIDACSTNTKKFEDSFKDKIEDIIKERNLNIKIIAEHKADAKYPVVSAASIIAKAERDEIIDYYKKIYGDIGSGYPSDPKTIKFLEDYFKKHKKLPDIARTHWKTCKRILDKSKQTKLIIE

SEQ ID NO: 21439 - protein, 392 aa, Methanococcus jannaschii
MIILKADYKKYNVSELEKLRMDEEKFYETFDNAILLQTCNRVEIIFDADSLEEIKGIENIDLEKFDILFGDKAIEHLFRVACGLESMIVGEDQILGQLKNAYLKAKEKGRISKKLEKIILKAIHTGQRARVETKINEGGVSIGSAAVELAEKIFGLEGKNVLLIGAGEMANLVIKALKEKNIKAIIVANRTYEKAEKLAKELGGMAIKFDKLEEALRYADIVISATGAPHPILNKERLKNAGKTIIIDIANPRDTTDDIRELPDIFLFTIDDLRLVAEENLKKRKEEIPKVEMIICEELERLKEFLDKMRFETAIKELGQYIENVRKKEVEKAKKILKNKNKPVEEVLEDFSKALCKRIIYDIIKIFENVEDKEVFECLAKEFKKLGNKNKN

SEQ ID NO: 21440 - protein, 573 aa, Methanococcus jannaschii
MLWRDVCEIFNKIEKTTKRLEKRDYFIKLIDMVKEKGKPEDLKKICYMAIGRVYPEYDERELGIGEKLLINAVTSIGIKKDELLEKIKETGDIGLAIEQLKSKIKQASLFFQPLTVDEVYETLKRVGEIEGEGSQKKKLRLISSLFLRASPIECRYLARLILEDMRIGMNVPTILDALSVYFNVPKEKLEKIYAITNDIGLLAEKLLMGDLESEELKLKLFRPIKPMLAQLTPSIEEALLEMGRAQFETKYDGARVQIHKDGNKVKIYSRRLEDVTNALPEIVEAVKNINVDKLIVEGECVAIDKQTGKPRPFQDILRRFRRKYDIGKMMKEINLRVYLFDILYKDGVSFIDEEFEKRRKVLEEIVGYENDWRTERKRIEKELKSDKIIDISYKLVTNDAKEAREFYNWSLSIGHEGVMIKNLKAPYTPGSRVRTMYKFKPTLESLDVVITKAKRGMGKRKDWYGSFEICVRDEEGNLYPIGHVGTGLTEADLEFLKEEIDKIIIRDLGEEVEVEPKIVIEVAYEEIQKSDKYPCGYALRFPRVVRFRFDKGVNEINTIEDVERIYEIQRGRK

SEQ ID NO: 21441 - protein, 215 aa, Methanococcus jannaschii
MDLEEQKKAVIEKLIREGYIKSKRVIDALLKVPREEFLPEHLKEYAYVDTPLEIGYGQTISAIHMVGMMCELLDLKPGMKVLEIGTGCGYHAAVTAEIVGEDGLVVSIERIPELAEKAERTLRKLGYDNVIVIVGDGTLGYEPLAPYDRIYTTAAGPKIPEPLIRQLKDGGKLLMPVGRYLQRLVLAEKRGDEIIIKDCGPVAFVPLVGKEGFQG

SEQ ID NO: 21442 - protein, 402 aa, Methanococcus jannaschii
MRVIDGGVTAPKGFKANGYKEGKFGVAIIISEKDAVGAGTFTTNKVVAHPVVLSRELIKNRDKFRAIVANSGNANCFTKDGMEDAKEMQRLVAELFNINEDEVLVASTGVIGRKMDMNIIKDRINKVYNLIKEGNSSINAAKAIMTTDTKPKEIAVEFEVNGKTVRVGGIAKGAGMIAPNMLHATMLCFITTDIEIDKESLTNILQKVVDKTFNNISVDGDTSTNDTVFVLANGLSGVNYEECGEEFENALLYVCRELAKMIVKDGEGATKFMEVVVKGAKTEEDAVKASKAIVNSLLVKTAVFGGDPNWGRIVAAVGYSGADFNPEVVDVILSNYKDEVYLVKDGIPLADEGTEELKKAEEIMKSDEIKIVVDLKMGEFENVCYGCDLSYEYVRINAEYTT

SEQ ID NO: 21443 - protein, 350 aa, Methanococcus jannaschii
MVTYKDAGVDISHEDKVIKALVSQITFKRSDIKPAELGLHYAGAVEFGDYYLVLSTDGVGSKMIVAEMANKFDTVGIDMIAMNVNDAICIGAEPIALVDYLAVGHITEEIAEQIGKGLNEGAKEANINIVGGETATLPDMIKGIDLAGTVLAIVKKDEIITGKDVKAGDVIVGLRSSGIHSNGLSLARKVFFDIAKLDINDKLSYGKTVAEELLTPTRIYVKPVLEMIRDKDIEVKGLAHITGGSFRKLKRLNDKVTYYIDNLPEPLPIFKEIQRLGNVPDEEMFRTFNMGIGFCVIVDEEDANKVIKIANKYNIPAQVIGRVVDSLEVNGNKIVGKAVVKYNDKHIILE

SEQ ID NO: 21444 - protein, 354 aa, Methanococcus jannaschii
MSKGEKMKIKVGVLGATGSVGQRFVQLLADHPMFELTALAASERSAGKKYKDACYWFQDRDIPENIKDMVVIPTDPKHEEFEDVDIVFSALPSDLAKKFEPEFAKEGKLIFSNASAYRMEEDVPLVIPEVNADHLELIEIQREKRGWDGAIITNPNCSTICAVITLKPIMDKFGLEAVFIATMQAVSGAGYNGVPSMAILDNLIPFIKNEEEKMQTESLKLLGTLKDGKVELANFKISASCNRVAVIDGHTESIFVKTKEGAEPEEIKEVMDKFDPLKDLNLPTYAKPIVIREEIDRPQPRLDRNEGNGMSIVVGRIRKDPIFDVKYTALEHNTIRGAAGASVLNAEYFVKKYI

SEQ ID NO: 21445 - protein, 364 aa, Methanococcus jannaschii
MKLHEYEAKNIFKKYGIPVPESFLVSKEDDLNSINVDKEVVLKAQVLVGGRGKAGGILFASNKEEFIKKAEELFNKEVKGEKVEKILVEEKLPIEKEYYVSIIIDRDAKKPLIIFSTEGGVDIEEVAEKNPEKIIKYHIDVRKPFLPYIARWIVKEAKLPSNEIGKVADVIYKLYKIFKELDATMVEINPLVITKDGNVYAADAVLHLDDDAAFRHNYEEFEEYKNKEKLPFAYVELDGDVAVIGNGAGLTLASMDIINNLGRKPACFLDIGGGADAETVKLALRKVLENKNVKGIFINILGGITRCDEVAKGIVEVLKEHPNVKFAVRMMGTNEEIGRKILEEHGIPYETSMEEAGRKLIEQL

SEQ ID NO: 21446 - protein, 465 aa, Methanococcus jannaschii
MATAASAIEYSSVKSIAGPLLIVEGVEGAAYGEIVEVICPDGEKRMGQVLEAREGLAVVQVFEGTTGLSTKDTRVRFTGRTAKIGVSMEMLGRIFNGAGKPIDGGPEIVPEKELDINGYPLNPVSRKVPSDFIQTGISTIDGMNTLVRGQKLPIFSGSGLPHNQLAAQIARQAKVRGEGEKFAVVFAAMGITSEEANFFMEEFRKTGALERAVVFINLADDPAIERILTPRIALTVAEYLAYEKDMHVLVILTDMTNYCEALREISAARNEVPGRRGYPGYMYTDLATIYERAGRVKGRTGTITQIPILTMPDDDITHPIPDLTGYITEGQIVLSRELHRKGIYPPVDVLPSLSRLAGNGQGPGKTREDHKKVVNQAYAAYAEGRSLRDLVAVVGEEALTDRDRAYLKFADEFEDKFVRQGKDEDRSIEETLDLLWELLAILPEEELKRVDRELIEKYHPKYRKK

SEQ ID NO: 21447 - protein, 594 aa, Methanococcus jannaschii
MKREVENMPVVGKIIKIAGPVVVAEGMKGAQMYEVVKVGEEKLTGEIIQLHDDKAVIQVYEETSGIKPGEPVVGTGAPLSVELGPGMLRAMYDGIQRPLTAIEEKTGSIFIPRGVDVPALPRDIKWEFKPVVNEGDYVEEGDIIGTVDETPSIVHKILVPIGVKGKIVEIKEGKFTVEETVAVVETENGERKEITMMQKWPVRKPRPYKEKLPPEIPLITGQRVEDTFFTLAKGGTAAIPGPFGSGKTVTQHQLAKWSDADVVVYIGCGERGNEMTEVIEEFPHLEDIRTGNKLMDRTVLIANTSNMPVAAREASVYTGITIAEYFRDMGYGVLLTADSTSRWAEAMREISGRLEEMPGEEGYPAYLASRLAQFYERAGRVITLGKDNRQGFVCIVGAVSPPGGDFSEPVTSNTLRIVKVFWALDANLARRRHFPAINWLQSYSLYIDDVTEWWNTNTGPDWRQLRDEAMSLLQKEAELQEIVQLVGPDALPDRERVILEVARMLREDFLQQDAFDEVDTYCPPMKQYLMLKIIMTFYQEALKAVERGVEPAKILGVSVKQDIARMKYIPHDEFINVKSKEIMEKIKNELGSLN

SEQ ID NO: 21448 - protein, 695 aa, Methanococcus jannaschii
MILVRPVRMKKLKAVILDEKIDNVVRSLHEEGIVELCDLSEKLEDLEWKTLLSPSSSADYVRNVTSLMIKAGRILDMFSSVSQKETSIKDILNPKPVEKKKVSFNSYQEVIDYAEKVLNEISKEVDGPAERLSELDNKKSKLLQLKEQISYLKGLEFDLKYLGSGEYVFIGAGSVPKEKLGELKAELDKVADGYIGIFSGSEFEKDKKIRVPIVFVTLKEKLENVLSEIRKFEFERYDISDVEGTPSEALSKIESELKAIESERNSLIEKLKALAQKWEKELLAVYELLSIEKARGDAYSQFGKTDRTYYIEAWVPARDAEKAKSLIENSADGFAFVEITEPDEPEEKIPVLLDNPKVIKPFEMLTEMYALPKYNEVDPTLLLVPGFLLFYGIMLTDAVYGLLLTIIGLFIWKKIGKVSEGANKLGYILTLAGISTVIMGIITGGYLGDFTYEFFGFDVTKTPLALVNPLGESYYINNNNPLFTLGSISVTNGPMAILVFSIFVGLIHLLIGLFVGFKENVKRGNMGDAFINQGVWILLILSIFVGIGLMFAGANTMIAGGIIGIFVVLAILASMYKGYKSGGVMEAILGAMDVTGFLGNVLSYARLLALCLATGGLAMAVNIMAKLVGESIPVIGIIVAIIILLVGHTFNFVMNGLGAFIHSLRLHYVEFFSQFYEGGGKKFSPFKANREYTTA

SEQ ID NO: 21449 - protein, 427 aa, Methanococcus jannaschii
MLYNMDERFEIKDIVAREVIDSRGNPTVEVEVITKGNGYGSAIVPSGASTGTHEALELRDKEKRFGGKGVLMAVENVNSIIRPEILGYDARMQREIDTIMIELDGTPNKSRLGANAILAVSLAVAKAAAATAKIPLYKYLGGFNSYVMPVPMMNVINGGKHAGNDLDLQEFMIMPVGATSISEAVRMGSEVYHVLKNVILEKYGKNAVNVGDEGGFAPPLKTSREALDLLTESVKKAGYEDEVVFALDAAASEFYKDGYYYVEGKKLTREELLDYYKALVDEYPIVSIEDPFHEEDFEGFAMITKELDIQIVGDDLFVTNVERLRKGIEMKAANALLLKVNQIGTLSEAVDAAQLAFRNGYGVVVSHRSGETEDTTIADLSVALNSGQIKTGAPARGERTAKYNQLIRIEQELGLSKYAGRNFRCPF

SEQ ID NO: 21450 - protein, 289 aa, Methanococcus jannaschii
MFKGVYPAIITPFKNKEVDFDGLEENINFLIENGVSGIVAVGTTGESPTLSHEEHKKVIEKVVDVVNGRVQVIAGAGSNCTEEAIELSVFAEDVGADAVLSITPYYNKPTQEGLRKHFGKVAESINLPIVLYNVPSRTAVNLEPKTVKLLAEEYSNISAVKEANPNLSQVSELIHDAKITVLSGNDELTLPIIALGGKGVISVVANIVPKEFVEMVNYALEGDFEKAREIHYKLFPLMKAMFIETNPIPVKTALNMMGRPAGELRLPLCEMSEEHKKILENVLKDLGLI

SEQ ID NO: 21451 - protein, 247 aa, Methanococcus jannaschii
MFRGVMESAKEFKKVVDTISTLLDEICFEVDEEGIKASAMDPSHVALVSLEIPRLAFEEYEADSHDIGIDLEAFKKVMNRAKAKDRLILELDEEKNKLNVIFENTGKRKFSLALLDISASSVKVPEIEYPNVIMIKGDAFKEALKDADLFSDYVILKADEDKFVIHAKGDLNENEAIFEKDSSAIISLEVKEEAKSAFNLDYLMDMVKGVSSGDIIKIYLGNDMPLKLEYSIAGVNLTFLLAPRIEG

SEQ ID NO: 21452 - protein, 1155 aa, Methanococcus jannaschii
MAKKNTKKDNKNQNLRCPIVCVLGHVDHGKCLMPHEKVLTEYGEIKIEDLFKIGKEIVEKDELKEIRKLNIKVHTLNENGEIKIINAPYVWKLKHKGKMIKVKLKNWHSITTTPEHPFLTNNGWIKAENIKKGMYVAIPRKIYGNEDFEKFIEFINSKILTNELIVKVNEKDLKNVELPSTKIYKKQKNVFRSEDIIEHNLNIEKISFSPRIHRCGKPQHYIKLPKSLNEWKAIFYFAGVMFGDGCVDRIANNDEEVFNKLKSLNNLGIEVERIKRKSSYEIIFKNGKNALINLLKILFDYPSEKKSHNIKIPQILYIAPKELVAEFIKGYFDADGYVNLRQNRIEVISASKEFIEGLSILLLRFEITSKIYEIKKSYKETKKKYYQLNIVGKRNLKNFKNIGFSIKYKEENLNKIIEKSRKSEKYPINKDMKRLRILFGMTRNEVNVSYYAKYENGKEIPSYEIVKKFLNSLKPKNLDKKIKVLEGKERDVNYLKAFESDGLIENGRLTKLGREALNIWKNHEFGKENIDYMKSLIENIAFVEVEDVEIIDYDGYVYDLTTETHNFIANGIVVHNTTLLDKIRKTRVAKREAGGITQHIGASEIPIDVIKRLCGDLLKMLKADLKIPGLLVIDTPGHEAFTSLRKRGGALADIAILVVDINEGFKPQTVEAVNILRQCKTPFVVAANKIDLIPGWNSKEGPFILNFNEKNQHPNALTEFEIRLYENIIKPLNELGFDADLYSRVQDVTKTVCIIPVSAVTGEGIPDLLMMVAGLAQKFLEDRLKLNVEGYAKGTILEVKEEKGLGTTIDAIIYDGIAKRGDYLVVGLPDDVLVTRVKALLKPKPLDEMRDPRDKFKPVNEVTAAAGVKIAAPELDKVIAGCPIRIVPKDKIEEAKEEVMKEVEEAKIEVDDEGILIKADTLGSLEALANELRKAGVKIKKAEVGDVTKKDVIEVASYKQSNPLHGAIVAFNVKILPEAQKEIEKYDIKVFLDNIIYKLVEDFTEWIKKEEERIKYGEFEKLIKPAIIRILPDCIFRQKDPAICGVEVLCGTLRVGAPLMREDGMQLGYVREIKDRGENVKEAKAGKAVSIAIDGRVVLKRHVDEGDYMYVAVPESHVRELYHKYMDRLRNDEKEALLRYMELMQKLTNNIFWGR

SEQ ID NO: 21453 - protein, 188 aa, Methanococcus jannaschii
MVDNMFIVFEGIDGSGKTTQSKLLAKKMDAFWTYEPSNSLVGKIIREILSGKTEVDNKTLALLFAADRIEHTKLIKEELKKRDVVCDRYLYSSIAYQSVAGVDENFIKSINRYALKPDIVFLLIVDIETALKRVKTKDIFEKKDFLKKVQDKYLELAEEYNFIVIDTTKKSVEEVHNEIIGYLKNIPH

SEQ ID NO: 21454 - protein, 95 aa, Methanococcus jannaschii
MILEEVYEIIKQRIKEKPEGSYVAKLTTDDKKTAINKICEKIGEESTELILAAKDDKKDEIIYEAADLIFHTMVLLAYKNIEFEELLKEFERRKK

SEQ ID NO: 21455 - protein, 284 aa, Methanococcus jannaschii
MEEHFIDLSKFMMANCPYEEAEGVIFSIPYDETTSFKPGAREGGNAIRTASWGLETYSPILDRDLAELKYCDLKDLDLYGSQEEIFGTIHSVSREILKENKKIIVFGGEHSITYPIIKAVKDIYDDFIVIQFDAHCDLRDEYLGNKLSHACVMRRVYELTKNIFQFGIRSGDKEEWDLARKNNLYLKMDLMNKDDLEYIKSLDKPIYVTIDIDVLDPAYAPGTGTPEPCGFSTRELFNSLYLLEEVKDKIIGFDIVEVSPIYDIANITAITAAKIARELMLMIL

SEQ ID NO: 21456 - protein, 428 aa, Methanococcus jannaschii
MAKQKPVLNVAFIGHVDAGKSTTVGRLLYDSGAIDPQLLEKLKREAQERGKAGFEFAYVMDNLKEERERGVTIDVAHKKFETQKYEVTIVDCPGHRDFIKNMITGASQADAAVLVVDVNDAKTGIQPQTREHMFLARTLGIKQIAVAINKMDTVNYSQEEYEKMKKMLSEQLLKVLGYNPDQIDFIPTASLKGDNVVKRSENMPWYKGPTLVEALDKFQPPEKPTNLPLRIPIQDVYSITGVGTVPVGRVETGILRPGDKVVFEPAGVSGEVKSIEMHHEQIPQAEPGDNIGFNVRGVSKKDIKRGDVCGHPDNPPTVAEEFTAQIVVLQHPTAITVGYTPVFHAHTAQVACTFIELLKKLDPRTGQVIEENPQFLKTGDAAIVKIKPTKPMVIENVREIPQLGRFAIRDMGMTIAAGMAIDVKAKNK

SEQ ID NO: 21457 - protein, 759 aa, Methanococcus jannaschii
MVYDNIKREIIGMLKRMPNKQADWDNDLLPTLKAMFNPKSVSNAKSQLISEGVISQEIVDGKKIITLIKDPYELQAPNVFDEEMFLAYYTDKLKEYFKHKLSTEGPEWDIFDVKEFIMHFPESGDLNDKLIEHPYEVRKSITNVYIEAYEELFNETPNVEFIHIRNPIDCRISLSELSSAHKGKLVEFRAMILQATKLKLRYAKGFYYCPKCGATKTLDLGFWDKPKEVGKSLTCPADGCDCKGLIFDEDLSGKVDFQEIKVQTPLQESIYANKHSTTVFYEFNKPKKAVYSGYVKIVGVPIVKENKNGSVGELYIHAFYIEKDDEDIEEIAKNLNEKDLELINRIAKDKNVIQKLSDYAFREVTGYDMIKRAVLLQLVSSGTNIDMRTSIHILMISDPGVGKSTLMESLIQKFPFVKKVYAVTSSGPGLVGSVVREKAEFGDSWVLKAGVLTEADGGVVCIDEFSRNKEVYDYLLGVMEQQKIEINKAGVIDAVLPARVAILAACNPRFGRFNPDLTVWEQINLPKELLDRFDLIFVIKDKIDKKKDEDIADFSIDNYNSKVRERKGKSSGKKFVINGVELNDELLLKYVLYARQIEPEISDEARKIIKEYYVSVRKMSEAKGTFGISARQLGSIIRLAVAHAKLRLSEVVKAVDAEEAIRLVDTCLKQIAYDPESGSIDIDKIAGTPKSKRDKVEKVLNIIKEISNSRDDGLAPEEEIYERAERAGLSEKEVEDAINYLKRVGDIYSPKSGYWQLMS

SEQ ID NO: 21458 - protein, 449 aa, Methanococcus jannaschii
MFGDLMVFKAYDIRGIYGRELDENFAYSLGKCIGKKFENKKILVGNDVRIGSKELLPYFIVGLKEYADVFYAGTISTPLMYFGTKGKYDLGVILTASHNPPEYTGFKMCDKEAIPLSPIEEIKPIFKKYELTESIKEEAKNLNLDDLKVNIIEEYKKFFLKRCKASDKKIAVDFANGATTIAEKEILNELFDNAVFINDYPDGNFPAHQPDTLKMECLKDIIRAVKKNNCELGLIFDGDGDRLGIVDENGNVLRGDILTAIIAKEILKEKSNAKIVYDLRCSKIVPEIIEKYGGIAIKSRVGHYFIKKLMHEIDAEFAGELSNHFYFKEIGYFESPLLALNYILKAMDEENKSLSELNKEFSKYPHSGEINFRVKDQKYIMEKIKEHFKDCKLEELDGISIYCKNFWFNLRPSNTEPLLRLNLEADDEKTMKEKVEEIKNLIAKLDASL

SEQ ID NO: 21459 - protein, 302 aa, Methanococcus jannaschii
MGGKMEKITCVGHTALDYIFNVEKFPEPNTSIQIPSARKYYGGAAANTAVGIKKLGVNSELLSCVGYDFKNSGYERYLKNLDINISKLYYSEEEETPKAWIFTDKDNNQITFFLWGAAKHYKELNPPNFNTEIVHIATGDPEFNLKCAKKAYGNNLVSFDPGQDLPQYSKEMLLEIIEHTNFLFMNKHEFERASNLLNFEIDDYLERVDALIVTKGSKGSVIYTKDKKIEIPCIKAGKVIDPTGAGDSYRAGFLSAYVKGYDLEKCGLIGAATASFVVEAKGCQTNLPTWDKVVERLEKHRI

SEQ ID NO: 21460 - protein, 272 aa, Methanococcus jannaschii
MLTKRIIPCLDIKDGRVVKGTKFLNLRDAGDPVELAQYYDDEGADELVFLDITASAEKRDIIIDVVERTAEKVFIPLTVGGGIKSIEDFRRILRAGADKVSINTAAVKNPNLIKEASEIFGSQCVVVAIDAKRHYVNEDEIDKINKNVVKVEDGYCWFEVYIYGGRKETGIDAINWAKKVEELGAGEILLTSIDKDGTKSGYDLILTKEISKSVKLPVIASGGCGKPEHVYEAFVYGKADAALMAGILHYREYTIEEIKKYCADRGIPMRLL

SEQ ID NO: 21461 - protein, 290 aa, Methanococcus jannaschii
MRVIILKIKKIFMVMIMIKVAVTGALGRMGSNIIKTITQQEDMKVVCAFEVPNHPKKGEDVGELIGIGKIGVPLSTADELDKVLKETKPDVLVDFTIAHACVENVKIAAKNGVNLVIGTTGFTEEQKAEIEKAIKENNVAAVISQNFAIGVNIFFKTLEFLAKKLGDYDIEIIEMHHRYKKDAPSGTALRAAEIIKANRGIESVFVYGRYGMTGERKKEEIGIHALRGGDVVGDHTVIFAGDGERIELTHRASSRQAFVNGVILAIRYIADKKEGIYNTFDVLGLNEIKF

SEQ ID NO: 21462 - protein, 427 aa, Methanococcus jannaschii
MTKVEKNGIGKRICVIGLGYIGLPTASMLAIQGFDVIGVDINEKRVKEIKELSFKTTEKDLMTLVKGAINSGNLKVQTKPEKADVFIICVPTPCIECDGEKKCDLTYLNKAIESIKPYLENGNLIIIESTIPPGTTDDIYKKLSKDKKIYVAHCPERVLPGSILKELVENDRVIGGVDEKSAEMAKEIYETFVTGKIYLTDAKTAEMVKLMENTYRDVNIALANEFAKIAEEIGINVWEAIELANKHPRVNILKPGPGVGGHCISIDPWFIVEKSKNAKLIRTARELNDSMPLFVVEKIKKIIKKDIGKVAIFGVTYKGNVDDTRESPAEKVVSKLIDEGFEVKCYDKYARDFIYPLNSLDEAVEGADIIVILAEHDEYKNFDKEDIKNIASKVKNKIILDTKNILNRELWEKEGFKVYVLGDGKNA

SEQ ID NO: 21463 - protein, 395 aa, Methanococcus jannaschii
MERIAVLAYSGGLDTSCCLKLLEDKYGYKVVSVCVDVGQPEEEIKEVEEKAKKLGVLKHYTIDAKEEFVKDYIFRAIKANAMYEGYPLSTALARPLIAHKVVEIAEEVGAEAVAHGCTGKGNDQFRFETTIRIKAPHLKIIAPIRDLNLTRAEEIEYAKEKGIPIPTESKKYSIDENLWGRSIEGSELENPDFVPPEEIYAWTKNPVEDKEEEIVEIEFKEGVPVAINGEKLEPVELIKKANEIAGKHGVGRIDIIEDRIIGLKSRENYECPGAVLLLTAHKALEQLVLTRDELRFKEIVDSLYGELIYKGLWFDPLREDLDAFIDKTQERVTGTVKVKLFGGTARVVGRDSPYALYSKELVSFDEKEIDQKELAGMVKYHGLQAMLYEMRKKRK

SEQ ID NO: 21464 - protein, 226 aa, Methanococcus jannaschii
MGDDLVKVKICGITNEEDIAYISKKVHAVGVIVDVPVKTPRKISLDKAIELKKYVAPFTSLVTVLMPNSIEEVLEIYNALKPNAIQLHGFESLDFVKELNKLKNTGELNAHIIKVIHIPKDEEIDFKTLLNTAKEYEKYVEAILVDTKIESIKLEGKTHNWAVSKKLRESLEKPLILAGGLNKDNVLEAIKTVKPYAIDVSSSLEAYGGKKDLKKVDEFLEVIKKV

SEQ ID NO: 21465 - protein, 410 aa, Methanococcus jannaschii
MDLIEEAIKLESDLIRINSVNPSFGGKGEKEKAEYVKKKLMEYVESYNIENYTLKEYNIIDKYGIERPNIVFKIDFGRDKTLHIISHLDTVPEGDISLWGTNPYEPVIKDGKIYGRGSEDNHKGIVSSLLLLKMIFENNIEPKYNLSLIFVSDEEDGSEYGLKYLLNNFEDEIFKKDDLIIVPDFGTPTGEFVEIGEKGILWIKFNIKGKQCHGSTPENGLNADIVAFNFANELYNGLYEKFDEINSIFLPEYSTFEPTILKNKVENPNTIPGYVEVVFDCRILPTYKIEEVLEFINKFIKNFEFKKYIKHYDNSIKAEITYEILKSENPNYTDENAEIIKELKKAIKNVLNRDAKLCGMGGGTVAAFLRYKGYNVAVWGIGEETAHQPNEHIKIEDLVKMAEVFYEILK

SEQ ID NO: 21466 - protein, 313 aa, Methanococcus jannaschii
MKVTIIGASGRVGSATALLLAKEPFMKDLVLIGREHSINKLEGLREDIYDALAGTRSDANIYVESDENLRIIDESDVVIITSGVPRKEGMSRMDLAKTNAKIVGKYAKKIAEICDTKIFVITNPVDVMTYKALVDSKFERNQVFGLGTHLDSLRFKVAIAKFFGVHIDEVRTRIIGEHGDSMVPLLSATSIGGIPIQKFERFKELPIDEIIEDVKTKGEQIIRLKGGSEFGPAAAILNVVRCIVNNEKRLLTLSAYVDGEFDGIRDVCIGVPVKIGRDGIEEVVSIELDKDEIIAFRKSAEIIKKYCEEVKNL

SEQ ID NO: 21467 - protein, 424 aa, Methanococcus jannaschii
MGMTIVEKILAKASGKKEVSPGDIVMANIDVAMVHDITGPLTVNTLKEYGIEKVWNPEKIVILFDHQVPADSIKAAENHILMRKFVKEQGIKYFYDIREGVCHQVLPEKGHVAPGEVVVGADSHTCTHGAFGAFATGIGSTDMAHVFATGKLWFKVPETIYFNITGDLQPYVTSKDVILSIIGEVGVDGATYKACQFGGETVKKMSIASRMTMTNMAIEMGGKTGIIEPDEKTIQYVKEAMKKHGTERPFEVIKGDEDAEFAEVYEIEADKIEPVFACPHNVDNVKQAREVAGKPIDQVFIGSCTNGRLEDLRMAIKIIEKHGGIADDVRVVVTPASREEYLKALKEGIIEKFLKYGCVVTNPSCSACMGSLYGVLGPGEVCVSTSNRNFRGRQGSLEAEIYLASPITAAACAVKGELVDPRDL

SEQ ID NO: 21468 - protein, 429 aa, Methanococcus jannaschii
MYLLIVKKTDRLEGIVKAPPSKSYTHRAVIGASLADGVSRIINPLWGADCLSSVHGCRMLGANIELDKEKDEWIVKGGELKTPDNIIDIGNSGTTLRILTSIASQIPKGYAILTGDDSIRKRPMQPLLDALKQLNIEAFSSKLDGTAPIIVKSGKIYGNVVKIRGDISSQFITSLMMLLPFNKEDTEIILTSPLKSKPYIDITLDILNKFGIKIDKTDNGFLVYGNQKYKPIDYIVEGDYSSASYLIAAGVLINSNITIENLFANSKQGDKAIINIVKEMGADIKVKKDKVIIEGEYSLKGIDVDVKDIPDLVPTIAVLGCFAEGKTEIYNGEHVRLKECDRLRACAVELKKMGADIEEKPDGLIIRGVKKLKGAKLNTYHDHRLVMAFTIAGLKAEGETIIEGEEAVKISFPNFVDVMKSLGANIEVK

SEQ ID NO: 21469 - protein, 183 aa, Methanococcus jannaschii
MKIMEPEIKIVNVVVSTKIGDNIDLEEVAMILENAEYEPEQFPGLVCRLSVPKVALLIFRSGKVNCTGAKSKEEAEIAIKKIIKELKDAGIDVIENPEIKIQNMVATADLGIEPNLDDIALMVEGTEYEPEQFPGLVYRLDDPKVVVLIFGSGKVVITGLKSEEDAKRALKKILDTIKEVQEL

SEQ ID NO: 21470 - protein, 391 aa, Methanococcus jannaschii
MRELNDVYDVVVVGAGPGGSMASYASAKNGAKTLLIEKSQEIGEPVRCAEAIPSIEEFGLKPEPEFVRNIIKGGILFSPSGKKVTVTQDKAQGYVVERKIFDKYLAIRAAKAGAKVAVKTTAIGLERDGDYWNVIVEFLGEEYVIKTKVVIAADGVESNIAEYAGLKAKKKPLEICSCAEYEMTNVELLDKNMMEFYFGNEVAPGGYVWIFPKGETANVGLGVRDKKKKAIEYLEEFIENGLAKDRLKDATPIEFKVGGAPVSGPIEKTYTDGLLVVGDAAGQISPLTGGGIYLAMDCGLIAGEVASKAIKLNDWSEETLKEYERRWKEKHYEYLMSHLKYRKILEKMSDDELDALAEALGESLDGIDLKKFVKRIITKKPSLLKYFKDLL

SEQ ID NO: 21471 - protein, 1188 aa, Methanococcus jannaschii
MLIIQNTKGDSMKFIAWLDELSNKDVDIAGGKGASLGEMWNAGLPVPPAFVVTADAYRHFIKETGLMDKIREILSGLDVNDTDALTNASKKIRKLIEEAEMPEDLRLAIIEAYNKLCEMCGEDEVTVAVRSSATAEDLPEASFAGQQDTYLNIKGAENVVKYVQKCFSSLFTPRAIFYREQQGFDHFKVALAAVVQKLVNAEKAGVMFTVNPISENYDELVIEAAWGLGEGVVSGSVSPDTYIVNKKTLEIVDKHIARKETMFVKDEKGETKVVEVPDDMKEKQVLSDDEIKELAKIGLNIEKHYGKPMDVEWAYEKGKFYMLQARPITTLKKGKKEKKAKEEDIEAKILLKGIGASPGIATGVVKIIHDVSEIDKVKEGDILVTEMTTPDMVPAMKKAAAIVTDEGGLTCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNCHAAIVSRELGTPCVVGTKKATKVLKDGMIVTVDGEKGIVYEGEIKKVEEKEKKQEVVVQQAPIITATEVKVNVSMPEVAERAAATGADGVGLLRAEHMILGLGKHPRKILEEEGEEALIEALMEGIRKVADAFYPRPVTYRTLDAPTDEFRGLEGGENEPIEHNPMLGWRGIRRDLDEVDILKCELKAIKRLREEGYKNIEIMIPLVTHPDEVRRVKEIMREVGLEPCKDIPFGIMVETPAAALIIEDFIKEGINFVSLGTNDLTQYTIAIDRNNELVSKYYKEDHPAVLKLVEHVIKTCKKHGIKTSICGQAGSRPHIVEKLVEWGIDSVSANIDAVETIRRVVARTEQKVILNYIRKSYVERE

SEQ ID NO: 21472 - protein, 345 aa, Methanococcus jannaschii
MKKVVLLTCTIIVGGQWGDEGKGKIISYICDKDKPSIIARGGVGPNAGHTVNIGGKSYGIRMIPTGFPYKEAKLAIGAGVLVDPEVLLKEVEMLKDFNVKERLIVDYRCGIIEEKHKIMDRKDEHLAKEIGTTGSGCGPANVDRVLRILKQAKDIEELKEFLGDVSEEVNNALDRGENVLIEGTQGTLLSLYYGTYPYVTSKDTTASSFAADVGIGPTKVDEVIVVFKTFPTRVGAGPFPTEMSLEEAESLGIVEYGTVTGRRRRVGYFDFELARKACRLNGATQIALTGLDKYDKECYGVTEYNKLSEKAKEFINKIEEVTGVPVTIISTGPEMHQTIDLRNEL

SEQ ID NO: 21473 - protein, 292 aa, Methanococcus jannaschii
MIRIGTRGSKLALYQANKVAELLKNLGYKVEIKIIKTTGDRVLDKKLSDIGIGVFTKELDLAMLNNEIDIAVHSLKDIPTIWNENLMVGAVLERDSYHDLLIWNKDIDFNEDSKIVIGTSSMRRRAFLKFIYPNAKFELLRGNVDTRLRKLKEGLYDAIVLSEAGIIRLGVSLEDFNYKRLDILPAPAQGIIAVACKRDDEEMKSILKEINHERTYLESLCERTALNEFGGGCSVPFGALAVYDEKNELLKLKAAVVTNDELKNASGEVKCKIDEIDKAVELGKKIGLKLKN

SEQ ID NO: 21474 - protein, 473 aa, Methanococcus jannaschii
MTTVMKFGGTSVGSGERIRHVAKIVTKRKKEDDDVVVVVSAMSEVTNALVEISQQALDVRDIAKVGDFIKFIREKHYKAIEEAIKSEEIKEEVKKIIDSRIEELEKVLIGVAYLGELTPKSRDYILSFGERLSSPILSGAIRDLGEKSIALEGGEAGIITDNNFGSARVKRLEVKERLLPLLKEGIIPVVTGFIGTTEEGYITTLGRGGSDYSAALIGYGLDADIIEIWTDVSGVYTTDPRLVPTARRIPKLSYIEAMELAYFGAKVLHPRTIEPAMEKGIPILVKNTFEPESEGTLITNDMEMSDSIVKAISTIKNVALINIFGAGMVGVSGTAARIFKALGEEEVNVILISQGSSETNISLVVSEEDVDKALKALKREFGDFGKKSFLNNNLIRDVSVDKDVCVISVVGAGMRGAKGIAGKIFTAVSESGANIKMIAQGSSEVNISFVIDEKDLLNCVRKLHEKFIEKTNS

SEQ ID NO: 21475 - protein, 261 aa, Methanococcus jannaschii
MQMVPPSAYDRAITVFSPEGRLYQVEYAREAVRRGTTAIGIACKDGVVLAVDRRITSKLVKIRSIEKIFQIDDHVAAATSGLVADARVLIDRARLEAQIYRLTYGEEISIEMLAKKICDIKQAYTQHGGVRPFGVSLLIAGIDKNEARLFETDPSGALIEYKATAIGSGRPVVMELLEKEYRDDITLDEGLELAITALTKANEDIKPENVDVCIITVKDAQFKKIPVEEIKKLIEKVKKKLNEENKKEEENREETKEKQEE

SEQ ID NO: 21476 - protein, 445 aa, Methanococcus jannaschii
MVNSSPLWKKLMRKCKGENMALKMDKSKELFEEAKKYLVGGVNSPVRYFKPYPFFVEKAKDCYLFDVDGNCYIDYCLAYGPMVLGHANDAVIKAVKEQLELGSAYGCPTEKEIILAKEVVKRVPCAEMVRFVNSGTEATMSAIRLARGVTGRKKIIKFDGAYHGAHDYVLVKSGSGALTHGHPNSPGIPEETTKNTILIPFNDEDAVKKAINENKDEIACIIVEPIMGNVGCILPKEGYLEFLREITEENDILLIFDEVITGFRLAKGGAQEYFGVVPDIATLGKILGGGFPIGAIVGRRELMEQFSPLGAIYQAGTFNGNPISITAGIATLKQLDDRFYKETARTAKILADTLRELADKHNIKAKVYNIASMFQIYFNDKEVVNYEIAKQSDTEKFMKYFWRLLEKGVFVPPSQFECCFTSIKHDDEVVDKTIKAMEDVFEGLE

SEQ ID NO: 21477 - protein, 307 aa, Methanococcus jannaschii
MRYVVGHKNPDTDSIASAIVLAYFLDCYPARLGDINPETEFVLRKFGVMEPELIESAKGKEIILVDHSEKSQSFDDLEEGKLIAIIDHHKVGLTTTEPILYYAKPVGSTATVIAELYFKDAIDLIGGKKKELKPDLAGLLLSAIISDTVLFKSPTTTDLDKEMAKKLAEIAGISNIEEFGMEILKAKSVVGKLKPEEIINMDFKNFDFNGKKVGIGQVEVIDVSEVESKKEDIYKLLEEKLKNEGYDLIVFLITDIMKEGSEALVVGNKEMFEKAFNVKVEGNSVFLEGVMSRKKQVVPPLERAYNG

SEQ ID NO: 21478 - protein, 216 aa, Methanococcus jannaschii
MQRVNPTRMELLKLKNKIKLAEKGHKLLKQKRDALIMEFFQIIEQASDLRDKVEAKLAEAYKDLIMAQTVMGTLAVKEAALAAKNDKLEVDMDTKNIMGVTVPTFEIYNVRRKVGERGYSPYGVSSKLDEAAKKFEEALELITELAEIETSIKLLAEEIITTKRRVNALEYVIIPRLKSLKKYISMRLDEMERENFFRLKLIKSRIEKREAEGETV

SEQ ID NO: 21479 - protein, 417 aa, Methanococcus jannaschii
MIMFLTLDDFNFEDKRVVLRVDINCPIDPNTGEILDDKRIREIKSTITELINKGAKVVILAHQSRPGKKDFTTLKNHAKVLSDVIGKEVEYIDEVIGSTAREAIINMKCGDVILLENVRFYSEEVLSDWKKWENITPKKQAETNLIKRLAPLFDYFVNDAFAAAHRAQPSLVGFSYYMPMIAGRLMEREVGVLSKVLENPEKPCVYVLGGAKADDSIRVMKNVLENGTADKVLTSGIVANIFLVAMGYDLGVNMDIIENLGLKSQIEIAKELLNKFEDKIVVPVDVALNINEERVEADLNKDEKVEHLINDIGEKTIELYSEIINEAKTIVANGPAGVFEKEAFAKGTEELLKAIANSKGFSVIGGGHLSAAAELFGIADKIDHVSTGGGATLDFLAGEKLPVIEMLKESYKKYKGQ

SEQ ID NO: 21480 - protein, 335 aa, Methanococcus jannaschii
MFKINLGDFMLIRPRRLRKNQKIRDLVRETILTKNDLIMPIFVDENLKGNEKKEISSMPNQYRFSVEGAIEEAKEIADLGIPAVILFGIPKHKDEIASSAYDKNGVVQRTIRGIKEELGDELLVIADCCLCEYTSHGHCGIVKDGKILNDATLPILAKIALSYADAGVDIVAPSDMMDGRVRAIREILEENGYDDVAIMSYSAKYASSFYGPFREAAESAPKFGDRKSYQMDIGNAREALKEIALDIEEGADLILVKPALPYLDIIRMAKDRFDVPIGGYCVSGEYAMVEAAARNGWLDREKVIYEILLSIKRAGADFIITYWAKEVAEIGLSQE

SEQ ID NO: 21481 - protein, 306 aa, Methanococcus jannaschii
MGECMLKTNICGIEFKNPVFLASGIMGETGSALKRIAKGGAGAVTTKSIGLNPNPGHKNPTIVEVYGGFLNAMGLPNPGVDEYLEEIEKVRDELNRMDVRIIGSIYGKDEEEFAEVAKKMERYVDIIELNISCPHAKGYGATIGQNPDLSYDVCKAVKKAVKIPVFAKLTPNVTDIIEIAQAVVDAGVDGLVAINTVRGMAIDIRAKKPILANKFGGLSGKAIKSIGIKVVWDLYENFDVPIIGVGGIMSGEDAIEYMMAGASAVQIGSGVYYRGYDIFKKVCDEIISFLKEENLTLEEIVGMAHE

SEQ ID NO: 21482 - protein, 178 aa, Methanococcus jannaschii
MIITIGGLPGTGTTTIAKMIAEKYNLRHVCAGFIFREMAKEMGMDLQEFSKYAEQHKEIDEEIDRRQVEIAKQGNVVLEGRLAAWMLLKNGIKPDLTIWFKAPLEVRAERISKRENIDKDVALKKMIEREASEKKRYKEIYNIDLDDLSIYDLVIDTSKWDVEGVFNIVSSAIDNLKK

SEQ ID NO: 21483 - protein, 494 aa, Methanococcus jannaschii
MGGNIKFLEAMVDFLERNVKTIFSYPGEQILPLYNEIEGSSIKNIMVRDERGAGFMADGYARITNYIGVCLATAGPGATNLTTPIATAYKDNSSVLAITGRCQRKYIGKNYFQEVNMDFLNFYKGYFVDKAEVSYIAKAFADCLFNKKPVQLNIPVDLYKEEAKDINITTYTDIYKDDETPSNNIKEIDVKKPLFLIGQGIFGTLSYKEIVKISKILEKINCPIATTFPARGVINEKLENCIGLVGRRGDLKSLLEADKIINIGSSLSYNTYVESVREKLLSKTENIQLKPKSIKELKEFFENLDVKNSSWIYKNSNKFQPSGDYSNKIYEIIKNIPEDAIIVTDAGKHTVFTCLLKTCVIPRNIISSHSFGTMGFGLPASIGVKFGTIDFNIDREVVLISGDGGFLMNVEELQVVAENNLKILMVVMKNNSLAEFCKIKNPNFNKIADAFEIDNCYIENVDEIGSEIKGYLKKNKPLLVVVETENEPLPKPNI

SEQ ID NO: 21484 - protein, 367 aa, Methanococcus jannaschii
MEVEYMNFNELNLSDNILNAIRNKGFEKPTDIQMKVIPLFLNDEYNIVAQARTGSGKTASFAIPLIELVNENNGIEAIILTPTRELAIQVADEIESLKGNKNLKIAKIYGGKAIYPQIKALKNANIVVGTPGRILDHINRGTLNLKNVKYFILDEADEMLNMGFIKDVEKILNACNKDKRILLFSATMPREILNLAKKYMGDYSFIKAKINANIEQSYVEVNENERFEALCRLLKNKEFYGLVFCKTKRDTKELASMLRDIGFKAGAIHGDLSQSQREKVIRLFKQKKIRILIATDVMSRGIDVNDLNCVINYHLPQNPESYMHRIGRTGRAGKKGKAISIINRREYKKLRYIERAMKLKIKKLKFG

SEQ ID NO: 21485 - protein, 197 aa, Methanococcus jannaschii
MFGGNMRIFEVMRETKETNIYLKINIDGTGKYKIDTGIPFFDHLLASFAKHGCFDLIVKARGDLEIDDHHTVEDVGICLGLALNQIEKRNIFRFGWAIIPMDDARATVAIDLSGRSYCVGNYEPKREFVGDLATENINHFFESVASYGMLNIHYEVIGKNEHHKAEALFKAFGVALDLATKIDERKGVISTKGEVKL

SEQ ID NO: 21486 - protein, 405 aa, Methanococcus jannaschii
MENYNDILEKMLNGEIKPYQLDKMFGSKIATEIRRKFIEKKVGIEFKHICNYSIDEEMAMKKNIENMIGAIQIPLGFAGPLKINGEYAKGEFYIPLATTEGALVASVNRGCSIITKCGGATVRVIDDKMTRAPCLKTKSVVDAIKVRDWIRENFERIKEVAESTTRHGKLIKIEPILIVGRNLYPRFVFKTGDAMGMNMVTIATEKACNFIEGELKKEGIFVKTVAVSGNACVDKKPSGMNLINGRGKSIVAEVFLTEKEVNKYLKTTSQAIAEVNRLKNYIGSAISNSMGFNAHYANIIGAIFLATGQDEAHIVEGSLGITMAEVEDDGLYFSVTLPDVPIGTVGGGTRVETQKECLEMLGCYGDNKALKFAEIVGAAVLAGELSLLGALAAGHLGKAHQELGR

SEQ ID NO: 21487 - protein, 333 aa, Methanococcus jannaschii
MHKICVIEGDGIGKEVVPATIQVLEATGLPFEFVYAEAGDEVYKRTGKALPEETIETALDCDAVLFGAAGETAADVIVKLRHILDTYANIRPVKAYKGVKCLRPDIDYVIVRENTEGLYKGIEAEIDEGITIATRVITEKACERIFRFAFNLARERKKMGKEGKVTCAHKANVLKLTDGLFKKIFYKVAEEYDDIKAEDYYIDAMNMYIITKPQVFDVVVTSNLFGDILSDGAAGTVGGLGLAPSANIGDEHGLFEPVHGSAPDIAGKKIANPTATILSAVLMLRYLGEYEAADKVEKALEEVLALGLTTPDLGGNLNTFEMAEEVAKRVREE

SEQ ID NO: 21488 - protein, 398 aa, Methanococcus jannaschii
MSQENWIDLEKKYHLQIYGRLPVVLVEGKGMEVYDIDGKKYLDFLAGIGVNNVGHCHPKVVEAIKKQAETLIHTSNIYYTIPQIKLAKKLVELSGLDRAFFCNSGAEANEGAIKFARKYVSKVLGREGGEIISMYNAFHGRTLTTLAATPKPKYQDGFYPLPPGFKYVPFNDIEALKEAITDKTAAIMIEPVQGEGGIHVADKDYLKAVRDLCDDKNIVLIFDEVQCGMGRTGRMFAFEHYGVEPDILTLAKALGGGVPIGAVVLKEEIAKALSYGDHGTTFGGNPLACSAALASVEVIEELIKDDKVIEKGKYFIRKLENLIEKYNFIKEVRGLGLMIGAELEFNGADIVKKMLEKGFLINCTSDTVLRFLPPLIVEKEHIDALINALDEVFTEIKK

SEQ ID NO: 21489 - protein, 222 aa, Methanococcus jannaschii
MCEGKMPVIGEKFPEVEVKTTHGAIKLPDYYVEKGKWFVLFSHPADFTPVCTTEFVGFQKRYDEFRKLNTELIGLSIDQVFSHLKWVEWIKEKLNVEIEFPIIADDRGELAEKLGMISPYKGNNTVRAVFVVDNKGIIRAIIYYPQEVGRNLDEIVRLVKALQVSDEKGVAMPANWPENDLIGDKVIIPPASSVEEIKQRKEACEKGEIECLDWWFCYKKLD

SEQ ID NO: 21490 - protein, 673 aa, Methanococcus jannaschii
MVWLMEALKTKENETTKEKKLTTKVEKSEKKEENVREEEIVCPICGSKEVVKDYERAEIVCAKCGCVIKEKLFDIGPEWRAFDHEQKIKRCRVGAPMTYSVDYNEPIIIKENGEIKVVKIGELIDKIIENSENIRREGILEIAKCKGIEVIAFNSNYKFKFMPVSEVSRHPVSEMFEIVVEGNKKVRVTRSHSVFTIRDNEVVPIRVDELKVGDILVLAKELPNIEEDIEIDKKFSKILGYIIAEGYYDDKKIVLSYDYNEKEFINETIDYFKSLNSDITIYSKDLNIQIEVKNKKIINLLKKLRVKNKRIPSIIFKSPYEIKKSFIDGIFNGKDAKVFVSKELAEDVIFLLLQIKENATINKKSINDIEVYEVRRITNIYTNRKLEKLINSDFIFLKIKEINKVEPTSGYAYDLTVPNAENFVAGFGGFVLHNTIHDKGLSTVIDWRNKDSYGKDLSANKRAQLYRLRKWQRRIRVSDAAERNLAFALSELDRITSKLGLPRHVRENAAIIYRGAVEKGLIRGRSIEGVVAAAIYAACRRCRVPRTLDEIAEASRVDRKEIGRTYRFLARELNIKLTPTNPIDYVPRFASELGLPGEVESKAIQILQQAAEKGLTSGRGPTGVAAAAIYIASVLLGCRRTQREVAEVAGVTEVTIRNRYKELTEHLDIDVTL

SEQ ID NO: 21491 - protein, 484 aa, Methanococcus jannaschii
MNILRRGRLGNSIKEDVAKYTTSLSFDKEIFEADILCDIAHVIMLYEQGIIKKEDAKKIIEGLKEIYKKGMENLNLDPSLDDIHMVIESELIKKLGEDVAGRMHTGRSRNDEVATDLRIALREKVLIIAKSLIKMLKDILELAEKHKETLIVGYTHLQHAQPVTFAHHLLSYVSAIERDILRLLDAYKRINISPLGCGAMATTGFKINRERTKELLGFDALIENSMDGVSARDFILETMADLAILGTNLSKICEELILFSTYEFGTIEIANEFCSTSSIMPQKKNPDVAEIARAKLSKLNGNLVTALTILKALPNTYNRDLQEISPHLWDSVYTTIDTIKMVHGMLKTIKINKERMEELAKANYSTATELADTLVRETGIPFRTAHGIVGEVVRRSIEEKKDMIEVIYEVLEKYNLKVDEEKIKKALDPYENVKMRDVIGGPAPEEVEKRIKVFRERLDRYEKEVDEKLQKINKVKEILLSYEI

SEQ ID NO: 21492 - protein, 327 aa, Methanococcus jannaschii
MKELFKRGGIMLFDKNILQKIDEELKTYVDKDDKLYNASKHLLFAGGKRIRPYLTVVTYMLKKDDIEEVLPAAAAVELIHNYTLIHDDIMDNDDERRGKPTVHVVYGEPMAILAGDLLYAKAFEAVSRIKDNKKAHEVLKILSKACVEVCEGQAMDMEFENYYPTMEEYLDMIRKKTGALLEASVGIGAVMADCNEEEREALKEYAKRIGLTFQIQDDVLDLIGDQKKLGKPVGSDIREGKKTIIVIHALKTLDEDKKKRLLEILGNKNVKDEEIKEAIEILKPSIEYAKELMKQKTEEAKEYLKIFNKDRRKVLEDLADFIMSRIY

SEQ ID NO: 21493 - protein, 352 aa, Methanococcus jannaschii
MITFIYFFGNIIYYLPIYSYINNYKFMLMVIIMDDLTQLPGVGPTTAEKLKEAGYTDFMKIATASIGELTEIDGISEKAAARIIEAARELCNLGFKSGTEVLSQRKNIWKLSTGSKNLDEILGGGLESQSVTEFAGMFGSGKTQIAHQACVNLQCPERIVADDAIKDEILNEPKAVYIDTEGTFRPERIVQMAEALGLDGNEVLNNIFVARAYNSDMQMLYAENVENLIREGHNIKLVIVDSLTSTFRTEYIGRGKLAERQQKLGRHMATLNKLADIYNCVVIVTNQVAARPDALFGPSEQAIGGHIVGHAATFRIFLRKAKGDKRVAKLYDSPHLPDAEAMFRITEKGIHD

SEQ ID NO: 21494 - protein, 305 aa, Methanococcus jannaschii
MHLLDLDVLSREDVLKIIEYGIYFKKNRRKHEKILEGKSVAILFEKPSTRTRMSFDIAVYELGGHPLIMNQNEIHLGKKESIKDTAKVMGRYVDTIVARVYKHRHLEEMAKYSSVPVINALSDLAHPCQILADLMTIKEYKGKFKGLKIAYLGDGNNVCNSLILGSALVGMDTYVGTPKGYEPNAKVVLKAKEIINNYGEGSLTLTNDPIEAAEDADVLYTDVWISMGDDKDKEEVLKIFPPFQINSKLLEYAKDDVIVMHCLPANRGYEITDDVIDGEHSVVYDEAENRLHVQKGVFKFIFERK

SEQ ID NO: 21495 - protein, 1232 aa, Methanococcus jannaschii
MVILMIKIGFVSTIDSDDLVFEEAYKEIKKYGIEFKILDYKCSRKEFEEFLEFIKEANIVFTKLMGGKNAFKYYDELAEFCKRHNIPFLPLPTISEIHPDLEKDRTVDDDVKNKVVKYLGYEGVYNYKNLLLYLANRFGNLNVEYEEPRPMPWQGIYYKGKYFETLDDYLNYLKELGRDLDKPIIGVLFYRNWFVANNIDYVNDLIDIIENKGAIPIAVFSSHLKNELGSIGTLETFKRFFYKDGKPIVHALINTTMFTLSMGVKAELLKDEPEFLKELNVPILQGIISTGFIEDWKKSVSGLNPIDLIIGMAMPEFDGAIIHFPIGGKEKIKDGEVGVPIIKYRAIRDRAEKIVDLALRYANLKLKSNKDKKIAIIFHNYPPRNDKIASAFGLDSPESVVNILKEMKKRGFIVDEIPKNGTELIKKMLNYATNDKRFLTEEMIKKAVGKVKKEDYEKWFNSLSEKVKQELIKNWGAIPGDVMNFDGELIIPGIINGNVFISVQPPRGFGENPSAIYHSPDLPPTHYYIAFYKWIKDVFKADAIMHIGKHGNLEWLPGKCVGLSNECYPDICMELPNIYPFIVNNPGEGTQAKRRSYATIISHLIPPMTISDLYGDLVELEKSIDDYYETENKEKKEFLKKEILKKIKELKLDEDLLDGKVIDEEINDENFEKLLNKIHDYLETLKNRQINDGLHIMGVPLEGDKLVNMLFMIIRYQFNYLEILAEILDYSWEELNENKGKYHKILDEINEIGLNLLKEYMQYNFDENKIDELKTVKINSKLRDVLKTVSTIYKNLMKVDEEIINAVNALEGFYIPPRVAGAPTKDINCLPTGRNFYSCNPQEIPTKSAYEMGKKLAEDLINKYLKEEGKYPEYIGVIVWGSPTMRTKGDDIGEILYLLGVKPVWNKMGRVVGLEVIPLEELGRPRIDVTLRISGLFRDTFPNVVELIDEAIKMVANLDEPDEMNYVKKHYREEVEEKIKKGIDEKTAKETSLYRIFSDKPGCYGAGVSHLIDEKNWESIEDFAKVYVEWGGYAYGKGYYGVEAKEEFINRLSKIELTVKNEDSQEWDIFEGDDFNSYHGGLIASVTYYSGKKPVSYVGDTSNPNDIRTKHLKEEGKEIFRTKIMNPKWIEGMKRHGYKGAADFSKYVDHMFAWDATSGIIDDWMYEKIAEKYVFDKDMEEFFKENNPYALLNITERLLEAIERGMWKADEEMKEKLRKKYLEIEGMIEEKL

SEQ ID NO: 21496 - protein, 365 aa, Methanococcus jannaschii
MMIMQYIYPFTAIVGQEKMKKALILNAINPKIGGVLIRGEKGTAKSTAVRALADLLPEIEIVEGCPFNCDPNGNLCDICKEKKKRGELKTTKKKMKVVNLPIGATEDRVIGTLDIEKAIKEGIKALEPGILAEANRNILYIDEVNLLDDHIIDVLLDAAAMGWNIIEREGVKIKHPSRFILVGTMNPEEGELRPQILDRFGLMVDVEGLNDVKDRVEVIKRVEEFNENPEAFYKKFEEEQNKLRERIIKARELLNKVEISDDLLEFISKVCIELGIQTNRADITVVRTAKALAAYNGRTYVTIDDVKEAMELALPHRMRRKPFEPPQLNKEKLEQMINEFKQQNNKDNEEKEEHKDDDVKKNMMK

SEQ ID NO: 21497 - protein, 185 aa, Methanococcus jannaschii
MQDKEFKIAIIGPENAGKSSIMNALFGKYVSLVSEVGGTTKMPIKRYWGKLKIGRIKEEPEFVNLVFVDLGGLYTTTDKQSPIMTPKVLEKTFEEINDSDMIIHVIDGSVGLLRSFERLHHLLKFRYQKPIIVVINKCDLLNDSDKEHLKNYVERRIKNTPIFVSAKTFEGIPELLDIIIKYLKR

SEQ ID NO: 21498 - protein, 462 aa, Methanococcus jannaschii
MELNQIIKSGEKMAVHPIDYRYGTPEMRKVWEEENKLEKMLKVEAALAKAQAELGLIPKEAAEEINKKASTKYVKLERVKEIEKQTKHDVVAMIRALAEVCEGNAGEYIHFGATSNDIVDTANSLLIKESIEIIEDKLKQLRDILLDKAEEHKYTVCVGRTHGQHAIPTTYGMRFALWAAEIDRHLERLKEAKKRICVSMITGAVGTMAAMGEKGLEVHKRVAEILGLEPVLISNQVIQRDRHAEFVFLLALIAQTLNKIGVTVRSMQRTEIGELEEEFDPTKQTGSSTMPHKRNPITFEQICGLSRVIKSLCIAEMDNIPLWEERDLTNSSAERCIFAEVCVLTDHILTLAIKGVKKLKVNKENVERNLELTKGLIMAERIMIELAKRGMGRQTAHEIVRQCAMKAYEEKRHLKDILLENEEVMKYITKEELEELMNPKTYIGLAPQIVDEVIKTLKNKKY

SEQ ID NO: 21499 - protein, 651 aa, Methanococcus jannaschii
MEFKGYIKEKFPYPKVREPQKRMMLKIYECIKNKRNLIVEAPTGVGKTLGYLIPALYFAERRKRVLILTETIDQQVRIYEDLSSLRHNLKVAFLMGKSNFICKSKGGKANRLYCQLNKKCLYRPNKRPICYCGTKKQPVNLGDKVIYYCPYCTCEYQKAKIESILADIVVMNNSMFYYAKEDIEAKRDIDIIICDEAHKLESSIRNTSTIIINPELPINRLKYMAIHYAPNILKKRLDIGDENFWEIIEKYLTSRGINIDICKETIIFDGENLSSWKYKTELAVLGAILDAYYQINNIKNKILRFNENEEIDREELRFEIDNKALIAIELDFIHKKKLSDLYLLEFIENIKNLRYINENYVVYRSGNSLLCEPVFVSSHLKELYGNAVVIHCSATIGNLKMHALKTGLDKAEFLILESPFPKNRKKIIALKDGVDMKYERKDREKANKNLLKILEAINGNSLVLFKSFEDLDSFYKYLKREITKTNIKNKNIHVYEQGMDGKEAKELKERFEKIGGILLATGRFAEGVDIPGEALVGVVIDSLPFPVPTPLILREQKILEERFKIRGVRDAHWRAFLMTSFDRMARTLVQMIGRLIRTENDYGVVVIQDKRFADWVGRVMREKGYLKDNYEVMSLDMAIKYIPKFMSQFKN

SEQ ID NO: 21500 - protein, 373 aa, Methanococcus jannaschii
MGDWMIENKVRDVVKKLKPYVPGKSKEEIARAYGIKPEDIIKLGSNENPWGPSPKIKEKILDEIDKIHQYPEPVNPILMKELSKFLNVDEENIIVGGDGADEIIDTIFRTFVDDGDEVIIPIPTFTQYRVSATIHNAKIKYAKYDKEKDFKLNVESVLNNITDKTKVIFLCTPNNPTGNIIENRDVERVINETDALVVIDHAYIEYAKKEYDWTQKAPEYDNVIVLRTFSKVFGLAGMRVGYGVANKKIIDYMMRVKPIFSLTRLSQVCAITALRDREFFERCVRDGIKSREMLYNGLKKFKDIKVYPSEANYLLVELKTMKAKEFCEELLKRGVIVRDCTSFDGLGDNYVRVSIGTFEEVERFLKILEEIIS

SEQ ID NO: 21501 - protein, 217 aa, Methanococcus jannaschii
MKFFLDTANVEEIKKYAELGLVDGVTTNPTLVAKEGRDFYEVVKEICEIVEGPVSAEVISTDAEGMVKEARELAKLADNIVIKIPMTKDGMKAVKILSAEGIKTNVTLVFSPLQALVAAKAGATYVSPFVGRLDDIGHVGMKLIEDVVKIYKNYDIKTEVIVASVRHPWHVLEAAKIGADIATMPPAVMDKLFNHPLTDIGLERFLKDWDEYLKSRK

SEQ ID NO: 21502 - protein, 762 aa, Methanococcus jannaschii
MVNFDEEVFRAYYEHKIKSFIKEELSNNLIKGNIFEFDIEKFLMHFPDACEVNDLIIERPKEIEEIILDIFKEAYVELFGEDKELEKIQIAFKNPKGCEKLIEEISAEDINKLVKFEGNILQAGKVNALLKKAVYYCNKRIKDENGGFLCKYTYTPCDGRVEIEIDDYFSEGEFIKDMLSPREVKKILENKKVWDKLVEKGKIPRCVDLKENDEVFKENLKEIKFILDEYDSIYVNIQEMEIQQPIDLMKNPEEPARSIRVFLENTPGIYAGRVNVIGRVMKREYRHNIPIYKIYIKSNYIKISESYNKIEVKDILRNEELIETLNELGRKKNIIDILSNYLISQIKGYELVKKAIFLQQIKGAFKFLPDGTPLRRDSHILLITDPGIGKSTMLRRIARLFPQNAYASVTTATGGGLTAIVTREATEIGDGWVVKPGVFVRANEGTACIDELTVDKNVMKYILEAMESQTIHVNKGGINVKLPARCAVLAACNPKRGRFDRNLTVIEQIDIPAPLLSRFDLIFPLMDKPNRKSDEEIAEHILNTHIETATKDYKILGAIDIDGITVDEKLLKYYIIYARSCAYIEENQDLYLGEFDETKLIMPYLTDKAKKMIKKYYLEMRKLGEGDNPIPITARQLEAIIRIAEMHAKARLSDKVEDVDAEVAISIIDDCLKQVAYDPETGTLDLDKIAGTPKSRRDKMDAVLNIIREIVSLRDDGLAPEEEIYEKAMAIGLSEKDVNDALEYLKKAGDIYNPRYGFWGLL

SEQ ID NO: 21503 - protein, 177 aa, Methanobacterium thermoautotrophicum
MKVDLEIDGSGKSSVNTGLGFLDHMLESVARHGLLDLEVEARGDLEVDDHHTVEDVALTLGEALREALGDKSGIRRMAHAMVPMDDALATVALDLSGRPYTVLELEFDDAVIGDVKSQNIGHFIESLAVSAAMNIHASVRGRNDHHKAEALFKALALAIRDAVRVEHGEIPSTKGKL

SEQ ID NO: 21504 - protein, 402 aa, Methanobacterium thermoautotrophicum
MSWYDMGPVSTCKLFGAVRAVTGIKNAVPLIHGPRGCAYHIGYLLTARGGRRIAVASTELSESDVVFGASEKLRDRIIEVDRTRKPDIIVIMSSCATSIIGEDIGRVADETSELVDAELITVSAGGFESSQGEGYEEVMMALIHKFCWRMEPSSKPSVNIIGEFRGGADLREVRESLSLMGVDVNCVLTSGCSIRDMTMIPAGHLNCSFCDVSGIAPCRFLEENFGTPFIHHPIPIGFSNSLRFYREVLGYLNLDYPINEEFSAFIEERDRIRAELEGLRVAVVSGPTRAVALTEFITELRMKPVLVSMDMIGDYTLENLRGVPGLRSEILVGVDVSDIEEAIIRTEPELILGGLAETRISEVSGAPLIDVMHGSSLTAGFRGAVNLGARMCGAVYGDHDCY

SEQ ID NO: 21505 - protein, 350 aa, Methanobacterium thermoautotrophicum
MKYAIETFDLTKVYGDFKAVDSLNMKIEKNSIFGFLGPNGAGKTTTIKMLTCLIPPSSGTARVAGYDILKNPDEVRQQIGMVPQKVSLYEDLTARENVEMCADFYGMPEDLKESRIEELMELVDIKYAADKPVGQMSGGQQQKVSLVASLIHQPDILFLDEPTIGLDPTTKRVLWDLIDELNSSGHTIILCSHDMYEVELLCDYVGIINQGVLAAFDTPQGLKDTVIKEEESLRAKEIGGILDRIDKETPESERRAIQEIKKSERICAGKEISMLIVNLTDDLLSELEALPVTLDVKKHHTGRIILELDETCETAVNDVLAAVIRNNARITSISTKDPSLEDVFMKVTGR

SEQ ID NO: 21506 - protein, 466 aa, Methanobacterium thermoautotrophicum
MNDTHGYIKSHPELFWEGREIVYETLGGYQHIAGLVDKIRKERPALLLDCGDTIHGTYHAVKSRGAAMIPLLNEMGFKAMTAHWEFAYGPERFIELSKKLNYPVLAINCYREGTERLVFQPYEILDVGELQVGIIGIASNIVDKVMPPHFSEGLEFTLGLEELPGWIDILRNEERVDLTVVISHLGFPQEVQLASDVEGIDVLLSAHTHNRLERPHIVGDTIIIQSGCHGSFIGRLDLEVDDGVRGFSHELMKVRGPSDPDVEEMVLRITETDSDHLETVVGSTRTHLNRYTILESTMDNLLLKAVMDTGDFDLAFSNGWRYGAPVPPGDIRIEDLWNIIPVNPPLSRVRLTGREIWDMMEENIELVFSRNPYNQMGGYLKRCLGLEMYFKIENPPGARIQKIFVNGRPLDPSGTYSAVYVTSQGVPSRYGEDHEETDLRAIDVLEEYIARNSPVDAGLEGRITPV

SEQ ID NO: 21507 - protein, 558 aa, Methanobacterium thermoautotrophicum
MLKILSMESQVYECDVLIIGSGGAGCRAAIEVSEHNLTPLIVSKGLSFKSGCTGMAEGGYNAAFACVDPEDSPDVHFEDTMRGGGFLNDPQLVRILVDEAPDRLRDLETYGALFDRQESGLLDQRPFGGQTYRRTCYQGDRTGHEMITALKEEVIRRDIETVEEIMITSLLVEEDRVLGAMGVSIRDSSTVAFRASSTILAAGGAGHIYPVTSNTIQKGGDGFSVAWKAGADLIDMEQVQFHPTGMVYPESRRGVLVTEAVRGEGGILLNSEGERFMKRYDPRGELATRDVVARAIYTEIMEGRGTGNGGVYLDVSHLPDEVIEEKLETMLLQFQDVGIDIRSEPMEVAPTAHHFMGGVRIDEWGRTNLRNLFAAGEVTGGVHGANRLGGNALADTQVFGRRAGIAAARNAIKSAPASIKSTVEEEEYRIKSMVAEGSHSPSEIRDRLHEAMWNGVAIVRSRESLESARAVIQDLTTMMGDLNVPETSGFNTYLIEALELENMLVTSSMVVESALIREESRGSHYRKDFPETRPEWLKSIVLNRNRRPGFIERGLKSA

SEQ ID NO: 21508 - protein, 287 aa, Methanobacterium thermoautotrophicum
MKIRIAVPSKGRISEPAIRLLENAGVGLKDTVNRKLFSKTQHPQIEVMFSRAADIPEFVADGAADLGITGYDLIVERGSDVEILEDLKYGRASLVLAAPEDSTIRGPEDIPRGAVIATEFPGITENYLREHGIDAEVVELTGSTEIAPFIGVADLITDLSSTGTTLRMNHLRVIDTILESSVKLIANRESYATKSGIIEELRTGIRGVIDAEGKRLVMLNIDRKNLDRVRALMPGMTGPTVSEVLSDNGVVAVHAVVDEKEVFNLINRLKAVGARDILVVPIERIIP

SEQ ID NO: 21509 - protein, 910 aa, Methanobacterium thermoautotrophicum
MVLTMTAIYELEVEEVLQRLETSESGLDPQEAEKRLKIHGPNKLEEVKRRPLILLFLSNLYNVLALLLWIAAILSFITGNYQLAVAIVMVIIINALFSFWQEYEAEKAAEALKNILPVMVKVIRASKEVLIPAADVVHGDIIILEEGDTVPADARILESHNLRVDASALTGESKPVRKVSHPVREADNYIDTENILFAGTQVTSGTGRAAVFATGRDTEFSRIATLTQEVREEPSPLQRQISLAARIIGALAVAMGVILFLVNLYIVRLPLETAFIFAIGLMVANVPEGLLPSVTLSLAASARKMARENALVKRLSSVETLGSTTIICTDKTGTLTRGEMTVRKIWIPHKVIEVTGSGYRPEGQFLFRGEPVSHRDMAELKLLMRAATFCNDSALIHEEGEWSVLGDSTEGALLVAAEKLGFDAEAELKAMPRITELPFDSRRKSMTSIHEKSGKRVAYVKGAPKKIIGLSERISVDGRVRALHADEKERIIGIHDEMASKGLRVLAFAYRELPEDLEVRDPGEVERDLVLVGMAAMHDPPREGVKEAVEHCKTAGIRIIMITGDYGLTAEAIAREIGIVEGECRIIKGKELDKLKDTELRGILARERNLIFARAVPEHKMRIASVLEDSDEIVAMTGDGVNDAPALRKADIGVAMGSGTDVAKEAADIVLADDNFASIVTAVREGRTVYENIRKFITYIFSHETAEIVPFIMMVLFSIPLPITIMQILAIDLGTDTLPALALGRSLPESDVMKLPPRAPSERLLNREVILRGYLFTGTIEAALIMAAYFLVLYSGGWLPGQELSASDPLYMRATTVVFAGIVMAQLGNLLSSQTLRSSALEAGLLRNRWILAGMVFAISVMLLVIYLPPLQPIFGTAPPGILEWFILILFTPIVFLTDEMRKFIQRRLA

SEQ ID NO: 21510 - protein, 790 aa, Methanobacterium thermoautotrophicum
MKRITIRIGGMGCAACALKIEEALRKLDGIRDAAVNLVEGKVSVEYDPRRVDLSDMEAAIEDAGYTVLNENIAMAVGGMSCAMCVQKIESALRGLEGVSNATVNLAAEKAYISYNPSLTSVEDLKRTVEDLGYTVRGLEGEEISEDLKPKIRRIIVGFGVSVPLMAMMYLGLQPPGGGISMLLVSIIPFIYVSGPIFRGALRSLRSGTLDMDVMYSMGIGVAFLSSILGTAGILPSDFMFYDTALMLASFLTLGRYLEAGARGKTSEAVRRLMELQPDTATVLRDGREVEVRIHEIDVGDEVIVRPGDRVPADGKVVEGSSYVDEFMITGEPLPALKTPGSEVVAGTINTDGILRFRVERTGDETFLSGIIKLVDEAQASKPPIQRIADRAVSYFIPAVLLVATSAFLFWYLVEGAGLLLSITVLISVLVVACPCALGLATPTAVTAGIGRGAELGILIKKGEALEVSDRISCVIFDKTGTLTLGRPRVTDMVGDVLGLAAALERKSRHPIAAAVTERAEEEGVDVPEAEDFRAIPGMGLEGMVDSHHVLAGNRALMEKYGIPLEHWDPEKFESDGKTVVIVAVDGEVKGIIAVSDEIKPGSARAVRELERMGIGTAMITGDNRKTAEAVAREVGIGTVIAEVLPQDKATRVAELRERGEGVAFVGDGINDAPALAEADLGVAVGSGTDIAREAGEVVLMGDDPLDVPAALQLAGKVISRIRQNIFWAFAYNVVLIPLAAGALYPLGIVFRPEYAGLAMALSSVTVVSLSLTLRGYTPPARRLREKQGEG

SEQ ID NO: 21511 - protein, 449 aa, Methanobacterium thermoautotrophicum
MAIHPVEFRYGTPEMRVIWEAENKLQKMLDVEAALAQAEGELGIIPAEAASEIVRKASTEFVTLERVNEIERDTKHDIASLVKALAEQCEGDAGEYVHFGATSNDIVDTSNSLLLRDSISVLRDKLTRVLEVLLALADENRDRVCIGRTHGQHALPTTYGMKFAIWADEIHRQLERLDACSERLCVGMMTGAVGTTAALGEEGLEVHERVSEILGLRPVLISNQVVQRDNHAEFIMVLANIATTLDKIALEIRNLQRTEIMEVGEKFDPEKQVGSSTMPHKMNPITAERICGIARVIRSYVVAALENNPLWHERDLTNSSSERIILPEACILTDYILKLTLDVLCNLVFYPENIKRNLEFTGGLIMAERLMAELTRRGMGRQTAYAAVRQCAIEASRTGRSLRDVVLERSEIMDYLTVEDLEEIMNPETYIGSARRMVERVLEESQKWL

SEQ ID NO: 21512 - protein, 309 aa, Methanobacterium thermoautotrophicum
MSEDRDLLAVGHTAFDYIIHLDEFPEPNTSTAIKRMRNLHGGAAANVALVGSRLGLRTSLVSAVGGDFEGSEYRELLESSGIDIESMILVADESTPTAFVMTDSDHNQISYFYWGAARYFKDAETPADAIKSARAVHLATGDPSFNCRCGEFARSLGKIISFDPGQDLHMYSRSQLERAVGVCDILFGNHHEIDRICSKLSVDIHGLREMGPGVVVKTYGKEGSIIYSDDVIKIDAIPREAVDPTGAGDSYRAGFMRAYLRGADLKTCGRFASAVASFIVEDEGTQTNIPDTGEAVKRFTAQWGYEPPI

SEQ ID NO: 21513 - protein, 865 aa, Methanobacterium thermoautotrophicum
MTVLEAALANDIYIPHLCFREGIEPFGGCRLCLVENTDGRLVTACETPVEDGAEFISESERINNIRRTVVSLLISEHSRDCLSCPSSGDCSLQEVSSYLNLTEDDLSRLRQDLPESEPDESNPFFIRNHDKCILCGLCVRVCRATGAEAIDFAYRGHDTRISTFMDRAITESSCVSCGECVEVCPVGALVSREEKPFTEVKTVCPYCGAGCGIYLGVRGDRVVSSRGDPDNPVNRGKLCVKGRFALKFVNSPERLKKPLIKVDGRFVEVEWDEALSTVAERLSEYSGEEFAAVASAKCTNEENYILQKFTRAVMLSGNIDHCARLCHAPSVRSLSMTLGSGAMTNSIAELEDSACILAVGTNPTETHPLTAYSVIRAIRSGAKLVVIDPRRTRISELADIHLQNRPGSDIPLIMAMCRFIIEEGLHDTEFIESRTENFDEFRDAVMALDLEEVESLTGVGVEDMRRAAITYASKKPASIIYSMGITQHAHGTDNVIALSNLALLTGNLGKPSAGINPLRGQNNVQGACDMGALPDLLPGYQTLDDSFRFSDKWGSTIPGPGMTLPEMFDAALEGRLRAMYIMGENPLLSEPETEKTRKALESLDFLVVQDIFMTETAELADVVLPACAWAEKDGTFTNTERRVQLIRKALDAPGEARTDWEIICMLAEKMGAEGFDYASSSEIFKEIAALVPSYAGISHERLQDGGIQWPCTSYEHGGTQYLHSERFSTPTGRASFLLPGYHVGEVSEEYPMVLVTGRNLYQYHTRSMTGRVPELDSFSDREELLINPLDAAKLGVEDGGTVLVKSEGGSLEVRARVSGDVMEGVVFMTFHFAETPANVLTGGDRDPVSGMPELKFTPVSIRPVE

SEQ ID NO: 21514 - protein, 469 aa, Methanobacterium thermoautotrophicum
MPFKLFDVDAEIPERKKHVYIKKKEDPEEDLPLCNTKTIPGCMTERGCAFAGAKGVITGAIKDALHVIHSPVGCTAYGYGTKRYPTSQEMPDGSLFPIENFNLKYITGTNLTETDVVFGGMDKLKRCIIEAAKEFPEANAVYTYATCTTGLIGDDIEAVSREVSEEIGKDVVAINAPGFAGPTQSKGHQVANYTLFENLVGTAEPPVVTDYDVNLIGEYNIDGDLWVLKRYFEEMGINVLSTFTGDCCHDEIKWMHRAKLSLVRCQRSATYIARLLEERYNVPYMKVDFFGIEYCKRNLMATGEYFGIPERAEEVIKDRMEKIGPEIEYLRNKLAGKKVWVFSGGPKNWHLPRPLEDELGMEVVAVSTMFEHEDGYEKIKKRVGENTVIVDDPNSLELEEIIEKYRPDIILSGIKEKYLAHKLGVPCVLIHSYENGPYIGFEGFLNLARDMYASIYSPVWDLLEFEAGD

SEQ ID NO: 21515 - protein, 459 aa, Methanobacterium thermoautotrophicum
MSEINVMERTRELVVNPLVTCQPFGAMFATLGIRRGLPIVHGSQGCSTFVRYGLNRHFREPAEIAVTSLHEDAAVFGGRSNLIDGVKNLVKRFRPELVGIVTTCSSEITGDDVDGFLRVAEAELREELGERFRTRMVSISTPSFVEHHLRGYGNALKSFIDTLAVDEGDCNERINLIPGIVNPGDIREIRHIFELMDVDPIILTDTSDPFDSPLRPSKTEKMPFYPKGGTVVSDIEESSNSIGTLSMSMYGNEASETLKKRFNIPKEHHIPIGVRNTDDFVRSLARIAEVDVSEELLDERGILIDSMADISSRYLFGRTAAVYGDPDMVMGVSRFLCELGITPLYACVGVDNEIFREGMKRVASEADERINVMINSDLRALERELTEEPVDFMIGNSDGRLIARDLGIPLVRMGFPVYDRVGYHRIPVVGYRGSVNLLNRITNTVLREYYEPQHWKLQQ

SEQ ID NO: 21516 - protein, 666 aa, Methanobacterium thermoautotrophicum
MKVLTTCTRDCPGSCGLTVNVSRGKVNSIEGSSIHPHTRGFICKNTARYHVRRLYSDRRVLKPLKRDGRQWKTISWDEALHVISDKLNECMDEHGAESIVYYQGFGARTALRLLNRRFFNLIGATTLRGTLCGGAAIAAQSKDFGRRLSHDPSDHLNSRNIFIWGRNPAVTDINLWRIIKRAQKHGTRVITIDPIRTQTAVKSDIHCQIEAGKDLYLAIAMAKIIMAEELHDSGFIEKHAENFDSYIEILDEFNLNQLSELSGVPLKIISKLAHLYSDGPSSIILGWGLQRYFNSYMACRFIDALAAISGYIGVSGGGVSSGFDEYGAFDESVTLEGAGNGRKVSMPLFGREIVNMNSPTVNCVFITAGNPVTLGPNSIQTLNALREVDFVVMVDLFLNDTAHTADLFLPATTFLEETDLVGSYGHPYVSPVNAAVKPLGESHSEFWILQRLSEIMGFADMEGTRMEWLEIIASKVLDYHGIEICDLLEKPYRSPGFPPVPFEGPLFYTDNGRFNLPSDRPYEMEQHDGAHPENSIRLLTVMSPQWVGSVEPTFHKGLVEIYLNPGTLSQLGFNDGEISVAESNAGKSCVIVRSSEDVHPLCALSFRGTWLSKGGCINTVIEDRETIMGHGTAYNETRIKLKKVSGGVSVHEMCHETHKYKSRHYE

SEQ ID NO: 21517 - protein, 561 aa, Methanobacterium thermoautotrophicum
MKELLYMELAEVYHRLESTTKRLEKTEILAELLRSVDKELLPDVTILMLGRVFPIWSEEELGVGIKLLMKAISLVVGVSMDEIEDEIREQGDIGLASEKLFSRKTQTTFFSQPLTVEFVYSRLKALASASGDRAQSKKINILVEVLSQAKPLEARYITRTVLEELRVGVAEGIIRDAIARAFEVDPALVERAHMLTNDLGMVAAVAREEGEPGLGRLNLEPGRPVKPMLAQLASSIESAITELGRAFCETKYDGIRVQIHRCGDEISIFTRRLENITAAVPEILEGVEEALPADDYIVEGEIIVTMDGRPASFQYILQRVRRKYDVERLTREVPLSLFLFDVLYHREPLIDEPLRHRREVLESILSEIPGRVEASRMVDVGPDNLNDALWLFEESIREGHEGIMIKDTEAPYIPGIRGKKMLKFKAEPETLDLIVVGGTYGRGKRAHLVGSYLLAARDEDSGDLVTVAHVATGLDDETLQQLSERMEKLAIERKGRKLLVRPEIILEVAYSEIVKSPEYESGYSLRFPVVKRIRDDLCLDDVDTVGRIESLFQSGQPDQPG

SEQ ID NO: 21518 - protein, 455 aa, Methanobacterium thermoautotrophicum
MKKLFGTFGVRRLANEVLTPEFASKLAAAYGSTVEGKIAVGGDTRTSTVMIKNAVISGLLSSGCDVVDLGILPTPAVQYAVRKYYDGGVIVTASHNPPQYNGIKFVDSDGIGIPDDLEEEIERIFFSEDFRRASWDKIGNLTSNPSIIREYQDGVIARVDAEAIRRRKFRVVVDCGCGAASYTMPYILRRLGCQVIALNSQPDGFFPGRDPEPVPENLSELMETVRSTGADLGIAHDGDADRTICIDERGEFVLGDKTFALVEKRMLQEKGGGIIVTTVATSSAIYDIASENNGEVITTAVGDLLVARKLKETDGLFGGEENGGLIFPDFVYGRDAALTAATILEIMAHEDRPLSALVSELPAYYSSKRKIECPDEIKGDVMDLVSKMLADEEGVRDIDTTDGVKIFSEAGWVIIRPSGTEPIFRCFAESETQEQADEMARWGISLVERAMEKLK

SEQ ID NO: 21519 - protein, 373 aa, Methanobacterium thermoautotrophicum
MKLKSGSMVKIRNKINDIEPYVPGRSIKEIADAYGLKEDEIIKLGSNENPLGPSPAAVEAMERELESVHRYPESALTDLREAIADYAGVGMDQVIVGGDGADEIIDVLGRTFLEPGESFVVPMPSYMYYEYTLQAHDARAVHARWDVNENRLDLESVLDAVDESTRLVFLCTPNNPTGGLIDKKDIRAVLESTDTLVVVDEAYTEFAGVDNTDLLPDHENLFILRTFSKVMGLAGMRIGYGLGDPQIIEYMHRVKPVFSLTRLSHAAALATIRDRDYIKKSTEYSIKSREYLYSGLKKFPELRVFRSYANYILIDVRGTGRTAAELSEELLRKGIIVRDCTSFTGLDEYWIRVSVGTLEEDRRFLEVLGELVQ

SEQ ID NO: 21520 - protein, 449 aa, Methanobacterium thermoautotrophicum
MKEKKPRLFGTSGIRGRFGEKVTLELTAEHRKALATHLGGDGEVVVGYDTRTSSQLLENALIAGIVECGCDVTRLGMVPTPLVGYAASRLGAAAGVMITASHNPAPYNGIKLWNPDGMAYRPSQERVIESIIHSRDFKRKAWDELGSITTVDMRDDYVRAVLETVEIKKPLKVVIDSGCGAASHLSPLIFRKAGCRVITLNSQPDGFFPGRDPEPVPENLSELMETVRSTGADLGIAHDGDADRMVAIDDQGRFASFDKLLALMAREIGGKIITTVDASLCVDECLGDRGEVIRTRVGDVHVANTIAEEGARFGGEPSGTWLHPDFCMCPDGILSALRVAELVSARGPLSELLEEVPSYPNIRDKVPCPDEKKDIIMERVAAELSDQFSETSDINTIDGVRISLDDGSWVLVRPSGTEPYIRITLEGKTEEKARYIHERTRGYLENVIG

SEQ ID NO: 21521 - protein, 400 aa, Methanobacterium thermoautotrophicum
MFMRGQLDALLREERVFNPDEELAENSNIRAWMDARGIGGYDELLERASSDPEWFWDEMASELEWFRPYTRVLEWEPPHARWFTGGKFNITYSALDRHVMGPERNRVAYIWEGEDGSVRKLTYYDLYREVNRLANALKDMGVSRGDRVSIYLPMIPELPIAMLACARIGAVHSVVFSGFWAKAFRERAADAGAKVAITADAFYRRGKVIRLKETLDMVADEIPSLERVIVVNRMGDDVSMVDGRDIYWSEAVEGMDDECPCQELDPEDPLFILYTSGTTGKPKGVVHTHGGYAVGVSSTYRFVFDVKDQDIWWCLADIGWITGHSYIVYAPLIEGATSVIYEGAPDHPDPGRIWSMVERYGVSILYTAPTTVRLFMKYGDKWPEKYDLRTLRILGSVGNP

SEQ ID NO: 21522 - protein, 380 aa, Methanobacterium thermoautotrophicum
MITLIFPGFNNVHVSGMDIEEKIRKIEEEIQKTPYNKATAHHIGKLKAKISRLKEEALQRKTSSGKGRGFHIKKSGDSTVVLIGFPSVGKSTLLNELTSAESKVGDYQFTTLEIVPGVMEYRGAQIQIFDIPGIITGASRGRGRGREILSVARSADLIVIVLDVFNTDHMDIILRELRDVGIRPNETPPDVIVKRRKLGGVKLSATVELTHLDEKIIRSVLNEYGIHNADVLIRDDITVDQFIDVMEANRAYIPAITVINKIDLVDESYLEGLREKFPEALFISADRDINIDELREEIFNRLGLIRIYLKPQGKKADYDEPLIIREGSTVGDVCQKLHRDFVRKFRHARVWGSSVKFDGQKVGLEHVLNDEDVLRIIIKK

SEQ ID NO: 21523 - protein, 718 aa, Methanobacterium thermoautotrophicum
MRSLSGKMHEVIICEKPKSSEKIAGALFPDAMKKKHGKVSYWEHVEGDKRVTIVSAVGHLYSLRPRQSNEEHFFDLEWAPIHEIDKKKGYVKDYLNVIRKFAAGADRYIHACDYDIEGTLIGFNALKYGCGEEALRKTSRMKFSTLTREEIQRAYKNPIEVDYGQVDSGAARHILDFIFGVNISRSLMKSVKAATNRFIKLSAGRVQTPTLAILVEREKEIRDFKPVPYWIIRAELGEGIIAESKRGKIFKRELVDSILEKCQGSDAEVKDVRVRDTIRKPPVPFDLGTLQSEAYRVFGFSPKKTQTIAQNLYTEGYTSYPRTSSQKLPESIGYEKILKNLAKNPRFGVHIERLRGPLKPHEGKKEDDAHPAIHPTGLLPSELSKDEKKVYDLIVHRFISVFGEDAILQTMKVELEIGEEEFSFSRKRVSKAGWMESYPYTKMEDEEFPEISGGDSLAVRSVSADERETKPPARYNEASLIRELERRGLGTKSTRADIIAKLYDRKYIEGKKIRVSPLGENIIDTLTRYCEKIISEELTRQFERELEDIMRGKISKDRVIDEAITEVRSILSDIEENLRDIGKELYRAYQDSRVVGECPACGGKLVIKYSPRNRSTFVGCSSYPDCRTVYSLPRGASVLKSLCEKCGLPMISYGRPRQRACLDPKCGKKKSEVEEVVGKCPECGSDLIKRSGRYGEFVGCKGFPKCRFTCSVDEVPEG

SEQ ID NO: 21524 - protein, 181 aa, Methanobacterium thermoautotrophicum
MTDVDIKIENIVASATLGKSIDLQTVAEALENVDFNREQFPGLVYKLKEPKTAALIFGSGKLVCTGAKSIEDSKRAIKLTVDMMRTMDPDIPEEFEIKIQNIVASANLGKPLNLEAVALGLENTEYEPEQFPGLVYRLDDPKVVLLLFGSGKVVCTGAKSAEDAKLGVEKTKARLAELDLI

SEQ ID NO: 21525 - protein, 428 aa, Methanobacterium thermoautotrophicum
MVKMNMTEKILAEAAGLREVTPGEIIEARVDLAMTHDGTSPPTIRTFRDIASRGGPARVWDPERIVMVFDHNVPANTIGAAEFQRVTREFAREQGIVNIFQNAAGICHQVLPERGFVRPGMVIVGADSHTCTYGAFGAFATGMGATDMAMVFATGKTWFMVPEAMRIEVTGEPEGHVYAKDVILHIIGEIGVDGATYRSVEFTGDTIESMDVSGRMTICNMAVEMGAKNGIMEPNRQTLDYVRARTGREFRVYSSDEDSQYLEDHHFDVSDLEPQVACPDDVDNVYPVHRVEGTHIDEAFLGSCTNGRYEDLKIAAEVIGDRRVHEDVRFIVSPASREIYLKALEDGIIETFIRAGAIVCNPGCGPCLGAHMGVLAPGEVSIATTNRNFRGRMGDPASSVYLANPAVVAESAIEGVISAPQQEAGNGC

SEQ ID NO: 21526 - protein, 642 aa, Methanobacterium thermoautotrophicum
MEREAEISAMMNEIRRLSPRQRERARRAVNGLNGKITGRELGFHLVKYGRRDPIDTQISVGDLVLISRGNPLRSDLTGTVAMKGKRFLVVALEHVPGWALKNVRIDLYANDVTFQRMIDNLKSPTRNVLRVLGFLCGTEKPSDGVDVVDFQAVDPELNESQRDAIRMALGSEDFFLIHGPFGTGKTRTLHELIRQEVMRGSRVLVTAESNAAVDNLLEGIAGHVKCVRLGHPQRVSRENLRETLAYKIENHPEYSKVREYQEKIDELIEERERHQKPTPQIRRGLSDTQILINATKRRGARGISPNVMISMARWIETNQRIDDLHSKLQEAEMRIADRILRESQVVLSTNSSAALEYIDGLRFDVAIVDEASQATIPSILIPLARAPRFILAGDHRQLPPTILSRDASELERTLFEELIKRHPGRSRMLNCQYRMHPAIMEFPNREFYDGRIRAHPSLEDISIRDIIEDVPDSDICQKLADPDPVLFIDTSGLDGCERRLKGSTSIQNPLEADLAVIISRSLMRMGVKPEEIGIITPYDDQVDLISSMIDVEVNSVDGFQGREKDVIIISMVRSNRNGSIGFLKDLRRLNVSLTRARRKLIIIGDSRTLSAHPSYRRLTEFCRKRGFLDEAGLDDVRKWGAS

SEQ ID NO: 21527 - protein, 417 aa, Methanobacterium thermoautotrophicum
MPYKVKDISLAPQGEKKIRWVQEHMPVLERIKSDFSEEKPFKGVTIGSCLHLEPKTINLGLTLQAGGAEVAMTGCNPLSTQDDATAAGAKMGLNMYGWRGETNEEYYENIHRVLDHEPEILIDDGADMIFLVHRERPELLDGIIGACEETTTGINRLRAMAADGALKFPVMAVNDAYTKYLFDNRYGTGQSTFDSIMGTTNMLIAGKTVVVCGYGWCGRGIAMRAEGLGASVIVTEVDPIRALEARMDGFRVMKVSDAVKEADILITATGNTDVVSESEFMNMKDGCVMANSGHFNVEINREALEELSRETGKVKEDIEVFIMPDGRKIYLLAEGRLVNLASERGQGHPAEIMDMSFAMQALSARHLLQEKPDPGVYRAPDEIDLMVARMKLDAMGIEIDELTEKQRLYLENWEEGT

SEQ ID NO: 21528 - protein, 732 aa, Methanobacterium thermoautotrophicum
MGCMTKKEIKLKVAEALAQQDVGRGIARVDPACMEKLGLSDGDIIEIEGKKLTAATVVSSQSDIGLGIIRIDGYLRKNAGASIGEEVTVRRADVKDAQKVVLAPVDQEVIIRGDIRSAFLNRVLVKGDIIVSGIRQHISGGGLFDEFFRDFMDISPLGEIKLAVVSTSPAGVVRVTPSTQVEMQQKPVDVSKLEGVKNLVDVTYEDIGGLKEEVKKVREMIEIPLKRPELFERLGITPPKGVLMHGPPGTGKTLLAKAVANESDAHFIAINGPEIMSKYVGGSEERLREFFEEAEENAPSIIFIDEIDAIAPKREDVSGEVERRIVAQLLTLMDGLKSRGQVVVIGATNRPDALDPALRRPGRFDREIEIGVPDREERKEILQIHTRGMPLADDVDLDELAEITHGFVGADLESLCKESAMRVLRRVLPEIKADEEIPKEVLKKMVVTRADFKDALKEIQPSALREVLVQVPNVSWDDIGGLEGAKQELREAVEWPLKYPDRFKKFGIRPPKGILLHGSPGTGKTLLAKAVANESQANFIAVKGPELLSKWVGESEKGVREVFRKARQTAPTVIFFDEIDSIASVRSGSTADSGVTQRVVNQLLTEIDGLEELQDVAVIAATNRPDILDPALLRPGRFDRHVKVEDPDKEARLAIFRVHTKDMPLADDVDLEKLAEKTEGYVGADIEAVCREAAMLTLRDNMDAEEVSMKYFLEAMEKVKPKGGVEEQVQYH

SEQ ID NO: 21529 - protein, 561 aa, Methanobacterium thermoautotrophicum
MINMNIGPYNNRPDMGRLREIIRVMTKYHFGNILEAVGLKNRLFETLKLYIKSPEEVHEPAHVRLRLVLEELGTTFIKLGQVLSTRADLVGREVAEELAKLQDEAPPFPFEDVKRVLESELGVPMEEVFAEFQEEPVASASIGQVHRARLRNGDAVAVKVQRPGIADTVKSDIILMKYLAKLANDRVPGLRYYNLPGIVAEFERAIRKELDYHQEANNVERFRAMFMDDETVYAPYVYREYSTGRVLTMEYVDGVKLTDILKSDIKFNARVIAERGARCYFKQIFIHGFFHADPHPGNILVQKGNVLCFLDFGMMGHLDRSFRDRLAELFILLMNYDVNGIVNQLRYMNILTEETDLEEVKYDIIDLLDRYYGADVRKVGEILTEFTMPGMIRRHRIRIPRDFVLLARVMSMAEDLGERLDPRFNGLAVAWEMTHKLIRNRLNPLRNLDEVPAAIIELEHIMNDLPRGLISALQKLEEGKLKMELEHRNLDEISVRIERSTNRISVAMLVSALIIGSSLVTIPREALILEKFPFLGIFGFAVSFLIALALIVSIIKSRRLS

SEQ ID NO: 21530 - protein, 431 aa, Methanobacterium thermoautotrophicum
MVSDMRCVVIGGGPAGRAAAMELAALDMDVILVEKKLIGGTCLNEGCMVVCGLNDVARFLDDARQLSDLGVLDVECSADYRRIAGGVKRTLERIRHVTERETLDAGIEIVYGVAEFEDDRLLVEGEEMDYDRLIIATGASPLIPPIEGASKAITYRDILDLDGIPDKLVIIGGGVIAAEFAGIFSSFGSEVTVVSRSGFLSKLDPLIRDYVSEKVLSDVRILEDTSTTEIDGSGVQTSGGYIEGLPMLATGLRPNSDFLKGFLELGPRGGVKVNDRMETSRQNVYAAGDVTGGHGTTPVARMEGVVAGLNAAGIERRVDYRYLPYSISLRYDVGFVDIPGEGGREAVIPGLAGPGSFWGVNNGKTGISKVRILDDGTPSGIYSVAPGARLIMPYLSLLMRLGVSMYEFEGFVETHPSTDSIYKLMRFLSRY

SEQ ID NO: 21531 - protein, 385 aa, Methanobacterium thermoautotrophicum
MISPKKYAKAAKVPPNGFKTSNEFFNYVFKDKEMIWMGQNTNHLHDHSEIAEAMIECINEGSYCKYPPPEGFPELKELVLKDLGLGDDFEALITAGGTESLYLCMNDILEPEDNAITCDPGYLIIDNFASRFACSVKSVPIYSSECDYKLTPDLVLENMDRDTRLISLIDPLNPLGSSYTRDEIKAFADIAVDHDVYLLHDITYRDFAREHHLAAEYAPEHTVTVYSFSKICGMAGLRIGAIVATSDIIESVKGIVINDLGTNVVSQAGAIAALKSKAKWVERIRNETLGNQKIIKAAVDEVEGAFLPVYPSNGNMMAIDIYETGVNPVDLTDYLLKRKIFVRQGAYTSKIFGDRYIRLSFSIPREQVEIFAENFVDVMEFLRPS

SEQ ID NO: 21532 - protein, 381 aa, Methanobacterium thermoautotrophicum
MVVIGGRVAGSTAAYHAARLGLSVLLLERNPEIGTPVQCAGGVSDSFFKSTGLKPLPEFTCTRIRAAAVNGPLGARIVTENPVVRGYILERKSLDKYLALRAAEAGADVLTMSIAGDLIFREGSVSGVVFRGPDGVQEVECGMVIAADGVQSSIARKAGLETGFRPADLCSCVQYEVAGVDVDPETMEFYFGSRFAPSGYLWVFPKGEGRANVGLGIRRKSCSERGPLSYLNRFMEERGFKRIEFNAGAVPVCGPIERTFTDGLLVVGDAAGQVDPLTGGGIHLAAECAKIAGEVAAEAIESGRVDGRFLSRYEMRWRKKIGKNLERSLKFRKILDGLGDEELDALLRSLEGKDLSSISKISLLRILKDYPSMLRILRDIL

SEQ ID NO: 21533 - protein, 496 aa, Methanobacterium thermoautotrophicum
MSELQKRAMRFLEDKNPVIVSNRGPVEFFKENDETVMKRGAGGLVSTLLPLVERFSGVWISSAMTVEDARVASGYPENRVPLPEDDPRFTVSFVIVDRERYESYYSIISNPLLWFVQHYMWNTPYDPQIDDKVYRAWEDGYVHVNKKFGDKVISEIERNEKDSLIMLQDYHLYLCPFFIKKEIGDVFLSHFIHIPWPQRDYFNILPERMRADIIGGLLSNTILGFHIERYCANFFECCEDLGYEVDGDRGIVRNGDEKTLVKSYPISVDPESMERTVSSPTFMEKDEFVRKLKGNMFLIYRTDRADLSKNIIRGFRAYELFLRDHPEFHGKVKFLATGKPTRQQIREYRNYSEEVKDTVEEINEKYGTDEWKPIEYIYRADYELVAAAFKNYDCLIVNPIADGMNIVPKEAAIINREDGALILSERAGCYDELAEHVIGVNPFDIKETADAIYSAMKMSPGKRKKLSEGLKSRVLKRTIYHWINEQFDDFEDLWES

SEQ ID NO: 21534 - protein, 436 aa, Methanobacterium thermoautotrophicum
MIRMARYVQDIRGSVNRDIDCQFALNLGMLIGDYVSCKRVLIGRDAHTPSQLIKRAIGTGLMAAGVDVIDFGVATVPVIHHHMKSFDTHLMINVSRSPLRADEINIKLLSNHEIPLEQRPTLYAEYEELGKLMYVDNYLESYVRSVLQLIVPSVSEREFMVVLGCDEGSPHNVEGEILNQLGCQTINITFRGSLFGKNFPIANPSSIAMISDVVKAVGADMGVILDNDRDTIFFIDERGQLLRDQTVLSIFAGHYLSRGDGPVVSSVVASKSLERVSRGRLIRTSVNNVLNEVHTNNAVFGGDEPGMYIFPEFQCCYDATFALLKMLEIITEENRTLHDLASEIGKYSRVEFSVECPNEFKDTVIERLLEQFQESDPELIDGIRVEDRAGVILIRPSRFEPVLRVYIESESPEETQKRSRDMIDLIKKEMSDLYGE

SEQ ID NO: 21535 - protein, 385 aa, Methanobacterium thermoautotrophicum
MFMTSVVVMAGGKGTRIRPLTFSRPKPLVPVANRPILDYIIHRVLDSGYSKVVMTLGYLKDQIRSHVLAEYPEIDFRFSVEKKPLGTAGGVKAAASEINETFIVLSGDVIFDLDLREMVKFHRKKNALVTVALTPVEDPSHYGIAVLDDDGKIKRFHEKPRPEEVFSKIANAGIYVMEPEVIEHIPQGSSDFSADIFPVLIERDAGMYGFLFDGYWNDAGKPNTFLRANHDVLNGTVTPEPDGEIAEEVPGRFGKIWIGRDVVIGDRVRIVGPAVLGDGSRVDDGAYIGKNTVIGSRVNVGENSFIRGSVILDGCVIGRGSQLLNCVVDEDCEIGAGCAIDRCAIIGRGAFIGPSTVIRSHCSVSNRLRILSGSLVDSDYPLVPE

SEQ ID NO: 21536 - protein, 264 aa, Methanobacterium thermoautotrophicum
MPDYLFDFLDELKFLRNGRKTAIITDIDGTISEIAPTPEEAVVDDEMRDVLRDLASRYRVLAFISGRPVREALRMVGVPGAVYVGNHGLEYIINGNYQRFSEVEEYIPLIKKCALELRDKIDEENVIFEDKGICYSIHYRQCTDPELSRKRILKNLQEIPESKGLKVDHGRMLVELKPPLHYNKGFIVRKILEDSDVSSAVYLGDDITDADAFREIRKLESERGMKNVPILVLSKEIPPEVKNSARFFVYGISEVLRFFRWLLK

SEQ ID NO: 21537 - protein, 194 aa, Methanobacterium thermoautotrophicum [sequence omitted]

SEQ ID NO: 21538 - protein, 666 aa, Methanobacterium thermoautotrophicum
MMKTVDKSKTLTKFEEFFSLQDYKDRVFEAIEKYPNVRSIEVDYLDLEMFDPDLADLLIEKPDDVIRAAQQAIRNIDRLRKNVDLNIRFSGISNVIPLRELRSKFIGKFVAVDGIVRKTDEIRPRIVKAVFECRGCMRHHAVTQSTNMITEPSLCSECGGRSFRLLQDESEFLDTQTLKLQEPLENLSGGEQPRQITVVLEDDLVDTLTPGDIVRVTGTLRTVRDERTKRFKNFIYGNYTEFLEQEFEELQISEEDEEKIKELAGDPNIYEKIIRSTAPSIHGYREVKEAIALQLFGGTGKELDDKTRLRGDIHILIVGDPGIGKSQMLKYVSKLAPRGIYTSGKGTSGVGLTAAAVRDEFGGWSLEAGALVLGDKGNVCVDELDKMREEDRSAIHEALEQQTISIAKAGIMATLNSRCSVLAAANPKFGRFDSYKSIAEQIDLPSTILSRFDLIFVVEDKPDEEKDRELARHILKTHKEDHMPFEIDPELLRKYIAYARKNVRPVLTDEAMQVLEDFYVSMRASAADEDSPVPITARQLEALVRLSEASAKIKLKEHVEAEDARKAIKLSQACLKQVGYDPETGKIDIDKVEGRTPKSERDKFRLLLELIKEYEDDYGGRAPTNILITEMMDRYNVSEEKVEELIRILKDKGAIFEPARGYLKIV

SEQ ID NO: 21539 - protein, 336 aa, Methanobacterium thermoautotrophicum
MEKILVTGGAGFIGSNFIRYMLQEHPYHIINLDALTYCGNLENLRGVEDEPRYTFVRGSITDRKLVDGIIKDVDAVINFAAESHVDRSIEDPEIFIRTNILGTQTLLEASRKHGVERFIQISTDEVYGSAEKGYFTEETPLAPNSPYSASKASADLMVRAYHRTYGLPVNITRCSNNYGPYQFPEKLIPLMITNALENKPLPVYGDGMNVRDWIHVLDHCRAVDLVLHRGRVGEVYNIGGNSERRNIEIVELIVRELGKDESLIRFVEDRPGHDRRYAIDASKIRNELGWKPLYSFEEGIRETIRWYIDNRDWWENIKSGEYLRYYERMYGGRLQD

SEQ ID NO: 21540 - protein, 292 aa, Methanobacterium thermoautotrophicum
MKGIVLAGGSGTRLYPITRAVSKQLLPIYDKPMIYYPLSVLMLAGIRDILIISTPRDLPLYRDLLGDGSQFGVRFSYRVQEEPRGIADAFIVGKDFIGDSKVALVLGDNVFYGHRFSEILRRAASLEDGAVIFGYYVRDPRPFGVVEFDSEGRVISIEEKPSRPKSNYVVPGLYFYDNQVVEIARRIEPSDRGELEITSVNEEYLRMGKLRVELMGRGMAWLDTGTHDGLLEASSFIETIQKRQGFYIACLEEIAYNNGWITREDVLEMAEKLEKTDYGKYLRDLAEGNFHG

SEQ ID NO: 21541 - protein, 514 aa, Methanobacterium thermoautotrophicum
MKFLYLLQHNTINMVCGGFMNIVIVGAGFGGISAAALLAQKGLEVTVIEKNEGPGGRASVYSEGGFTFDMGPSWYLMPDVFENFFAEFNARPEDFYDLKKLEPAYRVFFDGGRVVDVSSDIEKNYELFDSFEEDGGERLREYLESAGKLYDSVVKEMLYRDYRSVLDFLNGKLLLQGLRLNILESLEHFVNRRFKSDEARKILQYSMGFLGSAPQNTPSMYHIMSHIDMTLGVFYPEGGIRRVAQSIYELALEHGARFHFNEEVKRIEVIDGVATSIITDRNIYEADAVLVNADYPHSELELLDEPHRTYDEAYWESRVMAPSAFVAYLGVDRVIDALEHHNLFLERDWADKFQEVFDPRRARWPERPSYYVNVPSRTDTTAAPQGSDTLFILVPLAPGMEDNEELREGLYRRVMDDLERKVGENIRDHVVVKRIFAINDFRDRYNAYRGTALGLSHTLRQTALWRPSHKSKKVKNLYYTGHYTHPGIGVPMTLISSQIVCNEMMDDMGINPDG

SEQ ID NO: 21542 - protein, 180 aa, Methanobacterium thermoautotrophicum
MQVKNTEELRRELIELLSEMDVVQRGKFILSSGRESDYYVDIKRAVTEPAVLDVIARLIADAAGEVDRIAGPALGAVPIATAVSLYSRKPLLMIRKEKKGYGTSKLIEGDLQKGDRVAVVEDVTTTGGSLLKAVRAIQENGGIVEKAFVIVDREEGAVDEFKREGITLIPLLSVSDFNHS

SEQ ID NO: 21543 - protein, 187 aa, Methanobacterium thermoautotrophicum
MGRVHVDGGKSTRDLIDARKLIELLPLKPGDTFLDAGCGDGFISLEAVNAVGDEGMVIAVDIYPPSVEALRSAASGIKNIVTLLDDITGRLPVPDGTVDIYFMANVFHGIVANGEVDLLLAEVRRLLRDDGKLAIVDFKKIPGTPGPHLDLRLSEDEVIGILREKGFEVEDVVDAGSFHYLVVGSPL

SEQ ID NO: 21544 - protein, 374 aa, Methanobacterium thermoautotrophicum
MIMRKFASRVKDIQLSEIRKIFEVADEDTINLGIGEPDFSVPDHVREAVKDAVDEGLTHYTSNMGMEELREAIADKLKSENRVHAEPESIIVTVGASEAIFMCTQALLDIGDHALIPDPGFLSYDACVRLSGAVSIPVPLSMDEGFSMSPERVESLITQDTRVIIMNSPSNPTGSVMGKDDVKGIAEIAEDNDLIIISDEIYEKIIYDGKHYSPAQFTDNALIVNGFSKTYAMTGLRIGYVAGCEDIIEELLKVHQYNTACAPSISQYAALAAIRGPQNCVKDMVDEFRRRRDLMFRSLTDMGLECVLPGGAFYMFPYAGDSEEFTKLSLEAGVAVVPGSAFGNEGKGYIRMSYATSYELIEEAMERLKTVCGV

SEQ ID NO: 21545 - protein, 206 aa, Methanobacterium thermoautotrophicum
MANFFTNFLDKLLGRNKKLKIGLYGHPNSGKTTLANRMCEDWLGKPLGLTSEIPHETRTVYKKEKVTIKKDGAELDFDIIDTPGIATKVDYKNFLEFGLSEPEAKERAKEATKGIIEAIKWLDDVTGVLLVMDSSQDPLTQANITIIGNLEARKIPFLIVANKIDLPDSSPERIVSVFPQHTVVPISALHGEKTEDLYMEMVKKFR

SEQ ID NO: 21546 - protein, 491 aa, Methanobacterium thermoautotrophicum
MFSKILVANRGEIAIRVMRACRELGIKSVAVYSEADKNALFTRYADEAYEIGKPAPSQSYLRIDRILEVAEKAGAEAIHPGYGFLAENPRLGEECEKQGIKLIGPKGSVIEAMGDKITSKKLMKKAGVPVIPGTDQGVSDPDEAARIADSIGYPVIIKASAGGGGIGMRAVYEEDELIRAMESTQSVAASAFGDPTVYIEKYLERPRHIEFQVMADESGNVIHLADRECSIQRRHQKLIEEAPSPIMTPELRERMGSAAVKAAEYIGYENAGTVEFLYSNGDFYFLEMNTRIQVEHPITEVITGVDLVKEQIRVASGEELRFTQKDINIRGHAIECRINAENPLADFAPNPGKITGYRSPGGIGVRVDSGVYMNYEIPPFYDSMISKLIVWGMDRQEAINRMKRALSEYIILGVKTTIPFHKAIMRNEAFRRGELHTHFVDEYRRGIDAEMRKIVKEDQEMVERLQSTFLPSKKVAAISAAIGTYMHSRRG

SEQ ID NO: 21547 - protein, 399 aa, Pyrococcus abyssi
MNIMSGDEVQFHENYDDYITYLKRRIRQLELQVRMLEADKERLERELSRLRSEMSRLRQPPAFAGTVIEVLDDDRAIVQNYNGPRFVVRIAPWIERDKLRPGARVALDQRTMAIIELLPSSKDPTVLGFEVIERPNVTYNDIGGLKKQLQELREAIELPLKHPELFEEVGIDPPKGVLLYGPPGCGKTLMAKALAHEVNATFIRVVGSELVRKYIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDFEGRLEILKVHTRRMKLKNVDLRVIAEITEGASGADLKAIATEAGMFAIRERRTYVTQEDFLKAVDKVLGNERKLLQQITSHEIIYG

SEQ ID NO: 21548 - protein, 598 aa, Pyrococcus abyssi
MCGIIGYIGPRKASPIIVEGLKRLEYRGYDSAGIATSHEGRILIKKGAGKIDELAKRLNFTDLPGNIGIGHTRWATHGIPNDTNAHPHTDCTGKIVVVHNGIIENFQELKEELLRQGHVFRSDTDTEVIAHLIEENLRITGNFEDAFRLSLLRLRGSFALVVMFADDPERLYIARKDSPLIIGIGNGEMFIASDIPAFLPYTRKAVFLDDGEYGVVSRNGFTVKDIITGKEKRKKVYEIQWTLEMAEKGGYDHFMLKEIFEQPRAVKDAIYGNLEEVPKIAGLLSKYDRIIITGMGTSYHAALVGKYLIQRFGKIPVLVEEASELRYEYEDILDNKTLLIAITQSGETADTVAAMKLAKSKGSKVIGIVNVVGSLATRIADATLYTHAGPEIGVAATKTYTTQLTVLLLLSLELGKMNGVDTTQVENTLPKLPELIDAGLKMNEKIKELAKSLNDRRDFFYIGRGISYPTALEGALKIKEIAYVHAEGLSAGELKHGPLALIEEGVPVIGVAPSGKTFEKMLSNIEEAKARGGFIITVGDDLRLHQVSNVFIRLPKVPEEVSPITYIVPLQLLAYHLAVLKGHNPDRPRNLAKSVTVE

SEQ ID NO: 21549 - protein, 197 aa, Pyrococcus abyssi
MNRKTGTTTVGIRVKDGVILAADTQASLDHMVETLNIRKIIPITDRIAITTAGSVGDVQMIARILEAEARYYQFTWGRPMTTRAMANLLSNILNENKWFPYLVQIIIGGYVDEPTIANLDPLGGLIFDDYTATGSGTPFAIAILEEGYRKNLGIEKAKELAIKAVKAAGARDVYTGSKKIQVVTITKDGMKEEFVTL

SEQ ID NO: 21550 - protein, 356 aa, Pyrococcus abyssi
MMIMGKKSSDPAVVEINDVDELELEVGEEVTSKKKKKEKEIRTIEDLPGVGPATAEKLREAGFDTLEAIAVASPIELKEVAGISEGAALKIIQAARKAANLGTFMRADEYLKKRESIGRISTGSKSLDKLLGGGIETQAITEVFGEFGSGKTQLAHTLAVMVQLPPEEGGLNGSVIWIDTENTFRPERIREIAKNRGLDPDEVLKHIYVARAFNSNHQMLLVQQAEDKIKELLNTDKPVKLLIVDSLTSHFRSEYIGRGALAERQQKLAKHLADLHRLANLYEIAVFVTNQVQARPDAFFGDPTRPIGGHILAHSATLRVYLRKGKGGKRVARLIDAPHLPEGEAVFRITEKGIED

SEQ ID NO: 21551 - protein, 263 aa, Pyrococcus abyssi
MLKIDLSGKLAFTTASSKGIGFGVARVLAKAGADVIILSRNEENLKRAREKIKEESNVEVHYIVADLTKMDDLERTVKELKNIGEPDIFFFSTGGPKPGYFMEMSMEDWEEAVKLLLYPAIYLTKALVPAMERKGFGRIIYSTSVAIKEPIPNIALSNVVRIAMAGLVRTLAKELGPKGITVNGIMPGIIRTDRMIQLAQDRAKREGKTVEEALQEYAKPIPLGRLGEPEEIGYLVAFLASDLGSYINGAMIPVDGGRLNSVF

SEQ ID NO: 21552 - protein, 494 aa, Pyrococcus abyssi
MSPVEGYILSLDEGTTSARAIVFDREGNIKGIGQYEFPQYYPKPGWVEHNPMEIWDAQVRAIKTAIQKAKVEPAQIKAIGITNQRETTIVWDKNGNPLYNAIVWQCRRTAEMVEEIKREYGDLIKEKTGLIPDAYFSASKIRWLLDNVPRLREKAERGEVLFGTVDSFLIYKLTGEHVTDYSNASRTMLFNIKKLDWDEELLEIFKIPEGILPEVRESSEIYGYTRILGNEIPVSGDAGDQQAALFGQAGFETGMVKATYGTGNFILVNTGKTVRYSENLLTTIAWGLDGKVTYALEGSIFITGAAVQWLRDGIKIIKHASETEDLAEKLESNEGVYFVPAFVGLGAPYWDQFARGLIIGITRGTGREHLARATLEAIAYLTRDVIEEMEKLVGIKELRVDGGATANDFLMQFQADILNRRVVRPVVKETTALGAAYLAGLAVDYWESLEEIESLWRVEKIFEPRMDEETREKLYRGWKEAVKRAMGWAKVISS

SEQ ID NO: 21553 - protein, 497 aa, Pyrococcus abyssi
MGTRTKVAIIGAGITGASIARVLSKYENLEVHLIEKNPDVGWGVSKANTAIIHGGYDDDPEKYPMRARFCVKGNRIWHEWVKQLEIPHVWNGALVVALEEEDFDELEKLLERGIKNGVPEMRIVDKEELFQLEPGLNRNALGALWVPIVGQIAPIPAVIALVENAVANGVKTHLETKVKGIKVKRGEVRGLETNDGFIEADIIINAAGLYADEISRMVGLDYFEIRPRKGEYWIFDEGIPGPKRVLFPTPTPISKGIVVTTEISGHLMIGPNAKDLSPEEKENTATTREGLDEVWEGAKKLWPNLPPRSKVIRTFAGLRPEPTGGDFIIRAEEEVWGFINVAGIRSPGLTSAPAIAYYVAELIERELDVKLIEKKNWNPYRRDFPRIAMLPPEKANELIRRNPLYGKIVCRCNTVSEGEIVEAINRMKFIGVKSPSIDSVKFRTKATTGTCQGAFCRPRIIQILAREYKLPPWKIRLNVPGSEIGIGDVKVLTRGEN

SEQ ID NO: 21554 - protein, 752 aa, Pyrococcus abyssi
MNTMYLRKELLQPRLYQELIYAKCKERNCLIVLPTGLGKTIIAMMIADYRLNKYGGKVLMLAPTKPLVLQHAETFRKFFNLPPEKIVALTGEVSPSERVKAWNRAKVIIATPQTVENDLLTGKINLEDVVLVIFDEAHRAVGNYAYVYIAREYLNQAKNPHVIGLTASPGSSQEKILEVLRNLGIEHIEYRSENSPDVKPYVQGIKFEWIKVELPGLYKEVRKLLRDMLRDSLKPLAEAGLIESASADLPKKEILRAGQIINEETAKGNHDLRKLLLFHAMALKLHHAIELLETQGLSALRVYLKKLYEEAKTGSTRASKELFLDRRMKKALALLIQAKELGIDHPKMEVLKELVKEQLSKKENSKIIVFTNYRETARKVVEELTKEGIKAKRFVGQATKENDRGMSQREQKLILDSFARGEFNVLVATSVGEEGLDVPEVDLVVFYEPVPSAIRSVQRRGRTGRQKPGRVVILIAQGTRDEAYYWSSKHKERQMRETIRMVSQAIKREKQLSLESYVKKDTEKEMEREEKEERKGEREGVKVVVDSRELRSEVVKRLKTLGVKIEVKTLDVGDYIISDEVAIERKSANDFIQSIIDGRLFDQVKRLKDSYPRPVVIVEGQLYGIRNVHPNAIRGAIASIVIDFGVPIIFSSNPEETANYIFFMARREQEERRREVRVRGEKKALTLAERQRLIVESLPHVSATLAKRLLKHFGSVERVFTASVPELMKVEGIGEKIAREIRRVITSPYTED

SEQ ID NO: 21555 - protein, 580 aa, Pyrococcus abyssi
MADKSSLSLLKRFIKEALSERRTLAIVVVSIVGSALANLASPYILRVAIDHYIIPGRYKELGFIAMLYLLSLVAQWFFTTLQTFYTEVFGQKVLRNLRSQLHEKILQSNLDFFKTKSTGDLVSRIINDTNVVNDVLVSGLLGGLGSILSLAGIIVAMLLLDVKLTLVTLTSVPLMVIIALYFGGKMRRAYRETRQKIAKISSVVEESVAGIETIRAFGKEKDVEKEFSKVSTETIKAYLRVAIYMGIFWPLMNIASLLSVIVVIAYGGYLAYKGAVSIGVVVAFIQYAQRFRGPINNVVSMYDSLQSALAALERIYEILDDENVEDYEGISVEKLKGEIEFRNVWFEYEKGRPVLKDVNLYIPPASKVAIVGKTGAGKTTIANLIMRFYDPTKGEILYDGIDGKKISRKSLRKRIGYVPQETYLFPGTIMENILMANPEAKEEDVIRVCKELGIHDFIMKLPKGYETSAGEAGKLLSVGERQLISLARAMLKDPDIVILDEALSSVDPKTEQLVQNAMIKLMEGRTSIIIAHRLSITRFADKVIVVDDGRIVEEGSPGELLSRKGYFYKLYTSQMQEVPG

SEQ ID NO: 21556 - protein, 579 aa, Pyrococcus abyssi
MRKSINQLIRLLSYLRGHAVHFLIGLFLIILMSYTNSIVPVLIRNAIDKGVSTGAYKVAIRYGLLILLVGVLNGVFSLAGRYLLVKAAQYAVYYLRMDAFRAIQRHEMEFFDKTFSGQLISRITNDTERITRFLSFRVRMLLYSIFLIIISLYYMVRMNITLTMVALITIAIVVGLNTTYAMKVRPIYDKIRHQTGVIASIATGTIAGIKTIKSLSVEENVQTKFSQENEELYSLNVKAMKITALYGNAPFLVLGLAMSTMFYYGGKAIIQNTLTVGELVAFLTYMLTMMWPLRALGFTIGDIQRSLAAASRLFDVIDSAPKSIDPPDAVEISNPRGEIEFRDVWLTYHTGRTVLKGVSFKVKPGEKVLITGPPGSGKSSILKLIARFYKPTKGEVLIDGVNVAKIKTENLRKIVAYVPQEPFIFNRSIRENIALAKPNATQEEVERAAKIAKIHDFIASLPKGYDTVVGEKGITLSGGQRQRIALARAMLMNPKIVLLDDPVSNLDAETEKKLVEDLKEILQDKTALIVSQRLSLVKLVDRVIVMKDGKIVEDGKPEELIKKGGIFSEMMKAGGVYGG

SEQ ID NO: 21557 - protein, 307 aa, Pyrococcus abyssi
MRNKLIVVTGGAGFIGSHIAEALKEENDVVVIDNLYSGKPENVPEGVKFIEADVRDYESIAEIVSSADYVFHEAAQISVEESVKDPVFTEEVNVIGTINILRALSEGNGKLIFASSAAVYGEPTSLPIREDHPLNPISPYGVSKVSGEHYCKVFYQLYGVPTVILRYFNVYGPRQSSAYAGVISIFMERALRGEPLVIFGDGKQSRDFVYVKDVVEANILVAEKRRAEGETFNVGTGRETTIIELAMKIIELSSTSSQILFSKPRPGDIRRSVADIEKIKKLGFKPRYSLEEGLLETWKWFKSRTLG

SEQ ID NO: 21558 - protein, 1177 aa, Pyrococcus abyssi
MPYIEKLELKGFKSYGNRKVVIPFSKGFTAIVGANGSGKSNIGDAILFVLGGLSAKAMRASRISDLIFAGSKSEPPAKYAEVAIYFNNEDRGFPIDEDEVVIKRRVYPDGRSSYWLNGRRATRSEILDVLSAAMISPEGYNIILQGDITKFIKMSPLERRLILDDISGIAEYDAKKEKALQELKQAEENLARVDLLIREVKKQLDKLEKERNDALRYLDLKERLERARVELILGEIKKVESEIKGNDERIEKIEEEIKEIEEKLEEIAKEIVRKERELKEVEELIEKESSEEALKITREIGEVNSKINLAKRNIEVAKKELDEAQIRLIKAKDELKKVLSEIEKSKGAIARWGKRKEALLNKIKELEEERNKLVVKLGEIDRTFAVAREEFDNVVKELENARKSLYENEADIKRLEAEKERLSSRITILKAKLPGIREEVEKLREKLEEKKAELSNVENKISSISQRRRKVEEELEKKTSELQKVSSELESLERELIKAEAQSEVRVNRAVEELKRSGISGIYGTLLELIRVKDEMYSIAVEVALGNRADNVVVENEIVAEKAIEFLKRNKLGRLTFLPLNKIKPKKVNDSVGTPVIDVIEYDPRIENAIRFALGDTVIVSSMEEAREHIGKVRMVTLEGELYERSGAITGGHYKPRGLPVDTRELKERVEKLKLRKEALEAEINSLKVELRGLENQGFELRIKMSEIEKEITLLTRDIEKLLSEERIIKSEIEDSQKGIEEIDRIIHEKKGEIAKLRGKIERLERKRDKLKKALENPEAREVTEKIREVEGEIGKLREELSRVESRLESLNSRLNEELIPRKASLEEEIEGLVNKINALKANIAENEEVLKGLKGKLEELKAKEESVHSKISEYRRKREELEKEIRELRKEKEELSKRMQEFRIEANTLRVRNTQLRSILNEKNSQLRHFPKEVIRSIREIPLDLEKLKREIEEMEEEIRSLEPVNMKAIEDFEVVERRYLELKSKREKLEAEKESIIEFINEIEKEKKNVFMRTFEAIAKNFSELFAKLSPGGSARLILENPEDPFSGGLEIEAKPAGKDVKRIEAMSGGEKALTALAFIFAIQKFKPAPFYLFDEIDAHLDDANVKRVADLIKESSKESQFIVITLRDVMMANAEKIIGVSMRDGVSKVVSLSLEKAMRILEDIRKREALSSEG

SEQ ID NO: 21559 - protein, 411 aa, Pyrococcus abyssi
MKTLNVEDIIEKVANGEIKLHQVEKYVNGDKRLATEIRRKALERKLGISLKHIGHYSIDPNELIGRNIENMIGVVQIPMGVAGPLKINGEYAKGEFYIPLATTEGALVASVNRGCSALTEAGGVVTTILDDKMTRAPLIRCPNARRAREVAEWVKENLNYLQEKAVAKVTRHGKLRDVKPFIVGNNLYLRFEFETGDAMGMNMVTIASEEIMKVIEEEFPDVRYLALSGNLCVDKKPNAVNFILGRGKTVVAEAIVPREIVEKKLKTTPELIAEVNYFKNLVGSAQAGSYGFNAHFGNIVGAIFLATGQDEAQITEGSHGITIAEVTPEGDLYISITMPSLEIGTVGGGTRVPTQREALSIMGVAGGGDPPGVNAKKFAEIVAGAVLAGELSLLAAIAAKHLARAHKMLGR

SEQ ID NO: 21560 - protein, 259 aa, Pyrococcus abyssi
MRILITAASRGIGFNIAKELLKKGHEVSIASSNPDNIRKAYEKLKEIGEIHYFKADLKSKDDIKLLIKEAWEAMGAIDALVWNAPNVGCEPCMAHEARYIDWLEAALLHIVAPGYITTLLIQAWLEKKMRGVIIYLSSASVLEPMPPLILADTARAGLVQLAKGISRTYGGKGIRAYTVLLGSFDTPGARENLARIAEERGVTMDEIWEREVIDRTPLKRTGRWSELGALIDFLLSENAEYMLGSTIVFDGAMTRGVNL

SEQ ID NO: 21561 - protein, 795 aa, Pyrococcus abyssi
MAEKKEVKLKVASAYQRDVGRGIVRLDRKTMRELGISPGDVVEIIGTKNTAAIAWPAYPEDEGLGIIRMDGTIRKNAGVGLGDEVTVRKAEVREAKKVTLAPTEPIRFGRDFVEWLHERLVGRPVVRGDYIKVGVLGQELTFVVTATQPSGVVQITEFTDFNISEKPVKEVEKRMTTGVTYEDIGGLKDVIEKIREMIELPLKHPELFEKLGIEPPKGVLLYGPPGTGKTLLAKAVANEANAYFIAINGPEIMSKYYGESEERLREVFKEAEENAPAIIFIDEIDAIAPKRSEVTGEVEKRVVAQLLALMDGLKSRGKVIVIGATNRPDAIDPALRRPGRFDREIEVGVPDRQGRKEILQIHTRGMPIEPDFRKDDVLKILEDFKREGKFTKIIDKAIEEVNKSKEEEIPQVLKKIDAELYDEVKTRLIDKLLDELADVTHGFVGADLAALAREAAMAALRRLIREGKIDFEAETIPREVLDELKVTRRDFYEALKMVEPSALREVLIEVPNVHWDDIGGLEDVKQELREAVEWPLKYPEAFKAYGITPPKGILLYGPPGTGKTLLAKAVATESQANFIAVRGPEILSKWVGESEKNIREIFRKARQAAPTVIFIDEIDAIAPRRGTDVNRVTDRIINQLLTEMDGIQENAGVVVIAATNRPDILDPALLRPGRFDRLILVPAPDEKARFEIFKVHTRGMPLADDVDLKELARRTEGYTGADIAAVCREAAMIAMRRALEKGIIKPGMKASEIRRLAKVTMKDFEEALRKIGPSVSKETMEYYRKIQEQFKQARG

SEQ ID NO: 21562 - protein, 293 aa, Pyrococcus abyssi
MRFDVICMGNLNYDIVFLMEKFPGIHEKVNAKGVFTGLGGSAGNTATWLAKLGLKVGFIGAVGNDDFGRLHLEFFREIGVDTSGIKVVNDATGIAVTMVKGEDKRIVKYPGANRWKEVNTEYLKRARHLHLSSNPIELIREAVEKAKELGLTVSFDPGEMEVPRDVEKELDILMMNEDEFKAKYGSLDRIKDVKARIAIATLNGGGALVRDEKGEVHEVRGLSAKAIDTTGGGDAFNAGFLYGFLSGWDVVNSAKLGMLLAYLTVQEVGARSAVRPLDEIKKIAQELKLNLPI

SEQ ID NO: 21563 - protein, 380 aa, Pyrococcus abyssi
MTLVGKLLNAKPGEAVIRKVDLVYAHDGTMPLIIEAFNRIFNEVRTRAYIFFDHVYPAPTVKVANLHREIREFAKIHGIPVVEGKGISHQLVVELGLAEEAKIIVGGDSHTPTLGALGVFAVGMGATDVAIALGLGKIWLKVPESIAVLLDGSPREYIMASDVMIHLITSLKDREMSYNAIEFFNVPFSFDERLTLTNFSVEANAKTAIIGEEYEGGGYSDEITIELDSLPPMVAKPFSPANGVSVEDVEGTKIDQVFIGSCTNGRFEQIKRAAEILDGEQVNVRTLVAPASINVYRRMIEEGLVRILIDAGVVILPPGCGPCLGRHMGVAGDNEVILSTTNRNFRGRMGSPKAEIYLASPVTAAVSALYGEITNPEGEL

SEQ ID NO: 21564 - protein, 346 aa, Pyrococcus abyssi
MYRVAVIKGDGIGPEVVDSAIRVVNSVTDRIRFYEFEGGFEVFKRIGSPISEDDLKEIRKMDAILFGATTTPFNVPGYRSLIVTLRKELDLYANLRIIPDLSNGKEIVIVRENTEGLYARDGIGFSDRAIDFRIITLEGARRIAKFAINLAKERNSFITFVHKANVLKGDRFFREIVLEIAEREGVEVREAIIDSFMIKLVKNPWDHGVILTENMFGDIISDLATIHAGSIGIVPSGNYGDEIALFEPIHGSAPDIAGKGIANPIGAILSAAMMLDYLGLNGKVVWEATRRYVRYGNLTPDMGGTATTSEVTKGIISEIYSFDPFDIDEIWVEEIRLGRIPLTLWR

SEQ ID NO: 21565 - protein, 330 aa, Pyrococcus abyssi
MIKAAIVGGSGYIGGELIRLLSMHPEVEITTITSRKFAGKKVHKVHPNLRGLNLRFTDKYEFDADVIFLAVPHGTSMRIIGEFLGSAKIIDLSADFRVSKDLYEKYYGSHEKPELIDKFVYGLPELHRKEIKRAELVANPGCNATAVILALYPFRDVTSEAIVDLKVSSSAGGRRENVASIHPERSHVVRVYKPFHHRHEAEVLQETGVKAMFTVHSVDIVRGLLATTYFKFEGSEKDLLKRLLMYRGEPFIRLVTDKGGLQRYPDPKYVIGSNFVDIGFSYDSENSRAIVFSALDNLIKGGAGQAVQNMNIMFGFDETLGLNYYPLYPG

SEQ ID NO: 21566 - protein, 248 aa, Pyrococcus abyssi
MIQMRVIKVGGSVVPMLDKILDTSSLHGNSIIVHGGSRYVDEMARKLGVKVERLVSPSGVMFRRTTRRVLDVYVAALMRANRELVSFLRERGIDAIGVSGLDGVVLAKRKKLVKAVVNGKVIAIRDDYSGVIKSINVTLLKNYLKVGIPVIASIAYDPEENVPLNVDGDKVAYHVAIAMKAKELRFLSDTAFLIDGNVVERIPLEDFDEYLRYAGGGMKKKLMMARKALESGVKKVVIEGLNGRTVIS

SEQ ID NO: 21567 - protein, 364 aa, Pyrococcus abyssi
MSLYRKRLKIVRGEGIYVWDSEGKRYLDLIAGIGVAILGHNHPKWVEEVGNQLNKLVVAGPMFEHEEKEEMLEELSRWVNFEYVYMGNSGTEAVEAALKFARLYTGRKEIIAMTNAFHGRTMGALSATWKSKYKKDFEPLVPGFKHIPFNDVEAAKEAITRTTAAVIFEPIQGESGIIPAKEEFVKTLRDLTEDVGALLIADEVQSGLRTGKFLAVEHYKVEPDIVTLGKGIGNGVPVSLTLTNFDVERGKHGSTFGGNPLACKAVAVTLRILRKERLVEKASEKFIKVKGKDVVTTRGRGLMIGIVLKKPVGRYVEELQNEGYLVHTSGQRVIRLLPPLIISKEKMMEVKSAIEGVINGDTEG

SEQ ID NO: 21568 - protein, 265 aa, Pyrococcus abyssi
MRMMKYSKEYKDKTIIKVGDVKIGEGFTIMAGPCAIESEDQIMKTAEFLAELGIKILRGGAFKPRTSPYSFQGYGEKALKWMRKAADEYGLVTVTEVMDTRHVELVSKYADILQIGARNSQNFELLKEVGRQEKPVLLKRGMGNTIQELLYSAEYIMSQGNENVILCERGIRTFETSTRFTLDISAVPVVKELSHLPIVVDPSHPAGRRSLVIPLAKAAYAVGADGVLVEVHPDPENALSDSKQQLTFEDFKILLDELRKLGWRG

SEQ ID NO: 21569 - protein, 338 aa, Pyrococcus abyssi
MEGIAHMENIIFSPLSSLPSIVEELNPYKIAVLTNDMLKSLWLDKIIELLGGDVFPIVIPDGEEYKTIETAIKIWDELVSFGFTRKSLLIGLGGGVITDIAGFVASTYMRGTLLGFIPTTLLAQVDAAIGGKTGVNFHGKNMIGTFYLPNFVLISTETLSTLPRIELLNGMAEVIKYAILDKNVYRLLQDVKNVEEIRNREDIIRESVNVKVRVVEEDLKESGKRRILNLGHTVGHAIEKLSGYKIKHGFAVSVGLIAAAKLGEKLYNFDSGKVIELVERFNLPTKLPYPPKDIIEAMKLDKKAWYGKIVFVIPVEIGRISIEDVPEELLLQVLGEIR

SEQ ID NO: 21570 - protein, 215 aa, Pyrococcus abyssi
MIATVILADSIKEAIEKIKSSSSDLYELRADSLKDYSKLELLEPYSEKLVVTIRSKDEGGFKELSDEKRLELYSKFLEIKPRYVDVEFRSKIKDEVMEIAKRVGSRVILSYHNFRETPPFGVLYNLLEDMESEGADIVKIVTHASSPKDNIRIIRLYEFADNLIAFCMGSKGKISRIFSSMYSPITYVALDKKAAPGQLTLEELRVILKILGEGR

SEQ ID NO: 21571 - protein, 264 aa, Pyrococcus abyssi
MKVYGLIGKPVSHSLSPVMHNALFRKYGIDAVYVTFEVEELGKAIDGVRALGISGLNVTMPYKEVVTKFLDELSEDAREINSVNTIINLEGSLIGYTTDGVGARKALERFTEIEGRNVLILGAGGAGKAIAYELSKIANIVVLNRTPSKAKSLEKFGVKGGSLDELPNYVGWADVLINATSVGMGTNESLVPRRLLRRELIVMDIVYKPLKTRLLRDAESVGCRVIDGLWMLIYQGAESFKLWTGIYPDVELMRRVSLERLGKG

SEQ ID NO: 21572 - protein, 410 aa, Pyrococcus abyssi
MFGPVSVEMIIERVDEVRGKVKAPPSKSYTHRAYFLSLLADSPSKVMNPLISEDTIASLDAISKFGAQVNGNKIIPPQELTPGKIDARESGTTARISLAVASLARGTSVITGKGRLVERPFKPLVDALRSLKVKISGEKLPIAVEGGNPVGEYVKVDCSLSSQFGTAMLILASKIGLTVEMLNPVSRPYIEVTLKVMESFGIEFERNGFKVKVHPGIRGSKFHVPGDYSSASFFLAAGALYGKVKVSNLVKDDPQADARIIDILEEFGADVKVGRKYVVVERNEMKPINVDCSNFPDLFPILAVLASYAEGKSVITGRQLRLKESDRVKAVAVNLRKAGIKVKELPNGLEIVGGKPRGFTVESFNDHRIVMAMAILGLGAEGKTIIKDPHVVSKSYPSFFLDLRRVLNEG

SEQ ID NO: 21573 - protein, 356 aa, Pyrococcus abyssi
MRGRVLSFTLFGESHGKGVGVVITGIPPGIKVSHEELVKELERRKGIPGLSTARSEPDNPIILSGIFRGYTTGTPIAVLFENKDVDSSYYEDIKDKPRPGHADYPARIKYFGYNDYRGGGHFSGRLTVGIVTAGYFAKKILEKYGIRIRAYIKRIGRVEAKQLTLEEILSSENPFCPDEEAFEKMVEEIELARREGDSVGGIVEVVAVNVPPGLGGPYEEDIEADLASAFFRIPAVKGVEFGLGFKVAEKRGSEVNDPYVIRDGKVVTKTNNHGGVLGGITTGMPIIARIAFKPTPSIYLPQRTVDLREMKEVEIKLRGRFDPSIVPRALPVVEGVMAFVLADHLLFRRVWELKSS

SEQ ID NO: 21574 - protein, 208 aa, Pyrococcus abyssi
MFVKVCGVKSLEELEIVEKYADATGVVVNSKSKRNVPLDAAREIISSAKIPVFLVSTMKNREDWEVAIERTEARYIQIHSDVEPSLLPYLKDEYGVEIMKAFRVPQESENPERDAQMLLKKIRKYEADLILLDTGAGSGKMHDLRVTRIVAEEIPVVVAGGLKPENVEMVIKLVKPFGVDVSSGVERNGKKDEELVREFVRRAKNVVR

SEQ ID NO: 21575 - protein, 411 aa, Pyrococcus abyssi
MGEKRKSRQAEVNIGMVGHVDHGKTTLTKALTGVWTDTHSEELRRGITIKIGFADAEIRRCPNCGRYSTSPVCPYCGHETEFVRRVSFIDAPGHEALMTTMLAGASLMDGAILVIAANEPCPRPQTREHLMALQIIGQKNIIIAQNKIELVDKEKALENYRQIKEFIEGTVAENAPIIPISALHGANIDVLVKAIEDFIPTPKRDPNKPPKMLVLRSFDVNKPGTPPEKLVGGVLGGSIVQGKLKVGDEIEIRPGVPYEEHGRIKYEPITTEIVSLQAGGQFVEEAYPGGLVGVGTKLDPYLTKGDLMAGNVVGKPGKLPPVWDSLRLEVHLLERVVGTEQELKVEPIKRKEVLLLNVGTARTMGLVTGLGKDEIEVKLQIPVCAEPGDRVAISRQIGSRWRLIGYGIIKE

SEQ ID NO: 21576 - protein, 361 aa, Pyrococcus abyssi
MQAVLLAGGMGTRLLPLTIYRPKPMIPFFNKPLMEYMVNNLVEVGVDEIIVLVGYLKEKIIEHFGDGKEFGVEIKYSNGENVKFGTAGALKRAEKFIEGTFIVASSDVLTNLDFKSLLEFHAKKGGIATMALTKVEDPSPYGVAVLDDEGKILYFKEKPRREEAPSNLVNAGIYVFEPEILDLIPKGKPFDFSLNLFPKMLEEGIPIYGFPFDEYWNDVGRPSTYLQATEDVFLGKLKLPQISVGRLKGNVERGGSLFTGSRCILRNPKVSGFAVLGDNVEIGRDVKIERSVIFSNVTIEDGAEIREAIIGENVYIGKGVTIEPGSVIGDNSIIEEHSRIGANVKIWADSRVGRESIILPD

SEQ ID NO: 21577 - protein, 205 aa, Pyrococcus abyssi [sequence omitted]

SEQ ID NO: 21578 - protein, 571 aa, Pyrococcus abyssi
MEVERIALKYALINAIEHGGKANPKAVIGKVLGENPELRSKAREIVPIINKVVEEVNSLSLDEQKAKLMEIYPEYFEKKEEKKEEKKGLPPLPKAEKGKVVTRFAPNPDGAFHLGNARAAILSYEYAKMYGGKFILRFDDTDPKVKRPEPIFYEMIIEDLEWLGIKPDEIVYASDRLELYYKYAEELIKMGKAYVCTCKPEKFRELRDKGIPCPHRDEPVEVQLERWRKMLNGEYKEGEAVVRIKTDLNHPNPAVRDWPALRIVDNPNHPRAGNKYRVWPLYNFASAIDDHELGVTHIFRGQEHAENETRQRYIYEYFGWEYPVTVHHGRLSIEGVILSKSKTRKGIEEGKYLGWDDPRLGTIRALRRRGILPEAIKELIIEVGLKKSDATVSWDNLAAINRKLVDPIANRYFFVADPVPMEVEGAPEFIAKIPLHPDHPERGTRELRFTPGKPIYVSKDDLDLLKPGSFVRLKDLFNVEIVEVGEKIKAKFHSFEYEIARKNKWRMIHWVPEGRPCEVIIPEGDELIVRKGLLEKDANVKAGEIVQFERFGFVRIDKIEGEKVVAIYAHK

SEQ ID NO: 21579 - protein, 235 aa, Pyrococcus abyssi
MGFLNYMRVLLTGASGGIGQELAKELIRRGYEVIGVGRNEKALKELGIKYIVVDLSTYEGISKVRESLKGEIDVLINNAGFGLVKPLLEHSWEELEGMFKVNAIAPVILTKELLDFIPEGGKVVFIISGASHVYTLDLPGYGASKVALHYMAKVLEEELKERGIKVLRVYPKQVATDFWKGAKLRGALSPEYVARKIVNAIESDKRELFIPWYLKLAKFFEIKYRFSFEKEFKPQ

SEQ ID NO: 21580 - protein, 387 aa, Pyrococcus abyssi
MPTNVTAEYLAAEEEYRNAKTIPEKIRALEKMYALVPKHKGTEKLRLQIKRKLAELRKELEKQRQQRKGGGYSLAVKKEGAAQIVLVGLPNVGKSELLRALTGVDVESADYPFTTTEPIPAMMNYKDVQIQLVEVPGLIEGAALGKGMGPQLLAVIRNADAIAIVIDLSEDPIKQMKILLREFERAGIKVNKRRPRIEIRRTPSGGIVINGIENIKGDINEVMKMLREEKIHSAEITVREPVTLEDFADALDESLVWKKAIIIANKGDAPGSKDNYEKLVKAYGERFKIIPVSAKKRINLDAVKEALYDVAEIIRVFTKSPGEEPAYPPIALKRGSTVLDVAERIHKDLVKNFRYARVWGKSVKFPGQRVGPDHVLEDGDIVEIHAR

SEQ ID NO: 21581 - protein, 224 aa, Pyrococcus abyssi
MKVAGADEAGRGPVIGPLVIVAAVVEEDKIRSLTKLGVKDSKQLTPAQREKLFDEIVKVLDDYSVVIVSPQDIDGRKGSMNELEVENFVKALNSLKVKPEVIYIDSADVKAERFAENIRSRLAYEAKVVAEHKADAKYEIVSAASILAKVIRDREIEKLKAEYGDFGSGYPSDPRTKKWLEEWYSKHGNFPPIVRRTWDTAKKIEEKFKRAQLTLDNFLKRFRN

SEQ ID NO: 21582 - protein, 342 aa, Pyrococcus abyssi
MSVIQNIIGRVVVLRGGMYSVEVDVATDEGFGRFASPIEENPMLHIAEARRAVSEVDEIIGPELIGFDAVEQELIDSYLWEIDGTEDFSHIGANTALAVSIAIARAAANSKDMSLYSYIGGTFATELPVPIIQFASDENFEYYILVRDLLEVTDIVDAVNKIISEVGNKVSIEELSKASESVGMELGLEVALGIKMKRELEIEDVLNIVEDNNVAYIKPLGPPELFLELIAGTHGVFIDGEYLFRANNILDRRYYNALSIKPINLGTLTDLYNFVNDVKSEKITPILAEAKYEPADDTFPHLALGLRCPAMLISWNSVEKINELNRIAEELGERGRIITFEE

SEQ ID NO: 21583 - protein, 335 aa, Pyrococcus abyssi
MPRLVLASAPAKIILFGEHSVVYGKPAIASAIDLRTYVRAEFNDSGNIKIEAHDIKTPGLIVSFSEDKIYFETDYGKAAEVLSYVRHAIELVLEEADKRTGVSVSITSQIPVGAGLGSSAAVAVATIGAVSKLLDLELSKEEIAKMGHKVELLVQGASSGIDPTVSAIGGFLYYKQGEFEHLPFVELPIVVGYTGSSGSTKELVAMVRRRYEEMPELIEPILESMGKLVDKAKEVIISKLDEEEKFLKLGELMNINHGLLDALGVSTKKLSELVYAARTAGAIGAKLTGAGGGGCMYALAPGKQREVATAIKIAGGTPMITRISKEGLRIEEVRE

SEQ ID NO: 21584 - protein, 559 aa, Pyrococcus abyssi
MRYIELAQLYQKLEKTTMKLIKTRLVADFLKKVPEDHLEFIPYLILGDVFPEWDERELGVGEKLLIKAVSMATGIDSKEIENSVKDTGDLGESIALAVKKRKQKSFFSQPLTIKRVYQTLVKVAETTGEGSQDKKMKYLANLFMDAEPIEAKYIARTVLGTMRTGVAEGLLRDAISLAFNVKVELVERAYMLTSDFGFVAKIAKTEGNDGLAKVTIQIGKPIKPMLAQQAANIKEALLEMGGEAEFEIKYDGARVQVHKDGEKVTIYSRRLENVTRAIPEIVEAIKEALKPTKAIVEGELVAIGEDGRPLPFQYVLRRFRRKYNIEEMMEKIPLELNLFDVLYVDGVSLIDTKFMERRKKLEEIVETNGKVKIAENLITKNVEEAEQFYKRALEMGHEGLMAKRLDAVYEPGNRGKKWLKIKPTMENLDLVIIGAEWGEGRRAHLLGSFILGAYDPETGEFLEVGKVGSGFTDDDLVEFTKMLKPLIIKEEGKRVWIQPKVVIEVTYQEIQKSPKYRSGFALRFPRYVALREDKGPEDADTIERIAQLYELQERMKGKV

SEQ ID NO: 21585 - protein, 418 aa, Pyrococcus abyssi
MRIAVIGLGYIGLPTAIMFASSGHDVIGYDIRRDVVEKVNRGIAHIVEPEIGERLREVVSKGKLRATSDYNDLKGADAFIICVQTPLSNGVPDLTYLESAIKTIAKVIEKEALVVIESTVPPGTTERMAKLLEELTGLKEGEDFYVAHAPERVMPGRIFKELVYNSRIIGGVSEKASILAEKLYRSFVKGRIFLTTATTAEMVKLMENTFRDVNIALANEFAFLAHKYGVNVYEAIELANTHPRVKIHRPGIGVGGHCLPKDPYLLLANVDEDLGLIRKARKINESMPRFAAKLLFEALGEANVDPGDAVVLVLGLAYKGDTDDVRNSPALEFIKIIEKDVKEVRTYDPYVNGTHTILEEAVKGVDAIIIATDHSMFREIEWDKLGNLMRNKIIIDGRNLVKEPPKGFIFKGIGRGDV

SEQ ID NO: 21586 - protein, 420 aa, Pyrococcus abyssi
MVEQDPFEIAVKQLERAAQYMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETIARRKTPAFGIITGKPLSIGGSLGRNEATARGASYTIREAAKVLGWDDLKGKTIAIQGYGNAGYYLAKIMSEDYGMKVVAVSDSKGGIYNPDGLNADEVLKWKREHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDAAYVVAVQRVYQAMLDRGWVKH

SEQ ID NO: 21587 - protein, 260 aa, Pyrococcus abyssi
MAFVPPQAGYDRAITVFSPDGRLFQVNYAREAVKRGATAVGVKCKDGVVLAVEKRITSRLIEPESYEKIFQIDDHIAAASSGIIADARVLVNRARLEAQIHRLTYGEPAPLAVIVKKICDLKQMHTQYGGVRPFGAALLMAGVNDKPELYETDPSGAYFAWKAVAIGSGRNTAMAIFEDKYRDDMTLDEAIKLAIFALAKTMEKPSAENIEVAVITVKDKKFRKLSKEEIEKFLGEVMKEVEEEEVKEKEEDYSELDSHY

SEQ ID NO: 21588 - protein, 1117 aa, Pyrococcus abyssi
MRGPTVVEVTPDDLWIVMESYWQEKGLVRQHLDSYNAFIDRGLQEVVDEFGGIKPDIPDFEVKFGKIRVGEPEFQEPHGQRKPLYPMDARIRNLTYSAPLYLEMIPVIRGIEQEPVEVRIGELPIMLKSKVCRLYGLSDDELRQLGEDPKDPGGYFIINGSERVIVSIEDIAPNRTLVEKDERQEKYIAKVFSYRHGYRALVTVERKKDGILYVGIPNVPKPVKFVYVMRALGLERDKDIVDAVGNDPEVQQILFDNLEDASDITTQQEALEYIGKLVAPGQAREYRLKRAEYVIDNNLLPHIGVSPEDRIRKAYYLGMMALKVIELSLGKRDEDDKDHYANKRLRLAGDLLKDLFRVAFSQLVKDIQYQMTKTYQRRGEKYVFGNIHRFIRNSIRPDVLTERIEHALATGAWPGGRTGVSQLLDRTNYVSTLSHLRRVTSPLDREQPHFEARDLHGTHWGRICPTETPEGPNCGLVKNLALMAQITTAVPEEEVKEYLMSLGIVPIEVRRPSPELWRVYLNGVIIGTIEDGKALVERIKKDRRSGKISDIINVAYYEDVREVYVNSDDGRVRRPLIIVENGKPKLTKEHVQAIKEGRLKWSDLVRMGVIEYLDAEEEENAYVAMWPWEVTEEHTHLELMPAAILGLPASLIPYPEHNAAPRNTYGAGMAKQSLGLGWANFRIRVDTRGHLLHYPQIPLVNSRIMKAVGYEDRPAGQNFVVAVLAYHGYNMEDAIIINKASIERGLARSTFFRTYEAEEKKYLGGQTDKFEIPSPTVRGYRGEKYYRHLDEDGLIFPESKVEGKDVLIGRTSPPRFLEERGLGAVSLQERRETSVAVRPSERGVVDKVIITETGDGTKLVKVTVRDLRIPEIGDKFASRHGQKGVIGLIVPQEDMPWTESGIVPDLIVNPHGIPSRMTVGQLLEAIGGKVAALKGRRVDGTAFIGEPEEKLRKELEELGFKHTGREIMYDGITGKRFEADIFVGVIYYQRLHHMVADKIHARSRGPVQVLTKQPTEGRAREGGLRFGEMERDVLVGHGAAMLLIERLLEESDKTEVWVCENCGHIALEDKRRHKVYCPVCGEEERISKVEMSYAFKLLLDELKAMVIRPKLNLTERV

SEQ ID NO: 21589 - protein, 244 aa, Pyrococcus abyssi
MVLVTAVAVSNLEKDYGKVKALRGVSFQIEEGEIFGLIGPNGAGKSTTLKILATLLHPTGGRAEVFGHDVVKEASEVRKLISYLPEEAGAYKRLTGLEYLEFMAKLYAKDSRKAEKMLKLGIELSGLGERLNDKVSTYSKGMVRRLLLARALMVKPKLAILDEPTSGLDIMNAFEIRRTIKEFSKEGVTFLISSHNMLEVEYLCDRVALIHKGRILEVGTPRELKERYNAENLEEVFMEAVKNV

SEQ ID NO: 21590 - protein, 303 aa, Pyrococcus abyssi
MVRGMLEVNLFGIKFKNPLILASGVVDMTPELLRRAHREGAGGVVTKSIGMEPRKGYENPTIVELPYGLINAMGLPNPGWEAFLEEFRKEKFDFPVIVSIFGGTPEEFAFLAEKLGEVADAFELNLSCPHAKGYGMEIGQKPENVYEVVKAVKDVTDKPVIAKLTPNVSDIRELGLAAEKAGADGVSAINTVKAIAIDIYAKRPILSNKFGGYSGPGVKPIALRAVYDLASSLDIPVIGIGGITTWQDAVEFLLAGASALQIGTAVYLRGFSVFREIAEGISRYLKEEGYSSVKEIIGLALKV

SEQ ID NO: 21591 - protein, 328 aa, Pyrococcus abyssi
MYAIEVENLVKKYGDFTAVKGISFKVKKGEIFAFLGPNGAGKTTTVHVLTTLLKPTSGKAIVAGHDVVKEPQEVRKKIGIVFQDPSLDRELTAYENMYIHGMIYGLKGRELKEKIEELLKFVELWRFKDRPVKYFSGGMQRRLEIARALIHEPEILFLDEPTIGLDPQTRAHIWEYIRTMKEEHEMTIFLTTHYMDEAEQLADRIAIIDHGKIIAEGTSEELKKLVGNDIIYLKLESPKEELKCLKADFIRGCKLLPDGRVRIDVENATEALPKLFELAQKNNVKILEVTYHRPTLNDVFLHLTGREIRDEEGGESFARVVMRARMRR

SEQ ID NO: 21592 - protein, 431 aa, Pyrococcus abyssi
MKAIDVIERYSKIIAPANRMHYFPLVPVRAENAKIWDIEGKEYIDFLSNAAVQNVGHNNPRVVKAIKEQVEKLTHASYIYSYPVEPLLLAEKLAEIAPVDDPKISFGLTGADANDGAIKYARAYTKRQAILSYMKSFYGSTYGAMSLTGLDFQVRAMVGELSEIHYIPYPNCYRCPFGKEPGSCKMECVEYLKEKFEGEVYAEGVAALFAEPIQGDSGIVVPPKDYFRKVVKILREHGILFVVDEVQSGMGRTGKWFAIEHFGVRPDIITVGKSLGGGLPISATIGRREIIDSLPPLSHAFTLSGNPTASRAALAVIEEIEEKNLLRRAEKLGNHAMKRLKKMMDEHELIGDVRGIGLMIGVELVKDRETKERAIEETQKVIERAFELGLIVTHFNGNVLRIEPPLTIEEETLDEGLDILERAISEVEEEK

SEQ ID NO: 21593 - protein, 428 aa, Pyrococcus abyssi
MPKEKPHVNIVFIGHVDHGKSTTIGRLLYDTGNIPETIIKKFEEMGEKGKSFKFAWVMDRLKEERERGITIDVAHTKFETPHRYITIIDAPGHRDFVKNMITGASQADAAVLVVAATDGVMPQTKEHAFLARTLGIKHIIVTINKMDMVNYDQKVFEKVKAQVEKLLRTLGYKDFPVIPTSAWNGDNIVKKSDKMPWYNGPTLIEALDQIPEPEKPVDKPLRIPIQDVYSIKGVGTVPVGRVETGKLKVGDVVIFEPASTIFHKPIQGEVKSIEMHHEPLQEALPGDNIGFNVRGVSKNDIKRGDVAGHPDKPPTVVRTKDTFKAQIIVLNHPTAITVGYSPVLHAHTAQVPVRFEQLLAKIDPRTGNITEENPQFIKTGDSAIVVLRPMKPVVLEPVKELPQLGRFAIRDMGMTIAAGMVISIQKGE

SEQ ID NO: 21594 - protein, 300 aa, Pyrococcus abyssi
MTKQRVCPVCGSTEFIYDPERGEIVCARCGYVIEENIVDMGPEWRAFDASQREKRSRTGAPESILLHDKGLSTDIGIDRSLTGLMREKMYRLRKWQSRLRVSDAAERNLAFALSELDRITAQLKLPKHVEEEAARLYREAVRKGLIRGRSIESVIAACVYAACRLLKVPRTLDEISDIARVEKKEIGRSYRFIARNLNLTPKKLFVKPTDYVNKFADELGLSEKVRRRAIEILEEAYKRGLTSGKSPAGLVAAALYIASLLEGEKRTQREVAEVARVTEVTVRNRYKELVEKLGIKVPVT

SEQ ID NO: 21595 - protein, 119 aa, Pyrococcus abyssi
MMKLKTLPPTLRDKNRYIAFEIISDDEFTKDEVKSLIWEASLRVLGELGTALAKPWFIKYDPKTKTGIVRCDREYVEHLRFALMLATDFNGKRLIIRTLGVSGTIKRLKKKFLSQYGWK

SEQ ID NO: 21596 - protein, 346 aa, Pyrococcus abyssi
MHLMEFPREVILGKNLVPEVNNVIKRLKLESPGLVVYGPVTKKIAGESVKKAIRDEFDVYSITVKKAHIGEVEKVEAKIRDYNIKWAIAVGGGSIIDVTKLASYRSGIPFISFPTTASHDGIASANASIRGIEAKTSIKARPPIAVIADIEVIKTAPRRYLAAGVGDVISNITAVRDWKLAHKLKGEYFSEYAAALSLMSAKMVIRDAEIIRLGNDEGVRKVIKALISSGVAMSIAGSSRPASGAEHLFSHALDLLLDKPALHGEQTGIGTIIMAYLHGINWRKIKETLKTVGAPTSAYELGIDPEIIIEALTIAHKIRPERYTILGKEGLTREAAEKAAKITGVI

SEQ ID NO: 21597 - protein, 305 aa, Pyrococcus abyssi
MVLVMICSIGELLVDVIATEEGDLKDVRLFEKHPGGAPANVAVGIARLGFDSCLVSKVGDDPFGEFLVESLRRENVKTDGIVKDEEKHTGIVFVQLTGVSPSFILYDGVAYFNLRREDINWELINSSRIVHFGSVILARSPSRETVLDVIKRVKTIVSFDVNLRLDLWKNRGEDMLRTIEEAIKLADIVKASEEEVDYLEDNGIEVEGKLITAITMGSKGAKLNGIQVPGYKVNPVDTTGAGDAFTAALLVGIMKVREITNENLEKIGKFANLVAALSTLKRGAWSVPKVEELLKYKEAREILRL

SEQ ID NO: 21598 - protein, 454 aa, Pyrococcus abyssi
MELKPNVKEIPGPKARKVIEEHHKYMATTTNDPNEYFLVIEKAEGVYWIDVDGNVILDFSSGIGVMNVGLRNPKVIEAIKKQLDLVLHAAGTDYYNPYQVELAKKLIEIAPGDMERKVFLSNSGTEANEAALKIAKWSTNRKMFIAFIGAFHGRTHGTMSLTASKPVHRSRMFPTMPGVEHVPYPNPYRNPWGIDGYENPDELINRVIEYIEDYLFEHYVPAEEVAGIFFEPIQGEGGYVVPPKNFFKELKKLADKHGILLIDDEVQMGMGRTGRMWAIEHFDVVPDIITVAKALGGGIPIGATIFRADLDFGVSGVHSNTFGGNAVAAAAALAVIEELQNGLIENAQKLEPLFRERLEEMKEKYEIIGDVRGLGLAWGVEFVKDRKTKEYATKERNEIVVEALKRGLALLGCGKSAIRLIPPLIISEEEAKIGLDIFEEAIKVVSERHGYKIH

SEQ ID NO: 21599 - protein, 343 aa, Pyrococcus abyssi
MGVPIGELIPRKEIELENLYGKKIAIDALNAIYQFLSTIRQRDGTPLMDSKGRITSHLSGLFYRTINLMEAGIKPVYVFDGKPPAFKKKELEKRREAREEAEIKWKEALAKGDIEEARKYAQRATKVNEMLIEDAKKLLQLMGIPIVQAPSEGEAQAAYMAGKGDVYASASQDYDSLLFGTPRLVRNLTITGKRKMPGKDIYVEIKPELIVLEEVLKELKITREKLIELAILVGTDYNPGGIKGIGPKKALEIVKYSKDPLAKFQRQSDVDLYAIKEFFLNPPTTDDYSLKWKEPDEEGIIRFLCDEHDFSEERVKNGLERLKKAIKAGKQSTLESWFIKKKP

SEQ ID NO: 21600 - protein, 207 aa, Pyrococcus abyssi
MLQLTEKFKGTTTVGIVCSDGVVLAADRRASLGNIVYAKNVTKIHKIDEHLAIAGAGDVGDILNLVRLLRAEAKLYYAQSGKRMSVKALATLLANMLNGARMLPYLAWFLVGGFDEKPRLYSVDMMGGITEDKYVAAGSGMEFAYSVLDSEYREDLKVREGIKIAVEAINSAIKRDVFSGDGIMVVTITEEGYRELSNSRLKAILRQ

SEQ ID NO: 21601 - protein, 389 aa, Pyrococcus abyssi
MAMSDRLDLVNPSEIRKLFDIAAGMKDVISLGIGEPDFDTPQHIKEYAKEALDMGLTHYGPNIGLPELREAIAEKLKKQNNIEADPNKEIMVLVGANQAFLMGLSAFLKDGEEVLIPTPAFVSYAPAVILAGGKPVEVPTYEENEFRLNVDELKKYVTEKTKALIINSPCNPTGSVLKKKDLEEIADFAVEHDLIVISDEVYEHFIYDDVKHYSIASLDGMFERTITVNGFSKTFAMTGWRLGFVAAPSWIIEKMVKFQMYNATCPVTFIQYAAAKALRDERSWKAVEEMRKEYDRRRKLVWKRLNEMGLPTVKPKGAFYIFPRIKDTGLTSKEFSELMLMEAKVAVVPGSAFGKAGEGYVRISYATAYEKLEEAMDRMEKVLREKKLT

SEQ ID NO: 21602 - protein, 305 aa, Pyrococcus abyssi
MKVIEIENLTKSYGKFKAVDNLSLEVEKGIIFGFLGPNGAGKTTTILSMLGIIIPDSGSVRLLGYDIFKEPIKAKERLGFLPENATIYEELTAWRNLDFFASFYNIPKQEKEKRIEELLKLVGLWDVRYRKVKSFSKGMKQRLLLAQALINDPELLILDEPTSGLDPQGARLVKDIILEQKKQGKTVFFSSHILSEVEELADKVGIIVKGKLRTVGTLEEIKKQYMELEGYEIKVETKQPFPEIELPDVIRIEKIADNKVLIFAKSDIREILSEELSKRGITVLSLEIEEPSLEDVFLKTIYRRD

SEQ ID NO: 21603 - protein, 637 aa, Pyrococcus abyssi
MFSACMRDCYDTCSIISEFRNGKLIVKGNPEHPITRGFLCPKGALLPRWFHSKDRLKLPLIKEGDEFNETSWDKAISLVAEKLKEMIKEYGSESVLVYKYAGDRGVVNYYFPMRLFHYLNASTIDGGICDRAGQEALKDIYGTAVGVDPEKLKEHKLIVYWGINAFWTNLHGFMFAKRNNLEIWTVDVVRTETAKRSDKFFQVRPDTDVLFALGVAKVMIEENLYDEDFVRENVYGFEEFKNYVIKLSLNYVSQETGVEVEEIREFAREFAEKKGIIHIGYGFQRSLAGGEAVRAIAILPALVGHRFGFIYDMKTIDKSYAEAKFLRTKPELRIPQMELTEAIEDGRVKFLYIYNSNPLASYPNQNRLRKALRKNDIFVVTHDIFLTDTALFSDVVLPANTFFERLDIVDSYYHRYVLLNEPVAKGPGKSNSEVTRLIAKALGIKNPYLYESDEEVIRKVLEANRISFEELKKKGFVKIPEGERKWNTPSGKIEFYSQRAVKRGLSPFPEYKKFKGKYPLRLLSPTYRMTVTSQYHNTHGIIDSNLYMNPKDAAERGIKDGDEVIVFNENGKIKTKIKLTEDVPPGVVLLYKAFWVKLLGWNVNFLTTDKKVEKYGKGSAFHSTWVEVIRCGEPGVK

SEQ ID NO: 21604 - protein, 665 aa, Pyrococcus abyssi
MFIGDRVIRVVCPYCGFGCNLLIDPKTLKVKPYKGEPNRGKLCPKGLHALEFVLSKDRLRYPLKKVGSDFVRIGWDDAIREIASKLREIKERYGPNAIAFIASSKVSNEENYLLQKIARLLGTNNIDNCARLCHEASVHALKMTLGAGVQTNPYSDLENFKAIMIWGYNPAETHPVVMDYILNAKRKGAKIIVIDVRETTTMRLADYKLMINPGTDITLANALMNVIISEGLYDKEFVRSRTVGFSEVKMAVKKYTPEYAEKVTGIEAKLIREVAREFAKAGSGAIMWGMGLTQHVSGVENVIAVIDMALLLGYVGDKGGLYPMRGQNNVQGAAYMGALSEFLPGYVPLTDSTFRKRVASLWGVEDIPTERGLYLTELWDAILEGEVKALYIMGENPAVSEANVLKVRKALQKLELLVVQDLFLTRTARFAHYILPAAAFCEKEGSYMNSERRIQWSFKVCDPPGEAKPDWEILSLLGKELDLPGFPYEKVEDITEEYFKMFPELAGISVEELKNSNGIIIPYKRLHTIRFQTPDGKARLIAVEQIMPWEQPNGEYPLILTTVRVMSHYNTGEMTMRSPSLVKLMSEPVVYISESDAKKYGIKDGDLVKVETRRGSIVLKAKISKVKEGVIVVPFHFDANILTNDALNKAGTPELKYSSARIRKI

SEQ ID NO: 21605 - protein, 398 aa, Pyrococcus abyssi
MVRASKRALSIEYAIRDVVLPARELEKKGIKVIRLNIGDPVKFDFQPPEHMKEAYCKAIKEGHNYYGDSEGLMELREAIVEREKKKNGVNITPDDVRVTAAVTEALQMIFGALLDPGDEILIPGPSYPPYTGLVKFYGGVPVEYRTIEEEGWQPDIDDLRKKITERTKAIAVINPNNPTGALYDKKTLEEIINIAGEHDIPVLSDEIYDLMTYEGKHISPASLTKDVPVIVMNGLSKVYFATGWRLGYMYFVDPEGKLSEVREAIDKLARIRLCPNTPAQFAAIAGLRGPMDYLEEYMKKLKERRDYIYKRLNEIPGISTTKPQGAFYIFPRIEEGPWKDDKEFVLDVLHNAHVLFVHGSGFGEYGRGHFRAVFLPPVEVLEEAMNRFEKFMREKLSS

SEQ ID NO: 21606 - protein, 144 aa, Pyrococcus abyssi
MLGKENVVVNMIEVGEYKVKEGLYYTKEHEWAQVLEDGTVLVGITDYAQKELGDIAYVELPEVGKEVKKGEVLCEVESVKAVSEVYAPVSGEVIEVNEELSDSPEKINEDPYGAWIAKIKPNNLEEELKELMDAEKYAEFLKSL

SEQ ID NO: 21607 - protein, 383 aa, Pyrococcus abyssi
MEFEDAFKEVYEMVKPKYKLFTAGPVACFPEVLEIMKVQMFSHRSKEYRKVHVDTVERLRDFLEVKKGEVLLVPSSGTGIMEASIRNGVTKGGKVLVTIIGAFGKRYKEVVETNGRKAVVLEYEPGKAVKPEDLDEALKKNPDVEAVTITYNETSTGVLNPLPELAKVAKEHDKLVFVDAVSAMGGADIKFDKWELDVVFSSSQKAFGVPPGLAIGAFSERFIEIAEKMPERGWYFDIPLYIKYLKEKESTPSTPPMPQVFGLNVVLRIIEKMGGKEKWLEMYEKRAKMVREGVKEIGLGILAEPGYESPTITAVLTPEGIKGDEVYEAMRKRGFELAKGYGSVREKTFRIGHMGYMKFEDIQEMLDNLKEVIEELKKQKGIN

SEQ ID NO: 21608 - protein, 425 aa, Pyrococcus abyssi
MGWLKKYLEFPVLQKILIGLILGAIVGLILGHYGYADAVKTYIKPFGDLFVRLLKMLVMPIVFASLVVGAASISPARLGRVGVKIVVYYLLTSAFAVTLGIIMARIFNPGAGITLAEAGKQFQPKQAPPLVQTLLNIIPTNPFGALANGKVLPTIFFAIVLGIAITYLMNSKDERVRKSAETLLNAINGLAEAMYKIVAGVMQYAPIGVFALIANVMASQGVKVVGELAKVTVAVYVGLALQILLVYFVLLKVFGIDPIKFISKAKDAMLTAFVTRSSSGTLPVTMRVAEDMGISKGIYSFTLPLGATINMDGTALYQGVCTFFIANALGMHLTLGQQLTIVLTAVLASIGTAGVPGAGAIMLAMVLESVGLPLTDANVAAAYAMILGIDAILDMGRTMVNVTGDLTGTAIVAKTEGELKEGIIY

SEQ ID NO: 21609 - protein, 275 aa, Pyrococcus abyssi
MPRRAREYPEEGEFVVATVKRIHNYGAFLELDEYPGKEAFMHISEVASTWVRNIRDYLKEGQKVVAKVIRVDPRKGHIDLSLRRVTQQQRKAKLQEFKRAQKAENLLKLAAEKLGKDFETAWREVWVPLEEEWGEVYAAFEDAAKDGIDVLKGHVPDEWLPVLKEIIDNYVEVPTVTIDAEFEITVPKPNGVEIIKEALIRARDRANKEKDVEVKFTYLGAPRYRIDITAPDYYKAEEVLESIAEEILRVIKEAGGEATLLRKEKRIKKVKKRKK

SEQ ID NO: 21610 - protein, 362 aa, Pyrococcus abyssi
MFEKGYVDENYVRIPKDELFSFVVRVLTKLGTPEEDAKIVADNLIMADLRGIESHGVQRLKRYVDGILSGGINLHPRIKIIREGPSYALLDGDEGFGQVVGYKAMKLAIEKARKTGIGIVAVRNSNHYGIAGYYALMAAEEGMIGISMTNSRPLVAPTGGVERILGTNPIALAAPTKGKPFLLDMATSVVPIGKLEVYRRKGEEIPEGWAINSKGEITRSVEEVFNGGSLLPLGGFGELLGGHKGYGLSLMVDILSGILSGGTWSKHVKNTNEKNSNVCHFFMAINIEHFTPLEEFKGRMSEMINEIKNSRKHPDFERIWIHGEKGFLTMETRLKLGIPIYKKVLDELNEIARRVGVKGLEV

SEQ ID NO: 21611 - protein, 363 aa, Pyrococcus abyssi
MYRLQLLQVQKCQEEFERALSLGHYDKARLIALRCAELLRKIASENLSLSHILLEEAKKWEEKAKNVRKRREGKNEYFDKLKALIKRSTITWNDIGGLREAKKLIAQAIGLSIAKSPIEPPQGILLFGPPGTGKSLLASAVANSLNATFFSVKASDLLSKYFGESSKLISALFSLARQLSPSVIFIDEVDSLTMKRVSLDDAARRMIGTLLAEMDGFKERKDKVIVLTATNAPWDLDEAMLSRLPIRIYVPLPDVNSAVEIFKIHLRGIHYDVPLSRLAKEAVKRLYSGREIANVVKLATMKMLEEMNPELSDPLRVSTLKGRDLTTRPLTLDDFKYAMARIKSPITKSDVKKYERWAKEFAI

SEQ ID NO: 21612 - protein, 314 aa, Pyrococcus abyssi
MPERVVIALGGNALQQRGQKGTYEEMMENVKKTAKQIAEIIARGYEVVITHGNGPQVGTILLHMDAGQSLHGIPAQPMDVAGAMSQGWIGYMIQQALRNELRKRGIEREVVTIVTQTIVDKDDPAFENPTKPVGPFYDEETAKKLAKEKGWVVKEDAGRGWRRVVPSPDPKRHVEAETIKKLVEDGVIVIASGGGGVPVIEEDGEIKGVEAVIDKDLAGERLAEEVNADILMILTDVNGAALYYGTEKETWLREVKVDEMERYYQEGHFKAGSMGPKVLAAIRFVKNGGKRAIIAHLEKAVEALEGKTGTQVIP

SEQ ID NO: 21613 - protein, 393 aa, Pyrococcus abyssi
MVIFRIKNYVEKDINLPWDQREGEIKMKPLHDPLYITAVFKQVGDAYPTDRGTELKYSREENPTVRKLEDKLAELEGSDNALAFNSGMSAISTLYFSLLEGGDKVVLSMEGYGTTIELAKLLRKFGVDVKLAYPSADSLIETIDEETKLVLVETMTNPTLKVIDVPEVAKRCREVGAILVVDNTFVTPLLYKPLEDGASYVVHSLTKYIAGHNDVLGGAVLWNGEFSRDLWEWRRRLGTIIQPFDAWMIERGMRTLEVRFERQSENAMAIAEFLKDHPKVREVHYPGLKDDPYYKVARRLFKKDLYGGVVAFDLGSGDNALAFLRGLKRIFPSPSLGGVESIATYPVKSAAKTLDEEIREILGITDGLIRLSVGLEPLDELIEDIDNALGVVR

SEQ ID NO: 21614 - protein, 318 aa, Pyrococcus abyssi
MKVKVSVFGFGTVGRALAEIIAEKRKVFGVELNVVSITDRSGTIWGDFDLLEAKEVKESTGKLSNIGEYEVYDFSPQELIEEVKPDILVDVSSWDDAHEMYSYALAEGISVVTSNKPPIANHYDELITLARENGVGIFFESTVMAGTPIIGLLRENLLGEEIVKMEAIVNASTTFILTRMENGKTFEEAMEEARTLGILEEDPSKDIDGIDAYYKAKILHWVSYGEQPEEEEREGIRNVKDARNVRLVAEISKGRISVAPRKLPDNSPLLVSEVENAALIKTENLTLTLKGPGGGGKVTASGVFTDIIKAALKFPSPR

SEQ ID NO: 21615 - protein, 346 aa, Pyrococcus abyssi
MKMGVGKYDELFNRIKERAKLVDEKLFELIPEKEPKVLYEAARHYPLAGGKRIRPFVVLTATEAVGGNALKAIYPAVAIELIHNYSLVHDDIMDMDETRRGKPTVHKVWGINMAILAGDLLFSKAFEAISRAEISPEKKAKVLETIVKASNELCEGQALDLEFENREMVSIEEYMRMISGKTGALFDASAKVGGIVGTENEEYIEALSRWGRNVGMAFQIWDDVLDLIADEEKLGKPVGSDIRKGKKTLIVAHFFENADEKAKEKFLKVFGKYAGDVKGKGIIEEDVKAEVMEAIELLKEHGSIDYASRIARELVEKANEALNVLPESRARKDLELLASFMVEREY

SEQ ID NO: 21616 - protein, 689 aa, Pyrococcus abyssi
MMPRKLKLEGLDCASCAYEIEEALRKEGFKFAVVNFATKEAIIEGDIEKAKEVIKKVEPDVEVVEEVHIHDHAHGEFEKRTIYFIGISLVLFTIGILMRYYYAIDNTLVFGLFLASYLISGWKVLKSAIVNSLNGNVFDENFLIAVATIGAFLIKEYPEGVAVMLFYVIGEFLQDMAVDKSRRSIKALLALKAEYANLVRDGTVVKVKPEELKVGDIIIVKPGEKVPVDGVIIEGTSSVDTSALTGESMPRTVKEGDEILSGMINLTGLLKVRVTRELSESTVSRILELVENASARKAKTEKFITRFAHYYTPAVVGIATLIATVPPLVFKESFTSWVYRALVILVISCPCALVLSIPLGYFGGIGRAAKEGILIKGSNYLDALKDASIVAFDKTGTLTKGVFKVTKIETRNGFTEEEILRFAALAEAHSNHPIAKAIREAYGKEINEAEITEYEEIAGHGVRARIDSVEVMVGNDKLLHRSNIEHDTCKVKGTIAHVVIDGQYAGYIVISDEIKEDAHLAVKELKRLGVRKVVMVTGDSRDVAEEIAKQLGLDGFYAELLPEDKVKIIEKLEKEKGNGKLVFVGDGINDAPVLARADVGVAMGALGSDAAIETADVVIMDDKPSKLPKAIQIARKTQRIVWENIIFALGVKLAFIGLGIFGKATMWEAVFADVGVALIAVFNAMRVLR

SEQ ID NO: 21617 - protein, 520 aa, Pyrococcus abyssi
MFPENFYWGVSQSGFQFEMGDKYRRHIDPNTDWWHWVRDKVNIEKGLVSGDLPEDGINSYELYEVDHNLAKDLGLNMYRIGIEWSRIFPWPTTYVDVDYSIDSSYDLVKDIKIDKSILEELDELANQREIAYYRRVISSLRDKGFKVIVNLNHFTLPHWLHDPITAREKALTNSRNGWINKRTVIEFAKFAAYIAYKFGDIVDMWSTFNEPMVVVELGYLAPYSGFPPGVMNPEAAKLAMLNMINAHALAYKMIKKFDKEKADKDSKEAADVGIIYNNIGVAYPENHRNEKDIKAAENDNFFHSRLFLEAITWGKLNIEFDGETFVNLPYLKGNDWIGINYYTREVVKWSDPMFPTLPLITFKGVPGYGYACRPGMSSKSGNPVSDMGWEIYPEGIYNSIVEAERYGVPLYITENGIADSKDVLRPYYIVSHLAVIEEAYEEGHEVRGYLHWALTDNYEWPLGFRMRFGLYEVNLITKERKPRKRSVEVFSRIISEGTTKGLQDEFRLKVRGERYENDSG

SEQ ID NO: 21618 - protein, 514 aa, Pyrococcus abyssi
MEIKLFCVFIVFIILFSPFVIALSYPDVNYTAENGIIFVQNVTTGEKKPLYLHGVSWFGFELKDHVVYGLDKRNWKDILKDVKRLGFNAIRLPFCSESIRPDTRPSPERINYELNPDLKNLTSLEIMEKIIEYANSIGLYILLDYHRIGCEEIEPLWYTENYSEEQYIKDWIFLAKRFGKYPNVIGADIKNEPHGEAGWGTGDERDFRLFAEKVGREILKVAPHWLIFVEGTQYTHVPNIDEIIEKKGWWTFWGENLMGVKDYPVRLPRGKVVYSPHVYGPSVYMMDYFKSPDFPNNMPIIWETHFGYLTDLNYTLVIGEWGGNYEGLDKVWQDAFVKWLIKKKIYNFFYWCLNPESGDTGGIFLDDWKTVNWEKMRVIYRLIKAANPEFEEPLYIILKTNATTSILGVGERIRIYWYTNGKVIDSNFAHSSEGEMNITVTKSMTLYIIVKKGNQTLRKELKLYVIGGNYGSNISTTQLVTPKKGGERISTSLKLAISLLFILLFVWYLLREKH

SEQ ID NO: 21619 - protein, 307 aa, Pyrococcus abyssi
MIFDAHSDLPTFVYNEREKGKTRVLESNFEKFFTGISARVMSVWSRPDKRPVILRYALEAYNRLFKDVSESERFRIVGTVKEMDEAIKEGKVALWLGMEGGEPIESLDILEIFHSMGLRVLTLTWSLRNQIGDGVFERTKGGLTNFGAEVVGKCEELGIIVDVSHINEQGFWDVLDITAFPVIASHSNAKALCDHVRNLTDDQIKAIAERDGVIGAVAIPEFVDKEKPTLEKYVRHIEYMVDLVGYKHVGIGLDFVYYLGSKKSVEGLEDESKIPALIDTLNEKFSEKEVKAIAFENFKRVFERVVG

SEQ ID NO: 21620 - protein, 413 aa, Pyrococcus abyssi
MKAVILAGGFGTRLRPISSTRPKPMVPVLGKPNLQYILEALEKVKEIDEVILSVHYMRGEIREFIQEKMRDYPKDIRFVNDPMPLETGGALKNVEEYVSDDFLVIYGDVFTNFDYSELIEAHKKNDGLVTVALTKVYDPERFGVVITDEEGKIVEFEEKPRKPKTNLVDAGIYMVNKDVLKEIPKNKEVYFEREILPKFVSQGLVYGYKMPKHYYWVDLGTPEDFFYAHQIALDEMARENGYMILGENVEIPEDVEVQGPVYIDDNAKIGHGVKIKAYTYIGPNTMIEDKAYIKRAILLGNDIIKERAELKDTILGEGVVVGKNVIIKENAVIGDYAKIYDNLVIYGAKVLPWKKVEEYEAYIRIKLDPAKVRPELTPDRCPLGLPECIYKKFKAIAGEKPPCDECIENQWLF

SEQ ID NO: 21621 - protein, 191 aa, Pyrococcus abyssi
MVDTNNVKLRIENIVASVDLFAQLDLEKVLDICPNSKYNPEEFPGIICRFDDPKVALLIFSSGKLVVTGAKSIHDIERAVAKLIEKLKGIGVKFKRAPLIDIQNMVFSGDIGREFNLDNVALTLPNCEYEPEQFPGVIYRVKDPRAVILLFSSGKIVCSGAKSEADAWEAVRKLLRELEKYGLIEEEEEEL

SEQ ID NO: 21622 - protein, 314 aa, Pyrococcus abyssi
MPILEVKSVTKKFPTPKGEVIAVNNVSFSANSGEVLGILGPNGAGKTTTLRMIATIYRPDSGEVLVDGIDAVKNPLEVRKRIAYMTQEPDLTPPLSVRDYIIYYFRFRGFSKRDAKKHCEDILELFGLKTHAHKKPFQLSTGLKRRVQLACALSSDVPLVFLDEPTAGVDPRSKRKTWELIKEKLEDKGVTVILTSHDLYEVEYLADRVIIMNQGKIVAEGSPKELKKRFGKTVRIVLEEPIKNFELLKEELLRVKNVKDVRLARDDSFDVYFKSLDDSINGILQVISPQELKIKDIFTATANFEDVYLEIIER

SEQ ID NO: 21623 - protein, 253 aa, Pyrococcus abyssi
MIIVENLRKRFGGKEVLKGISFTVKDGEIYGLLGPNGSGKSTTMRILSGIITDFEGKVIVGGVEVAKDPLQVKRIVGYVPETPALYESLTPAEFFSFVGGVRGIPKDILEERVRKLVEAFEIKKYMNQLIGTLSFGTKQKISLISSLLHDPKVLILDEAMNGLDPKSARIFRELLYEFKEEGKSIVFSTHVLALAELICDRVGIIYQGRIIAEGTVEELKEISKEERLEDVFLKLTQAKEEIAQVVSALKEAL

SEQ ID NO: 21624 - protein, 410 aa, Pyrococcus abyssi
MFRLGDFNYHNKVVFLRVDLNSPMKDGKIISDARFRAVLPTIKYLLENGARVVVGTHQGKPYSEDYATTEEHARILSNLLNQHVEYVEDIFGRYAREKIQELKPGEIAMLENLRFSAEEVKNKPIEECEKTFFVKKLSKVIDYVVNDAFAAAHRSQPSLVGFARIKPMIMGFLMEREIEALMKAYYSKESPRVYVLGGAKVDDSLKVAENVLRRGFADVILTGGLVANVFTLAKGFDLGRKNIEFMKKKGLLELVKHAEKILDEFYPYVRTPVDFAIDYKGDREEIYLLSEKRELLNDYQIMDIGSRTIEKYRDIIMKAKVVVANGPMGVFEREEFALGTVEVFKAIAESEAFSVLGGGHSIASIQKYGIEGITHISTGGGAMLTFFAGEELPVLRALQISYEKFKEVKA

SEQ ID NO: 21625 - protein, 335 aa, Pyrococcus abyssi
MKRVAVLGATGLVGRTFVKLLGGHPWFKVEKLIASEKSAGKKYGDLVEDSPEEFRDYYVISLNEFLENPGVDLVFNALPASISRDVEEKLAQEIPVFTNARAHRYDEDVPILVPEVNKDHLKLVEVQRKRRGWKGFIVTNPNCSTAILTLSLAPLRNFGIKKVRVATMQAISGAGFSGLSAYAIQDNVIPFISGEEWKIENESKKIMGKLKGDEIEPASFDVIAIATRVPVIHGHTEAVFVELENPDIKSIREAIENFDPLKDLKLPSYEKPIVYTEIPQPRLHRDRGRGLTVTVGRLERTSEGVKYVALGHNLVRGAAGGSVLNAELAYKLKII

SEQ ID NO: 21626 - protein, 352 aa, Pyrococcus abyssi
MVYKLLVVKFGGSSVRYAFEEALELVKYLSERIPIVVVVSALKGVTDELIRFANGDKGALPRIERIHEEFLNYHGLNTKISISFRKDMPPEALRDEIISLGERISAKIFAEGLELLGIKSKVVDPLEFLIAKGEFGDAYINIQESKRRAGKLIRLIKSGVIPVIPGFYGNLNGFRVTFGRGGSDYSATALARILDSRCVLIMSDVEGIFTADPKLVPSARLIPYLSYEEIKVAAKLGMKALHWKAVDPVVGDIPIIFGKTKDWKFGTIVLNARSNFPIIVHRVREDFAEIFVVGRNISLPGFLVEEEREDFVKIVVAREDLPEAIREIHREVVEREEKNLRTGNNSELWARI

SEQ ID NO: 21627 - protein, 368 aa, Pyrococcus abyssi
MRKMIVLKFGGSSVKNDFHEAVSLTKSIFEEKEVAVVVSALKGITDMLIKYAKTFDSKYAIKIADSYVKFARTNGVDPNILSPHIQELFNPPSLPKDALTDYILSIGELLSAVIFAEVVEGQVIYPWELFSAYGKFGDGFIDLKKSKKNAKIIYEVIDSGKIPIVPGFVGGMDGYRVTLGRGGSDYSAVALGVILNSELVAIMSNVEGIFTADPKLVPSARLIPYLSYEEALIAAKHGMKAIQWKAAELAKEKKILMLFGRTNNWRMGTVISNRTSRMPLMTYKDGLLLINVEEELEYRVIDEGPFWKLYDVPGNEGIRIIRELHKAIFGNVLSMLQEPGKHIRINRHKVGKSFEHMTFNQSFSRKFY

SEQ ID NO: 21628 - protein, 216 aa, Pyrococcus abyssi
MVVIGEKFPEVEVKTTHGVIKLPDHFTKQGKWFILFSHPADFTPVCTTEFYGMQKRLEEFRKLGVEPIGLSVDQVFAHIKWMEWIKENLGVEIEFPIIADDRGELAEKLGMIPSGATITARAVFIVDDKGIIRAIVYYPAEVGRDWDEILRLVKALKISTENGVALPHKWPNNELIGDKVIIPPASTVEEKKQREEAKAKGEIECYDWWFCYKKLK

SEQ ID NO: 21629 - protein, 315 aa, Pyrococcus abyssi
MPTYIIETKELTKFFGKRNVVYNLNLKVPKGAVYGFLGPNGAGKTTTIKMLTGALKPTYGEIKIIGMEMPRERVKIMRNVGYMPERPLAYDDMTIFEFLVYMGRLLGLPKDKAVNQARELMAYTGVGRLAFNKIEELSSGQRQRVLFASALMGDPELLILDEPTSNLDPLGRMEFIGKILELAKSGKTVFISSHIVSEIERMCNYVGLIKDGQLIEQGKVRDLAKIESTDYDVVVSDNEKLLKFLRDKIYVREVWEEEGIVRVKLDERFSEKFFLELPAFLASEKLAIKLFKPHTSPLERILMKRFNMGWKNGEQ

SEQ ID NO: 21630 - protein, 451 aa, Pyrococcus abyssi
MGKYFGTSGIREVVNEKLTPELALKVGLALGTYLNGGRVVIGNDTRTSSEMLKKAVISGLLASGVDVIDIGLAPTPLVGFAIKLYDADAGVTITASHNPPEYNGIKVWDRNGMAYTPEKERELERIIEEEKFKRAPWNEIGQLKQANPREEYIEAIMKEIKLDNSYTVVIDPGNGAGSIISPYLHRELGNRVITINSDPHGFFVRELEPNKESLSMLAKTVKALKADIGIAHDGDADRVGVVDENGEFVEYEVMLSLIAGYMLRKYGKGKVVTTVDAGFALDDYVRGLGGEVVRTRVGDVAVAEELMKHGGVFGGEPSGTWIMPQWNLTPDGIFAGALVLEMIDRLGLIGELAKEVPRYVTLRKKIPCPNDLKAKAMEEIAKLIPREFSYEREITIDGIRIENDDWWILFRPSGTEPIMRITLEAHTKERAESLMEKAEKLVKDAIKKASS

SEQ ID NO: 21631 - protein, 418 aa, Pyrococcus abyssi
MNRNFWLFVAGRFISQLGWAIQEVALPLYVLDVTHSAKIMTLFVLADLIPSIITTPIAGVFGDRYDRKKIMVGFDLIRGVLLFLVIAFNFLTIRCLLVVQVIMAIMNAFFSAGTGAMYPDLVKPEELERANSIVMSASIISRLVGPAIGGFVYGFGGIKLAILMNAISFFGSGLFEIFIKYEWKTRNIEGFSDFVRDIKEGLKFIMSNSFISTLIGLVILLNALGAPFASIIYPYAMREILKFSSQQFGLVESAFMLGALIGNLIVGAFLGAKAGRYIFRLFLVNGAVELIFILIISPFLALPRNSAFMLLLVLGATMGMAGAMINVPLASKLQRAVPSEIRGRVFSTMEMLARIANPLSLVVVGPLVDTIGAWKTASFLWLGSGVVILYYWIFKGKELTSEEESKLVENFPGVPPED

SEQ ID NO: 21632 - protein, 351 aa, Pyrococcus abyssi
MNIMDEKIKRIIEFMNENSIDAVLITKNPNIYYLSGASPLAGGYILVNNDGATLYVPELEYEMAKEESKIPVEKFKRRDDFYKVFEGVKVLGIEGSLSYSFVEDLKEKGKISEFKKVDDVIKEMRIVKSDEEIKIIEKACEIADKAVMAAIEEVTEGKKEREIAAKVEYLMKMNGAEKPAFDTIIASGYRSALPHGVASDKRIEKGDLVVIDLGALYNHYNSDITRTVVVGSPNEKQREIYEIVLEAQKKAVEAARPGITTKELDSIARNIIKEYGYGDYFIHSLGHGVGLEIHEWPGVSQYDETVLKEGMVITIEPGIYIPKFGGVRIEDTIVITKTGARRLTKTERELI

SEQ ID NO: 21633 - protein, 182 aa, Pyrococcus abyssi
MKEELVKLIIDSGCIKFGHFILTSGKESNYYIDIKSLITNPKALKLIAKMIKEESRKLGIEYDKVAGPELGAVPIATALSLETDKPLLIIRKKKKEHGTGKLIEGEISPGDRVLLVEDVTTTGGSVIRAAKILKEHGAEVVGIFVVVDREEGARENIEKEGFKLYPLVLVSDLFEAAGVSKD

SEQ ID NO: 21634 - protein, 992 aa, Pyrococcus abyssi
MTKRIRQPIIAVLGHVDHGKCLLPDEKVVVPSVGFVTLKELFETASKVVERDDEKEIRELDERITSVNGDGKTGLVKASYVWKVRHKGKVIRVKLKNWHGVTVTPEHPFLTTKGWKRADQLRPGDYVAVPRFIHGNEDEKIFLSYVKVKKSGEEWKEYFYLAGRKGNIDVNLLFVAPKRYVVEFLRGYFEERSEVKGESVIVEARELVEPLSLALLRFGIFSKIQGSKLIVTGKRNLEAFKDYIGFKDEREKALEEAIEKVKGSEVYPIFEEIRRLRLLFGFTREELGSYAKYENSEAPTYEELMEILDFIERGSPSLSKKIAILEGKLKAELRVLEEEGLIKDGKLTPLGRELLEVWRNREFDSKDVDYIRNIAETLVFIPVENVEEEEYDGYVYDLTTETHNFIANGILVHNTTLLDRIRKTNVAAKEAGGITQHIGATEVPIEVVKKIAGPLIKLWKAEIKLPGLLFIDTPGHEAFTSLRARGGSLADLAVLVVDINEGFQPQTIESIEILRKYRTPFVVAANKIDRIKGWVIEEDEPFLMNIKKQDQRAVQELETKLWELIGKFYEFGFQANRFDRVQNFTRELAIVPISAKYGIGIAELLVLIAGLSQRYLEEKLKIEVEGPARGTILEVREEPGLGHTIDVIIYDGTLHKDDTIVVGGKDKAIVTKIRALLKPKPLDEIRDPRFRFDYVDEVTAAAGVKIAAPGLEEALAGSPVIAAPTPEDVEKAKQEILEQIERVVISTDKVGVIVKADTLGSLEALSKELQEKEIPIRKADVGNVSKTDVMEALSVKEEEPKYGVILGFNVKVNEDAEEVAKAKDVKIFVGNVIYKLIEDYEEWVKEEEEKKKRELLSKVTFPGVIRLYPDERYVFRRSNPAIVGIEVIEGRIKPGVTLIKQNGQKVGVIRSIKSRDEFLQEAKKGQAVAIAIEGAIVGRHIHPGETLYVDLSRDDAITLLKHLRDTLEDTDIKALKMIAKVKAKEDPFWRAI

SEQ ID NO: 21635 - protein, 180 aa, Pyrococcus abyssi
MLIAITGTPGVGKTTIAKLLAEKLGYEYVNLRDFALEKGCGREVDGEVEVEIDELAYFVEKELKDRNVVLDGHLSHLMPVDLVVVLRAHPRIIGERLRERGYSKEKIGENVEAELVDAILIEAIDEHENVIEVDTTNKTPEEIVEEIIGLIKSGVKRRVGIVDWSEVYDEIIPYLRLGGE

SEQ ID NO: 21636 - protein, 181 aa, Pyrococcus abyssi
MPKGCLVITVSGLAGSGTTTLCRNLAKHYGFKHVYAGLIFRQMAKERGMSLEEFQKYAELHPEIDREVDRRQVEAAKECNVVIEGRLAGWMVKNADLKIWLDAPIRVRAERVAKREGISVEEAFMKIAEREMQNRKRYLNLYGIDINDLSIYDLIIDTSKWSPEGVFAIVKAAIDHLYEKV

SEQ ID NO: 21637 - protein, 427 aa, Pyrococcus abyssi
MNVSIIGSGYVGLVTGMGFVKLGNRVIFVDVDEWKVRVINNAQPPIYEEGLEELMQEFKGKYYATNNYREAILNSDITFITVGTPSKPDGTIDLTYVKNAAKEIGKALKEKDNFHIVVVKSTVLPGTTEGVIRPILEKYSGKKAFQDFGLAMNPEFLREGVALKDFLNPDRIVIGVQDERTKKVLEKLYEPFNAPKLFTDIKTAEMIKYASNAFLATKISFANEIGNICKKLGIDSWKVFEGVGLDHRISPHFFRSGIGFGGSCFPKDLKALIKKAEELGEDPIILKAVLQVNERQPLKLIELLKKHVPNLKDMKVGVLGLAFKPNTDDVRETRAYIVIKKLLEEGAKVIAYDPKAMENFKRFYPDVGRQISYANSAEEVLREVDVILILTEWRDFESLDYSGKIVIDGRRVRSAEKTAKIYEGVCW

SEQ ID NO: 21638 - protein, 291 aa, Pyrococcus abyssi
MIRKAVIPAAGLGTRMLPITKSMPKEMLPIVDRPVIHYVVEEAVKAGIEDILIITGKGKRAIEDYFDRSFELEYYLKERGKLEALREVEEIGEMVDIYYVRQKKPLGLGDAILYAEKHVNGEPFAVLLGDDIIISKKPAIKQLIEVAERKNTPVIGVESVPRELVSRYGIIEGELIENDLYRIKRLVEKPSPKEAPSNIAIIGRYILIPEIFDILRETPPGRDGEIQLTDALQILLNKNEILAKRIEGERYDIGSKFGFVMANLKLSLRREELRNEVLKYLKSILKEISNE

SEQ ID NO: 21639 - protein, 448 aa, Pyrococcus abyssi
MVKLLGMSREDVREAIKNGDVTIAVYGLGKMGLPLAAVFADNGAKVIGVDINERVVNSVNNGENHIKEEPGLDELVKKNVEAGRLKATTDGILAAKKADVMIILVPTLADDRGNLKLESVYDVAEKISKGLEKGDIVITEATMPPGTTESLIPILEKSGLKLGDFGLAHAPERTMTGTAIRDITGQYPKIVGASDERTLEAVIGIYETINRKGVIPMSSIKAAEAVKVFEGIYRDVNIALANELALWCEEHGLDAIEIFNAANTQPYCHLHMPGAGVGGHCIPIYPWFVINLAKKTNVRLIRTAREINDSMPRHVVELTVRALNDAGKPMKGSKILVLGLTFRGGVKEFTKSPAIDVIRELKEWGAEVYAYDPLCTREDAERFGAKWKEDFKDVDAIVIVTDHREFKTLDLKEIAAEVRTKVIVDGRNVIHPEEAKKLGFIYKGVGRV

SEQ ID NO: 21640 - protein, 379 aa, Pyrococcus abyssi
MVSKPHGGKLIRRIAAPRTRERILSEQHEYPKVQIDHGRAIDLENIAHGVYSPLKGFLTREDFESVLDHMRLSDDTPWTIPIVLDVEKPEFEEGDAILLYHKETPIARMHVEDIYTYEKEEFALKVFKTKDANHPGVAKVYSMGKYLVGGEIELLNELPNPFAKYTLRPIETRVLFKEKGWKTVVAFQTRNVPHLGHEYVQKAALTFVDGLFINPVLGRKKRGDYKDEVIIKAYEVLFEHYYPKDVAVLATVRYEMRYAGPREAIHHAIMRKNFGATHFIVGRDHAGVGNYYGPYEAWDLFDEFPDLGITPMFIREAFYCKKCGGMVNEKICPHDEKYHVRISGTKLRNMIMRGEKPPEYMMRPEVYEVIRSFDNPFVE

SEQ ID NO: 21641 - protein, 174 aa, Pyrococcus abyssi
MEGFTIWLTGPSGAGKTTLAVKLAKKLREMGYKVEILDGDTIRKTLYPNLGFSKEAREMHNRIVIYMAKLLTRNGVIAIVSLISPYKRIREYARKEIGRFMEVYVYAPLEVRIKRDPKGLYAKAIRGEIRGLTGYDGVYEEPENPEVKVDSSRMTPDEEAELVIRKAKELGYLP

SEQ ID NO: 21642 - protein, 352 aa, Pyrococcus abyssi
MKALILSGGYGTRLRPLTYSQQKQLIPVANKPVLFYAIEDVIEAGIHEIGIIVGPNKEQVIETVKSVDWDANIEFIYQGEPKGLAHAILVARDYLGNDDFVMYLGDNILREGIVRHKEHFEKSDYDASILLCEVPNPQQFGVAELSEDGKTIKRLIEKPKHPPSNLALVGIYFFRPIIHEAVRHIKPSWRNELEITDAIQWLIDNGYKVGWTKVTGWWKDTGKPEDLLEANRLVLDEIEREIKVETRAKIIGRVKIEEGAKIDENTIIKGPAVIGRNAVIRNAYIGPYTSVGNNVVIEDTEVEDSIIMDGSVIIGAGRIIESIIGKEVRIVRGDGHPLGRRLIVGDKSQLTL

SEQ ID NO: 21643 - protein, 880 aa, Pyrococcus abyssi
MKIEEVKVYNFRSHEETVVRFRKGINLIIGQNGSGKSSLLDAILVGLYWSKKLRLRGLKKDEFRRIGGKGGTRIEIKFENDDSKYVLFRDFSRNVAYLKVQENGKWRHASEPSMESVSSYIERILPYNVFLNAIYIRQGQIDAILESDETRDKVVREILNLDKLESAYENLKRIKTNINLLIESKKSFIARTENIEELIKANEDELTKKLSEINEISSKLPPIRGELEKVRENVKELESIKGKISELKIQVEKLKGRKKGLEEKIVQIERSIEEKKAKISELEEIVKDIPKLQEKEKEYRKLKGFRDEYESKLRRLEKELSKWESELKAIEEVIKEGEKKKERAEEIREKLSEIEKRLEELKPYVEELEDAKQVQKQIERLKARLKGLSPGEVIEKLESLEKERTEIEEAIKEITTRIGQMEQEKNERMKAIEELRKAKGKCPVCGRELTEEHKKELMERYTLEIKKIEEELKRTTEEERKLRVNLRKLEIKLREFSVMRDIAEQIKELESKLKGFNLEELEQKEREFEGLNEEFNKLKGELLGLERDLKRIKALEGRRKLIEEKVRKAKEELENLHRQLRELGFESVEELNLRIQELEEFHDKYVEAKKSESELRELKNKLEKEKTELDQAFEMLADVENEIEEKEAKLKDLESKFNEEEYEEKRERLVKLEREVSSLTARLEELKKSVEQIKATLRKLKEEKEEREKAKLEIKKLEKALSKVEDLRKKIKDYKTLAKEQALNRISEIASEIFSEFTDGKYSNVIVRAEENKTKLFVVYEGKEVPLTFLSGGERIALGLAFRLALSMYLVGRIDLLILDEPTPFLDEERRRKLLDIMERHLRRISQVIMVSHDEELKDAADYVIRLRLEGGKSKVEVVS

SEQ ID NO: 21644 - protein, 456 aa, Pyrococcus abyssi
MGKLFGTFGVRGIANEKITPEFTLKIGMAFGTLLKREGREKPLVVVGRDTRVSGEMLKEALISGLLSVGCDVIDVGIAPTPAIQWATKYFNADGGAVITASHNPPEYNGIKLLEPNGMGLKKEREAIVEELFFKEEFDRAKWYEIGEVRKEDIIKPYIEAIKSKVDVEAIKKRKPFVVVDTANGAGSLTLPYLLRELGCKVVTVNAQPDGHFPGRNPEPNEENLKEFIEIVKSLGADFGVAQDGDADRAVFIDEKGRFIQGDKTFALVADAVLRERGGGLLVTTVATSNLLDDIAKRNNAKVMRTKVGDLIVARTLFEHNGTIGGEENGGVIFPDHVLGRDGAMTVAKIVEIFAKSGKKFSELIDELPKYYQIKTKRHVEGDRHGIVNKVAEIARGRGYNVDTTDGAKIIFEDGWVLVRASGTEPIIRIFSEAKSEEKAKEYLNLGLGLLDEVLSS

SEQ ID NO: 21645 - protein, 653 aa, Pyrococcus abyssi
MNITSFINRLKELVEIEREAEIEAMRLEMRRLSGIERERLGRAILNLNGKIIGEELGYFLVKYGRNREIKTEISVGDLVVISKRDPLKSDLLGTVVEKGKRFIVVALETVPEWALRDVRIDLYANDITFRRWLENLNTIKKAGKRALRFYLGLDEPSQGEEVNFVPFDKSLNRSQRKAISKALGSEDFFLVHGPFGTGKTRTLVELIRQEVKRGNKVLATAESNVAVDNLVERLSRSGIKIVRIGHPSRVSKHLHETTLAYLITQHELYGELRELRVIGQSLAEKRDTYTKPTPKFRRGLSDEEIIKLAERKRGARGLSARLIMEMAEWIKLNRQVQKAFDDARKLEERIARDIIREADVVLTTNSSAALEVVDYDTYDVAIIDEATQSTIPSILIPLNKVERFVLAGDHKQLPPTILSLEAQELSRTLFEGLIERYPWKSEMLVVQYRMNERIMEFPSKEFYGGKIIADESVRGITLRDLVEYQSPNDSWGKILNPENVIVFIDTSKAENKWERQRRGSESRENPLEAEIVAKIVDKLLSIGVKPEWIGVITPYDDQRDLISMKVPEDVEVKTVDGYQGREKEVIILSLVRSNKLGEIGFLKDLRRLNVSLTRAKRKLIVVGDSSTLSSHETYKKMIEFFKEKGCFIEFPFS

SEQ ID NO: 21646 - protein, 371 aa, Pyrococcus abyssi
MESLKIALVSDWYFPKIGGVAIHVHNLAIHLRKMGHEVSIVTNALTNGKEGELQKYGIDLIKVPGLIKDGINLSMIAKSSNSLVEYLKGFDVVHAQHAFTPLSLKSIPAGNKVGALTLVTNHSVEFENFSILNGFSKMSYSYFKMYLGQVKVGIGVSKASVSFLRKFTNAPIVEIPNGVNIERFNGRGREWGTRNILYVGRLEPRKGVNYLISAMKFVEGKLTIVGDGSMRKVLKMQAKKLGVEDKVEFLGFISQEELILLYKKSEVFVLPSLSEAFGIVLLEAMASEVPVIGTSVGGIPEIIGDAGIIVPPRDSKALANAINAILSNQKTAKRLGKLGRKRVERLYSWDVVAERTERLYRGELGDSDTNV

SEQ ID NO: 21647 - protein, 450 aa, Pyrococcus abyssi
MAVHPIDYRYGSEEMRRVWEEENKLQKLLDVEAALARAHAKLGNIPEESARVISERANTKWVKLERVKEIEAEIHHDIMAVVKALSEVCGEHGKYVHLGATSNDIIDTANALLIKESLAIVEKDLKELRSILKELAKKHIDTVCIGRTHGQHAVPTTYGMKFALWLDEIQRHIERLQQLKDRVLVGKMRGAVGTAASFGDKAFEIEKLVMEDLGLKPARITNQIIQRDVYAELMFFLALVASTLDKMALEIRNLQRTEILEVSEPFGEKQVGSSTMPHKRNPIRTEKVCGLARVLYSNVIPALLNNPLWHERDLTNSSVERVILPESFVLLDEMLKVMKKVLKGLEFFPENIKRNLYLTKNLIMAEPLMLKLAEKGMGRQEAHELVRQLAMKAFKEGRDLLEVVRKNEEAMKYLTENDLEGLKPENYIGKAREIVENVVNYVEEMERRGL

SEQ ID NO: 21648 - protein, 294 aa, Pyrococcus abyssi
MEGVIVPLVTPFREDYSIDFEALEWHIRFLEEKGVHGIFVNSTTGEFTSLNTDERKMLAEKGREITSGMYLVGTGSTSTLEVIELSRHAEDIGADGIVIVAPYYCKLKDEEILKHFSMVAERVDIPIIVYAIPSCANPVPVDIIRKVSLEYSNIIGVKASVDSLTYLQELIEVKEERKDFRVFTGLDQYFLSTLLLGGDGGIMACANFAPEIHLQIWNSFKRRNFEEAIKLSRVLGEISRIYNVASSFASAVKLAMIAKGFPIKPVLRPPHVIDGEEVFNEIKGILRSLENVKP

SEQ ID NO: 21649 - protein, 457 aa, Pyrococcus abyssi
MDYPRIVVNPPGPKAKELIEREKRVLSTGIGVKLFPLVPKRGFGPFIEDVDGNVFIDFLAGAAAASTGYSHPKLVKAVKEQVELIQHSMIGYTHSERAIRVAEKLVKISPIKNSKVLFGLSGSDAVDMAIKVSKFSTRRPWILAFIGAYHGQTLGATSVASFQVSQKRGYSPLMPNVFWVPYPNPYRNPWGINGYEEPQELVNRVVEYLEDYVFSHVVPPDEVAAFFAEPIQGDAGIVVPPENFFKELKKLLDEHGILLVMDEVQTGIGRTGKWFASEWFEVKPDMIIFGKGVASGMGLSGVIGREDIMDITSGSALLTPAANPVISAAADATLEIIEEENLLKNAIEVGSFIMKRLNELKEQFDIIGDVRGKGLMIGVEIVKENGRPDPEMTGKICWRAFELGLILPSYGMFGNVIRITPPLVLTKEVAEKGLEIIEKAIKDAIAGKVERKVVTWH

SEQ ID NO: 21650 - protein, 390 aa, Pyrococcus abyssi
MRQKRKYFIAERVILIKRSKIRELFERASKMENVISLGIGEPDFDTPKNIKEACKRALDEGWTHYTPNAGIQQLREAVVEYYKKFYDVDIDVENVIITAGAYEGTYLAFESLLESGDEVLIPDPAFVSYVEDAKLAEAKPVRIPLREENNFMPDPDELLELVTKKTRMIVINYPNNPTGATLDKEVAKAIADIAQDYNIYILSDEPYEHFIYDDAKHYPMLKFAPENTILANSFSKTFAMTGWRLGFVVAPSEIIKEMIKLHAYIIGNVASFIQVAGVEALRSEESWKAVKEMRKEYNERRKLVLKRLKEMPGIRVKEPKGAFYVFPSIKDTGMSSEKFSEWLLEKARVVVIPGTAFGKMGEGYVRISYATSREKLMEAMDRMEKALSEL

SEQ ID NO: 21651 - protein, 375 aa, Pyrococcus abyssi
MRFFLKTTILMGRGSLENVKRIISEGERVLIFSSRSMDRLGFLSEVADYVEEAGGVYETIIGLPPEPSVENVEEVLPKVEEFSPETFIALGGGSVIDVAKAVKVFYDAPGLDFDSVAIFSRFKKAQPLPKLKTRLIAIPSTSGAGSEVSAASVIKKGDTKYTIVSPELCPDYAILDPRLPEKMPREVARNSGLDVLVHAIEAYVSKASTPFSDALAVKAARIIFERLEDSVNGDAKAREEVHYAATMAGIAFLNGRLGLVHAMSHKSAWIGPHGLVNAIFLPYVMEFNMERAREKYDAMARELGLSSADELLEKVKELNEKLGVPKLSEIVKEEEFLGKVEDMSRKTYEDPLVSFNPVEPSVEDIKNLYLRALHD

SEQ ID NO: 21652 - protein, 317 aa, Pyrococcus abyssi
MVVSLKGRDLLCLQDYTPEEIWTILETAKMLKIWQKIGKPHRLLEGKTLAMIFQKPSTRTRVSFEVAMAHLGGHALYLNAQDLQLRRGETIADTARVLSRYVDAIMARVYDHKDVEDLAKYASVPVINGLSDFSHPCQALADYMTIWEKKGTIKGVKVVYVGDGNNVAHSLMIAGTKLGADVVVATPEGYEPDEKVIKWAEQNAAESGGSFELLHDPVKAVKDADVIYTDVWASMGQEAEAEERRKIFRPFQVNKDLVKHAKPDYMFMHCLPAHRGEEVTDDVIDSPNSVVWDEAENRLHAQKAVLALLLGGVKTGF

SEQ ID NO: 21653 - protein, 152 aa, Pyrococcus abyssi
MAELKVSAIKEGTVIDHIPAGKGLKVIEILKLGKLTNGGAVLLAMNVPSKKLGRKDIVKVEGRFLSEEEVNKIALVAPNATVNIIRDYKVVEKFKVEVPDVIEGILRCGNPNCITNHEYVTTKFYVISREPLKVRCHYCERTMEEEEILANL

SEQ ID NO: 21654 - protein, 308 aa, Pyrococcus abyssi
MDWKGRDVISIRDFSKEDIETVLATAERLERELKEKGQLEYAKGKILATLFFEPSTRTRLSFESAMHRLGGAVIGFAEASTSSVKKGESLRDTIKTVEQYCDVIVIRHPKEGAARLAAEVAEVPVINAGDGSNQHPTQTLLDLYTIKKEFGRIDGLKIGLLGDLKYGRTVHSLAEALTFYDVELYLISPELLRMPRHIVEELREKGMKVVETTTLEDVIGKLDVLYVTRIQKERFPDEQEYLKVKGSYQVNLKVLEKAKDELRIMHPLPRVDEIHPEVDNTKHAIYFRQVFNGVPVRMALLALVLGVI

SEQ ID NO: 21655 - protein, 162 aa, Pyrococcus abyssi
MVSMCENEKERTLVIIKPDAVIRGLIGEIISRFEKRGLKIVGMKMIWISKELAEKHYAEHREKPFFKSLVEYITRTPVVVMVVEGRCAIEVVRKMAGATDPKNAEPGTIRGDFALEVSDAICNVVHASDSKESAEREIKLYFRDDEIFDYPRAEDWFYRKGI

SEQ ID NO: 21656 - protein, 637 aa, Pyrococcus abyssi
MFEYFPYKTLRPHQDEFIELVRDVVKRGEKVIIEAPTGFGKTISVLAGVLPHAISFGYKVIYLARTHKQMDRVIEELKRIREIAKVSGIEFRSRKDLCLHSYIRTFAQDAYTSMIVCKSLKRLGKCKYFENLKEKRDKVKEIVEFFLENPSYPWEVIEYSNLLELCPYEVTRKVGEKANVIVASYLYMVNPWIRQAFLDGLGLEYSDLIVIFDEAHNLPDQAISALSDRLSIRSVERAIKEANEYGEKDIENFLSIFLRGLEIIYKEKLENYEISEVPLSPASIFEHVSSILGLRERDLLRFLQEMVEVGDAIREDKIERNLPPRSYVGRVGEFLWNWISLADRSDYLHVFTREKGLALEIVALDPSVALEFLEDVHSAILMSGTLSPLEAFRDIIGVNARLKKFPRMVKSENAIVLVARDVSTRGEERSPVLYKKLAEYIFEAVKIIPKNVGVFTASYEVLEGLISTNVHIRIEEEIGKKVFIEKRDASSSENDALVAEFKAEAKGNGGVLFGVMGGRNSEGQDYSGDEMNGVILVGIPYARPTPRVQAQIRYYEKKFPGKGRYYGYLLPAHRKLAQAAGRVHRSEEEKGSIVILDYRVLWNTVKRDLPDWMVETMQPVTLPLMRIKLRKFWRAVK

SEQ ID NO: 21657 - protein, 562 aa, Pyrococcus abyssi
MSGARALVKALEKEGVKHTFGIIGGSIMPVFDELLESSIRHITTRHEQGAAHAADGYARVSGKPGVAITTSGPGATNLVTGIANAYMDSSPIVAITGQVPTHMIGKMAFQETDIISITKPITKWNYQIRNPREVPKAVKMAFTIATLGRPGPTLLDFPKDAQTGEDEINFDVDVSRLVTPWRPPKLDACPEEVKKAVDMILSAERPVFIVGGGVVWSGATEEVLAIAEYLMIPIMSTFMGKGAVPENHPLYIGNLGMHGKIAANKLLPQTDLIIAVGMRWSDRTVSEFENFAPEAKIIHIDIDPKEVGKNVKVDLGIVGDAKRVLRSIYSEITRGVKKREDWPWLKKVREFQEKYKEELIPLDGNYLRPPEILKELRKILPEDAIVATEVGQNQMWVALYFPILKPRTFLTSGGLGTMGFGFPAAIGAKVAKPDKVVIDIAGDGSFMMSERELATAVNENLPVIVVILNNSSLGMVAQWQRMFFNRRYVATYFKKNPDFVKLAEAYGAQGFRAETMEELLKAVKEGMNSEVPTVIDVPIHPEDDVLPMVPPGEHISKVVTRY

SEQ ID NO: 21658 - protein, 423 aa, Pyrococcus abyssi
MGMTIAEKILADHSEREEVKPGEIVMAKLDFVFGNDVTMPLAIKKFRELGVKRVFDRERIAIVLDHFTPNKDIKSAEQCKSSREFAKEMGIKWFFEGGSVGVEHCLLPELGLVLPGDLIIGADSHTCTYGALGAFATGVGSTDLAVAMATGEAWFRVPETMKFIYEGELQPYVTGKDLILHTIGDIGVNGALYKVMEFSGSVIEELSVEQRMTMSNMAIEAGAKTGIIEPDKKTLDYVKERAKRKFKVYKSDEDAKYYKVIEYDVTNWEPVVAFPHLPENTVPISKAAKMNIKIDQVFIGSCTNGRIEDLRMAAEILEGQKVAKWVRLIVIPCSPTVYWKALKEGLIEIFLEAGAVIGPPTCGPCLGGHMGVLASGERAVSTTNRNFVGRMGHPKSEVYLANPYVAAASAVLGRIASPEEVVK

SEQ ID NO: 21659 - protein, 354 aa, Pyrococcus abyssi
MKLRIAVIPGDGIGKEVVAEGLKVLKKLEELSRVSFEFKEYPFGAEHYLKTGETLPDWAIEEFKKFDAIYFGAIGDPRVKPGILERGILLKMRFELDLYVNLRPVKLYHPRLTPLKGKNKIDIVFVRENTEGLYAGAGGFLRKGTPQEIAVQEMINTRFGVERVIRFAFEYAKRSGRKKVTLVDKANVLTYAHDLWERVFAEVSQEYDLETDHYYVDAMAMKMIRSPESFDVVVTPNMFGDILTDLGAEIVGGLGIAASGNINPETTGMFEPVHGSAPDIAGKRIANPLAAILSASMMLEYLNLEKESKWIEEAVKRAIAENKVTPDMNGNLKTYEVGDWVVKFLEVVANEEEG

SEQ ID NO: 21660 - protein, 840 aa, Pyrococcus abyssi
MILGRSEPQKDEIKLRVAEALKRDVGRGIVRFDRKYQRMIGVEPGDIVEIEGERITAAIVANPHPDDRGLDIIRMDGYIRKNAGVTIGDFVTIRRAEVKEAKKVVLAPAQKGVIVQIPGDIVKNNLLGRPVVKGDIIVASGRSEMYYSSGTPFDEIFRGFFEAMSVGFGELKFMVVNTIPKGIVQITYNTEVEVLPQAVEVREEKIPEVTYEDIGGLKEAIEKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKSRGKVIVIAATNRPDALDPALRRPGRFDREIEVGVPDKQGRKEILQIHTRGMPIEPDFEKETVIKALKELEKDDRFDKEKIKKIIEKVSKAKSEEEIKDILREDRNLYIEVRTKLIDKLLDELAEVTHGFVGADLAALAREAAMVVLRRLIKEGKINPEAETIPREVLEELKVTKADFYEALKMVEPSALREVLIEVPNVHWDDIGGLEDVKQELREAVEWPLKYPKAFKRLGITPPKGVLLYGPPGTGKTLLAKAVATESQANFIAIRGPEVLSKWVGESEKRIREIFRKARQASPAIIFIDEIDAIAPARGTAEGEKVTDRIINQLLTEMDGLVENSGVVVIAATNRPDILDPALLRPGRFDRLILVPAPDEKARFEIFKVHTRGMPLADDVDLKELARRTEGYTGADIAAVCREAAMNALRRAVAKLSPEELEEESEKFLKSLIVTRKDFEVALKKVKPSVTKYMMEYYRQFEESRKRMVGESTGREPDYFTG

SEQ ID NO: 21661 - protein, 350 aa, Pyrococcus abyssi
MGKLLKPSKEIGIVGYGAYVPMYRIRNEEIGRVWGVSNFPIEEKAVPGLDEDAVTIGIEAARNALKRAKIDPREIRAIWFGSESKPYAVKPSATIIAEAIGATPDLEAADFEFACKAGTEALQAAIGFVASGMAKYAMAIGADTAQGRPADHLEFTAGAGGAAFIVGEKSSETLAYFEGSYSYVTDTPDFWRRQHEHYPRHGNRFTGEPAYFHHVITAAKTLMDELGLTPADFDYAVFHQPNVKFPLTAAKILGIPKEKVLPGLLTGKIGNTYSGATMVGISAVLDIAKPGDRILWVSFGSGAGSDAFSIVVQDAIEEKRDLAPKVEDYVKRRKVIDYALYAKARRKYIL

SEQ ID NO: 21662 - protein, 388 aa, Pyrococcus abyssi
MEKPIIVGVGMTPVGEHWRTSLRDLAVEAILKAMDDAGIDKVDSLYVGNMASGSFVEQENLGALIADWAGLGNIPAVKVEAACASGGAAVQEGAKAVLSGLEDVVLVVGVEKMTDAWPSDATRYLAYASDAEWELFHGVSFVALNALIMRHYMNTYGYTEEDLALFAVNAHANGAKNPYAMFKRPITVETVMKSPYIADPLKLFDASPVCDGAAAVIITIPEKAKELGIPKDKWVEIAGMGRAIDTINLANREDLLTLKAAKIAAEKAYKMAKVEPKDIDFFEVHDAFTVMAALSLEALGVAEKGEGAKLAKEGQIAIDGDYPIQTMGGLKARGHPVGATGVYQTVESVLQIRGEAPNGIQVPDAEIGLTQNIGGTGSNITVTILRRV

SEQ ID NO: 21663 - protein, 249 aa, Pyrococcus abyssi
MPFEIVFEGAKEFAQLIETASRLIDEAAFKVTEEGISMRAMDPSRVVLIDLNLPASIFSKYEVDGEETIGVNMDHLKKVLKRGKAKETLILRKGEENFLEISLQGTATRTFKLPLIDVEEIEVDLPELPFTAKVVILGDVIKEAVKDASLVSDSMKFIAKENEFTMRAEGETQEVEVKLTLEDEGLLDIEVQEETKSAYGISYLSDMVKGLGKADEVTIKFGNEMPMQMEYYIRDEGRLIFLLAPRVEE

SEQ ID NO: 21664 - protein, 110 aa, Pyrococcus abyssi
MVKFCPKCGSIMIPDKKRGVFVCRRCGYEEPINPEDAKAYKRTEEVKHKPDEGVIVVEQDFSTLPTAKVTCPKCGYHEAWYWELQTRAGDEPSTIFYKCKRCGYVWRSYE

SEQ ID NO: 21665 - protein, 348 aa, Pyrococcus abyssi
MSEKMVAIMKTKPAYGAELVEVDVPKPGPGEVLIKVIATSICGTDLHIYEWNEWAQSRIKPPQIMGHEVAGEVVEVGPGVEGIEVGDYVSVETHIVCGKCYACRRGQYHVCQNTKIFGVDTDGVFAEYAVVPAQNVWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVSIDFNNLIIFKALTVYGITGRHLWETWYTVSRLLQSGKLNLDPIITHKYKGFDKYEEAFELMRAGKTGKVVFMLK

SEQ ID NO: 21666 - protein, 478 aa, Pyrococcus abyssi
MIAMRLPDHKTKIVATIGPATSSRNMIKKLIENGVSVVRLNFSHGSFEEHAKVIEKVRDISQKLDRRVAILADLPGLKIRVGEIKGGYVELKRGEKVVLTTRDVVGDETTIPVEYKDFPRLVSKGDVIYLSDGYIVLRVEEVRGQDVEAVVVSGGKLFSRKGINIPKAYLPVEAVTPRDMEIIKFAIEQGVDAIGLSFVGSVYDVLKVKSFLEKNDAEDVFVISKIERPDAVRNFDEILKASDGIMIARGDLGVEMPIERLPILQKELIRKANTEGKPVITATQMLVSMTAEKVPTRAEVTDVANAILDGTDAVMLSEETAIGKFPIDAVKMMAKIAKVTEEYRESFGMSRLRELVEDGTRGTIKEAIARSIIDALCTLNIKYILTPTRTGRTARLISRFKPKQWIFGFSTNERVCNNLMFSYGVYAFCLEEGFDERDIIRLIKGLGLVESDDIVLMTEGKPIEKTMGTNSIKIFQIA

SEQ ID NO: 21667 - protein, 685 aa, Pyrococcus abyssi
MILVIAEKPNVARKIAGALSERRPIRKTIFGVPYYEVFRDGKKLIVASAVGHLYGLAPKQDFFGYPIFDIEWVPVYIAEKNKDYAKDYIKALSVLAKRVKEFIVACDYDTEGEVIGYTALKYACGVDPSRAKRMKFSALTKRDLLNAWRNLEPTINFGMANAGIARHVLDWYWGVNLSRALTHAIKRASGKWVVLSTGRVQGPTLKFLVEREREIQSFVPKPYWVIKLVIEKNGQKLVANYEKDKIWSEEEAKKIVTEVKKSKARVSNIEVKRQKRNPPVPFDLGTLQREAYSAFGFSPKKTLDIAQSLYEKGFTSYPRTESQKLPKNLNFRLIIQNISRMPQYRPYAHLLLGMPELKPVEGKKEDPAHPAIYPTGEIPGPGDLSKDEEKLYDMIVRRFLALFMEPAVRESVKVTILAGPHKFMLSGARTVKQGWLSVYGKYIKFDEVTLPEFFIGERVRVLQVRREKKKTKPPARYSPAAVIKKMEDLGIGTKATRAQILETLYQRGYIEGKKSIKVTPLGMKVIETLEKYVPEIISVELTREFERKMDLIMQGKLTKEEVIEEAKVKLTKILEEFKKRELEIGLELARIVVGDVKDEIKEEKPIVVGKCPKCGGDLIVKYNKKTGKRFVGCSNWPKCDVTYPILQRGEIIPTNKTCCNGAPVVIIRDKGRDIEICLDIKCKKW

SEQ ID NO: 21668 - protein, 1112 aa, Pyrococcus abyssi
MDREEIIERFLRFLREYAEEGEEPLYIGKIKDLLAITPKRSIAINWMHLNSFDPELAEEVLENPEECILAAEDAIQIILKEDIMREDVPRIHARFYNLPKTLMVKEIGAEHINKLIQVEGVVTRVTEIKPFVSSAVFVCKDCGHEMVVQQKPYEGFVAVKKCEKCGSKNVQLDVEKSKFVNFQMFRIQDRPETLKGGQMPRFIDGILLDDIVDTAMPGDRVVVVGILRVVQEKREKVPTFKKVIEVNYIEPVSKEIEELEITPEEEQKIRELAKRKDIVDAIVDSIAPAIYGYREVKKGIALALFGGVPRTLPDGTRLRGDIHVLLVGDPGVAKCVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHNSQLLRYIANLAPRAIYTSGKSSSAAGLCVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHNTAAVVRDEFTGGWVLEAGALVLADGGYALIDELDKMNDKDRSVIHEALEQQTISLSKAGITATLNARTTVIAAANPKQGRFNRMKRISEQINLPPTLMSRFDLIFVLVDEPDEKIDSEIARHILRVRRGESEVVTPKIPHDLLRKYIAYARKNVHPVISEEAMEEIEKYYVKMRKSVKKSSEEEIKPIPITARQLEALIRLSEAHARMRLSPIVTREDAREAIKLMEYTLRQIAVDETGQIDVTILEVGQSARKLSKVERILDIIEKLEGTSEKGAKIDDILEEAKKFGIEKQEAREILEKLLEQGQIYMPENGYYRTV

SEQ ID NO: 21669 - protein, 686 aa, Pyrococcus abyssi
MAEKLIPVVCPWCSVGCRLYIVSVDGYPRKIEFDYNPKTPNKGKLCPKGVSSYQHYVHPDRLKKPLKRVGEKGEGKFEEISWEEAIEIIAKKFKEILESHGPEALAFLGSERCSLEDNYLLQKLARALGTNNVEFAGRLCQSSNFVARSKIFGGPAQTNPFDDIVKSKVILIWGYNPAATNPVLFGQYFEKAILDNGAKLIVVDPVKTETAKYAHIHLQPYPGTDLAIALAMLHVIIKEELYDKDFVAERVNNFDALARAVEKYTPEWAEKISGVPASLIHEAAVLFATGGNATVVLNEGINQHANGSITAMAISNLIAITGNIGKEGVFSGVIPGAHCGLCAAVPGVNCAQLPGPVPLNEETAKKFSELWGFEVPSKPGLHYQAIFDAMLEGKIKGIYIMGQNPARSLANSSKIEEALKRAFVVVADIFPTETTKYADIVLPAAAWYEKTGTVITQNRRVMRSFQAVKPPGEAKPDWEIIVMLAKSIGLGEYFNYSSVDDVLREINNVIPALKGATPERLAKNLEGCMYPCPDENTETPRLFLKGFPTKSGKAELIPVEWKPPGEVPDEEYPFWLTNFRLVGQFHTGTMSNRTKSLKKRWPGPYVMINERDAKRLGIRSGDLVRVETRRGSLVARAEVTENIREGVVAMPWHWGFNYLTKDDAIDEFSKMPELKTAACRISKVEG

SEQ ID NO: 21670 - protein, 422 aa, Pyrococcus abyssi
MVNCTSDYCVKDISLAPEGMKKIDWVSRFMPVLQHIRREFEEKKPFKGVRIAATLHLEMKTAFLLLTLKAGGAKVSAAASNPLSTQDDVVAALAKEGVKVYAIRGESKEEYYEFMNKALDIRPNIIIDDGADMVSLVHTERKELLDEIWGASEETTTGVIRLRAMERDKVLRFPVIAVNDSYMKYLFDNRYGTGQSTWDGIMRATNLLVAGKNVVVVGYGWCGRGIAMRARGLGATVIVVEVDPIKALEARMDGFLVMSMKEAAKIGDIFVTATGNIKCIRREHFELMKDGAIMANAGHFDVEIWKPDLEELAVEISNPRPNVTEYKLKDGRRLYLLADGRLVNLVAADGHPAEIMDMSFALQAKAAEYIKENHERLEPRVYVLPREIDEMVARIKLQSMGINIEELTEEQKKYLESWQHGT

SEQ ID NO: 21671 - protein, 483 aa, Pyrococcus abyssi
MEFYWGVVQSAFQFEMGDPYRRNLDTRSDWWHWVRDPYNIKNELVSGDLPEEGINNYELYEIDHRLAKELGLNAYQLTIEWSRIFPCPTYSVEVEVERDGYGFIKSVKIRKEHLEKLDELANKREVRHYENVLKNLKKLNFTTFVTLNHQTNPIWLHDPIEVRVNIEKARARGWVDERAIVEFSKFAAYVAWKFDKYVDFWATFDEPMVTAELGYLAPYVGWPPGILNPKAAKSVIMHQIIAHARAYDSIKKFSDKPVGVILNIIPAYPLNPRDSKHVKAAENYDLFHNRLFLEAVNKGKLDIDINGEYVKVPHLKRNDWIGNNYYTREVVKYVEPKYKELPLVTFVGVEGYGYSANPNSISPDNNPTSDFGWEVYPKGLYDSTAEAYEYSEMVFITENGIADSKDILRPRYIVDHVKEVKRLRENGINVLGYFHWALTDNYEWAMGFKIRFGLYEVDPITKERIPRRKSVETYKKVVKEGIE

SEQ ID NO: 21672 - protein, 259 aa, Pyrococcus abyssi
MEGVYKVRIGKPEKGYVVLVHGLGEHIGRYEKFIQELVKNGFCVVGFDWPGHGKSKGKRGHTSVEEAMKIIDEIISEIGEKPFLFGHSLGGLTVIRYAEERGEKIKGVVASSPALAKSPRTPGFMVAIAKILGRILPSVSFSNGIDPELLSRNPERVKRYVEDPLVHDRVSAKLGMSIFKNMEEAHRKAEKIKVPILILVGSGDVITPPEGAKRFYERLKVEDKKLVEFPGAYHEIFEDPEFGKEFEETIIKWLVEHVP

SEQ ID NO: 21673 - protein, 339 aa, Pyrococcus abyssi
MPSLIVVGGQWGDEGKGSIIAYLALHDEPEIIARGGVGTNAGHSVFINGKKYAVRQLPTGFMQRKARLLVGAGVLVDPEVFFHELEHLKEFNVKDRVGIDYRCAIIEEKHKELDRTNGYLHGKIGTTGSGCGPANADRVMRKAKQAKDIKELEPYLTDVAAEINDALDEGALVLVEGTQGFGLSLYYGTYPYVTSKDVTASSVAADVGIGPTRVDDVIVVFKSFPTRVGAGPFPTEMPMEEADRLGLVEYGTVTGRRRRVGWFDFEMARYSARVNGATMLAITMLDKYDKEAFGVTDYDKLPRKAKEFIEEIEERVGVPVGLIKTGPELEHIIDLRENI

SEQ ID NO: 21674 - protein, 330 aa, Pyrococcus abyssi
MRILMVGHYPPHRGGVARHLKEVVERLRRRHSVDVLTYGTVATDVYSVKVPNVFGLRGISFSFLASKKIVELHEERNYDLIHAHYVGTTSFAGVLAKRKLGIPLVVTAHGSDLEFMSKLPLGRYFVKASLREADAVTAVSHFLAKRAISLGAKSVEVISNGVSTCGDRVSKKYIVFLGKVSKYKGIDEFLELARRFPELEFLIAGEGNLRELPSNVKFLGYVNPDDVLSRALALVLPSKREGFGMVILEANSFSVPALGRKVGGIPELIRDGKNGFLFDSIDEAEKFLRVLLDLKVNAKVGALGKRVASLYSWDDVAIRYERLYRRVLER

SEQ ID NO: 21675 - protein, 317 aa, Pyrococcus abyssi
MKVLVTGGAGFIGSHLVDRLMEDGYEVRVLDDLSAGSLENLNRWLENENFEFIRGDMRDYKIVKEAVDDVEVVFHLAANPEVRISSQSPELLYETNVLITYNLLQAIRESNVKFLVFTSSSTVYGDANVLPTPESYGPLEPISVYGGAKLAAEALISGYAHIFGFRALIFRLANIIGKRSNHGVIYDFINKLKRNPNELEILGDGKQRKSYLHVSDTINGILHIFEYFKRQNKIFDVYNLGNEDWITVKEIAEIVSEEMGLSPKFKFTGGVDGGRGWKGDVKFMLLSIEKAKKTGWRPKMNSYEAVRRTVRELLGVL

SEQ ID NO: 21676 - protein, 332 aa, Pyrococcus abyssi
MKVLIMAGGYATRLWPLTKDKPKPLLPVGIKTILDFIMEKVLELNVDEVYISTNKFFEHKFKPYAEKYGVDLIIEDTYREEEKLGTIGAIKNALDSLGLDDYLIIAGDNIFSLSLRDFVSKFTGKPLIAVYDVGDLELAKRYGVVILEGNRVVKFIEKPQEPPSTLISTGIYALPRDVMGMIDEYLKYGNKDAPGYFIQWLIERGIEVYAYKFDDFWYDIGSADSYLESLKMLMKESYIGDIKVSPYSKIIPPVVILDGTRIEGRSIIGPFAYIGRNCLIENSDVSDSIIFDSTVIRNSTIWRSIIDEKCEIRNLELKKSIVGGHAKIQRGD

SEQ ID NO: 21677 - protein, 2122 aa, Pyrococcus abyssi
MPVEKVMKRDGRIVPFDESRIRWAVQRAMWEVGVRDERKLDEVVKNIVKRINELYDGKIPHIENIQDIVELELMRAGLFEVAKAYILYRKKKAEIREEKKRILNKKELDEIDKRFSINALRVLASRYLKRDENGNIIESPRELFERVSILAVIPDLLYDERVFDKDGNYKQDLKRVEYYLENFEKFDGKYSIGKYKLNKYHFERMVNLYRELAEKGKMKVSIDEFLSMLERGEFDKYEKEIEEYFKLMTNQVFMPNTPALINSGRPLGMLSACFVVPIEDDMESIMKAAHDVAMIQKMGGGCIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHNTGLNFSKLRPEGDIVGTTTGAACFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSNSGPVSFMHLIDAVSDVIKQGGVRRGANMGILEIWHPDIEKFIHAKEKNIGTNVLSNFNISVGIWEDFWEALKEGKKYPLINPRTGEVVKEIDPKTLFEELAYMAWAKADPGVIFFDIINRRNVLKEAKGGPIRATNPCVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHNCGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSIEAAKKRGTFPLYEKTGYPKGELPVEGFYHPEIWNLPWDKLVEEIKKYGVRNAMVTTCPPTGSVSMIADTSSGIEPIFALVYKKSVTVGEFYYVDPVFEAELKRRGLYSEELLKKISDNYGSVQGLEEIPEDMRRVFVTALDIHWLDHLLAQANIQMWLTDSASKTINMINEATVEDVKAAYLIAHFLGCKGVTVYRDGSLSVQVYSVEGEKKRRYKPKPSEYAKKVLLEIVEKEPWIKNFINVDEILNGKRQELNFSLTGLKRETHEVKKVEVKQQNNKIPEEKIKELLGVVYCPVCYEREGKLVELRMESGCATCPVCGWSKCVIS

SEQ ID NO: 21678 - protein, 370 aa, Pyrococcus abyssi
MNYDALIIGGGPVGNYLASLLAGKMSVAVVERKGAFGGKACTGIIGAENYESLGLPDKAILNAFKGAFFISKTKVFEIHRQVPQAYLVDRKVLERELAKRAIKRGADYYLATNFVGFKDGKAILQHLDSRFEIKAKYYVGADGVNSKVAQEIGAKTRGEVLRGWELEVLGNFRREWVEVWVNKDINPEFFFWVAPINEEEARIGTFGDVESLAKFLKVRRINPSNVLEIKSGAVVLGWRSPWVKDNVALVGDAALHIKPTTAGGIVFGSYCARALAKAILNGNLAEYEKNCSWVKEQVKFGLRIRKVFKSLTQKEIEEIFEVLGSEDARKLIIEKADFDDHVKTAKALLRNPRLLARLIRIAPIILRTLL

SEQ ID NO: 21679 - protein, 429 aa, Pyrococcus abyssi
MIEPRDELGTATTDSAQKILLLGSGELGKEIAIEAQRLGVEVIAVDRYANAPAMQVAHRSYVGNMMDKDFLWSVVEREKPDAIIPEIEAINLDALFEFEKEGYFVVPNARATWIAMHRERLRETLVKEAKVPTSRYMYATTLDELYEACEKIGYPCHTKAIMSSSGKGSYFVKGPEDIPKAWEEAKTKARGSAEKIIVEEHIDFDVEITELAVRHFDENGEIVTTFPKPVGHYQIDGDYHASWQPAEISEKAEREVYRIAKRITDVLGGLGLFGVEMFVKGDKVWANEVSPRPHDTGMVTLASHPPGFSEFGLHLRAVLGLPIPGEWVDGYRLFPMLIPAATHVIKAKVKGYSPRFRGLAKALSVPNATVRLFGKPEAYVGRRLGVVLAWDKDVQEAKKRAEMVAHMIELRTRSSDWHDQNYEKRKHLL

SEQ ID NO: 21680 - protein, 334 aa, Pyrococcus abyssi
MLTYAQAGVDEEKTARALREIIRTARETFKLRKGKVGEPGDIGHYAALLDFGNFYLAMTTDGVGTKVLVAEAVGKFDTIGIDMIAMNVNDLLCVGAEPLALVDYFAVKEPNEEVFKQVAKGLYKGAEEAGVAIVGGETAVMPDLINGYDLAGTAIGIVEKGKVITGERIRPGDSVIGISSSGIHSNGLTLARKLLIPKYGLDYEYEGRKLWEWLLEPTRIYVRPILELINSVEVHGLAHITGGGLLNLKRLTNYGFELEMPPIEGIFKLIHENGVPLDEMFRVFNMGVGFIVVVPQEEKEEALEILSRHYKSYELGNVTRELGKIKVKNYGITL

SEQ ID NO: 21681 - protein, 240 aa, Pyrococcus abyssi
MELKGKVALITGASRGIGRAIAIELAKRGVNVVINYRSNEEEAKKTEELCRQYGVETLLVKADVSNREEVREMVKKVIDKFGRIDILINNAGILGKTKDPLEVTDEEWDRVISVNLKGAFIVTQEVLRYMKKGKIVNIASIAGKDGGTVGPHYAASKGGLIALTFNLARHLAPNILVNAVAPGPVDTDMLSSEMKEMLKKLSLTGDIAKPSEVAHAVIFLLENDHITGEVIDVNGGRLMD

SEQ ID NO: 21682 - protein, 618 aa, Pyrococcus abyssi
MEKLKRFLPEDQYEKLAAINNPYLHEFLAEWIEWLKPSKVFVCTDSPEDEEYVRWKALYYGEEKMLEMPRHTVHYDNYYDQARDKANTKLLVPKGVTLPFLNTMDREEGLKEIREIMKGIMKGKELFICFFVLGPRNSIFTIPAVQLTDSAYVAHSEFLLYRKGYEEFKRLGPTKNFLKFVHSAGELDERKTSKNLDKRRIYIDLVDETVYSANTQYGGNTIGLKKLAFRLTIQRAVREGWLSEHMFLMRVNGPNGRKTYFTGAYPSMCGKTSTAMIPWENIVGDDLVFIKNVDGTARAVNVEIGVFGIIEGINEKDDPIIWQVLHSPVEIIFSNVLVKDGKPYWNGMGIEIPDEGENHSGKWWRGKRDKEGNEIPPSHKNARFTVRLEAFPNLDKEALENPCGVEVGGMIFGGRDPDTWPPVREAFDWEHGVITMGASLESETTAATLGKEGVRAFNPMSILDFLSVHLGDYIRNYLEFGRKLKKKPKIFAVNYFLRENGKWLNEKLDKAVWLKWMELRVHGDVEAIETPIGYIPKYEDLRELFKQVLNKEYKKEDYEKQFKIRVPELLAKIDRIWNIYEPIGNIPEELFKQLEEERERLLKAREKYGDYISPFSLL

SEQ ID NO: 21683 - protein, 485 aa, Pyrococcus abyssi
MGKFAKKLERAIRGYTFDDVLLIPQATEVEPKDVDVSTQITPNVKLNIPILSAAMDTVTEWEMAVAMAREGGLGVIHRNMSIEEQVEQVKRVKKAERFIVEDVITISPEETVDFALFLMEKHDIDGLPVVENEKVVGIISKKDIAAREGKLVKELMTKDVITVPENIEVEEALKIMIENRIDRLPVVDKEGRLIGLITMSDLVARKKYKNAVRDENGELLVAAAVSPFDIRRAIELDRAGADVIVVDTAHAHNLKAIKAMKEMRQKVDADFIVGNIANPKAVDDLTFADAVKVGIGPGSICTTRIVAGVGVPQITAIAMVADRAQEYGLYVIADGGIKYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIKELKEKGEFVIITSAGLRESHPHDIIITNEAPNYPLEK

SEQ ID NO: 21684 - protein, 398 aa, Pyrococcus abyssi
MVLMGKLDWIKEELEELKKKGLYVTIRVLQSAQGPWVVVNGKRVLNMCSNNYLGLAAHPKIKEAAIRAILDYGVGAGAVRTIAGTMELHVELEEKLAKFKKREAAILFQSGYNANLGAISALLRKGEDGIFLSEELNHASIIDGMRLSGAPKVIYKHLDMDDLKKKLEENKDKKKKIIVTDGVFSMDGDLAPLPEIVELAEQYDAIVYVDDAHGEGVLGSHGRGIVDHFNLHDKVDFEMGTLSKAFGVIGGYVAGPEEAIEYLKQRARPFLFSSAMNPPDVAAAIAAVEILQKSDDLVKKLWDNTHFLQKGLRDLGYDLGNTKHPITPVMLYDEKLAQEFSRRLYEEYNIFAQAIVYPTVPLGTARIRLEPSAAHTKEDLKLVIDAFEDLGKKTGFLK

SEQ ID NO: 21685 - protein, 282 aa, Pyrococcus abyssi
MFVIGSGAKHLEEEISRHGNLINVEIKKFPDGEKYVRVLERGKEAIVIQSTYHPQDENLIEALLLGDALSEAGFKKLKIVIPYLAYSRQDRVTKEGEPISVRAIMKMLGLYYDELYVFDIHNPKTLEHFPGIAKNIYPAEAIANYFKDKLGEGLILAPDKGALERAKRVAEVLGLEYSHFEKERISPTEVRMKPVDVDVNGKNVLIVDDIISTGGTMIKAANILRELGAKEIFVVATHGVFAEGAIERVSKAVNELAVTNTIPTEVSKISIVDYIVKLGEKE

SEQ ID NO: 21686 - protein, 419 aa, Pyrococcus abyssi
MKAVVLAAGKGERLRPLTDDRPKPILKVANKPIIEYILENLDPFVDEFIIIVKYMKEKIIETLGDEFHGKPITYVSQVEEEGTAKAIYSAKDYIEEEEFFAINGDIYFEQEAIRGLLHVYKKTKANAALVVKKFDDLSQLGMVKTEGGYVREIVEKPGNVGGLANLGIYIFNPDVFEFIERTQESERGEYEITDTINLMISDGRKVAYFEYSGFWSDIGRPWDLLEVNEYILKTKLKHDIRGTVEEGATIIPPVEIGEGTVVRSGSYIIGPVKIGKNCRIGPNCFIRPYTSIGDNCHIGNAVEIKNSIIMDNSNAPHLNYVGDSIVGENTNLGAGTITANLRHDNRTIKVEIKGKLEDSGRRKLGAIIGHNVKTGINVTIYPGRKIGSGALVGPGVIVDKNIPPNVLVVAKQEKIVKEI

SEQ ID NO: 21687 - protein, 430 aa, Pyrococcus abyssi
MTMENPYEIVAVIAREILDSRGNPTVEVDVHTPISMGRAAVPSGASTGTHEAVELRDGGKRYHGKGVRRAVENVNKIIAPELVGMDVRWQREIDRLLIELDGTENKSNLGANAILAVSLAVAKAAANALELPLYQYLGGVNAYVLPVPLSNVINGGVHAGNDLDFQEFMIMPIGANSFREAIRWVSETYHVLKKVIAEKYGKNAVNVGDEGGFAPPMKEVTEPLDVLIKAIEEAGYKPGEEIALALDAASSEFYKDGKYIVSGKEYTREELLELYKELTSTYPIVSIEDPFHEEDWEGFVMITRELGKKVQIVGDDLFVTNPKRLKKGIEMGAANALLLKVNQIGTLTEAMDAAYMAFRAGYGVVVSHRSGETEDATIADLAVALNAGQIKTGAPARSDRNAKYNQLIRIEEELEGVAVYAGKNFRKVFF

SEQ ID NO: 21688 - protein, 771 aa, Pyrococcus abyssi
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVDIETLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSLYPSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 21689 - protein, 219 aa, Pyrococcus abyssi
MVSMDLYERWKRTVEMLEREGIIRSLEVKEAFLKYPRYMFVEDRYKSYAHIDEPLPIPAGQTVSAPHMVAIMLEIAKLKEGMNVLEVGTGSGWNAALISYIVKTDVYSIERIPELVEFAKRNLERAGVKNVHVILGDGSKGFPPKAPYDVIIVTAGAPKVPEPLVEQLKPGGRLIIPVGSYHLWQELLEVVKKKSGEIKVRNHGGVAFVPLIGEYGWRE

SEQ ID NO: 21690 - protein, 214 aa, Pyrococcus abyssi
MPEILKIKPTRMELLKLKRRVKLAERGHKLLKEKQDALIMEFFTIYDEALSLRRELIKKMEEAFEALRRAQVDVGSLRLKEISIGVKPNEEIEIRTRNIMGVRVPLIEVPELKRKASDRGYAFISTTSTVDVAAEKFEEVLELAIRLAEVEESLKRLGKEIEKTKRRVNALEYIIIPRMKNTIKFIEQHLDEMERENFFRLKRVKAILEARQSM

SEQ ID NO: 21691 - protein, 465 aa, Pyrococcus abyssi
MMEMSKEYSTISKIYGPLMIVEGVKGVAYGEVVEIETESGEKRKGQVLDARENLAIVQVFEGTRDLDVKTTSVRFTGETLKVPVSMDMLGRIFNGIGKPIDGGPEIIPEDRRDVHGAPLNPVARAYPRDFIQTGISAIDGMNTLVRGQKLPIFSGSGLPHNQLAAQIARQAKVLGEEESFAVVFAAMGITYEEANFFKKSFEETGAIERAVLFLNLADDPAIERIITPRMALTVAEYLAFDYDMQVLVILTDMTNYCEALREISAAREEVPGRRGYPGYMYTDLATIYERAGRIRGKKGSITQMPILTMPDDDITHPIPDLTGYITEGQIVLSRELHRKGIYPPIDVLPSLSRLMKDGIGKGRTREDHPQLAQQLYAAYAEGRSLRDLVAVVGEEALSETDKKYLEFADRFEREFVAQGYYEDRSIEETLDLGWELLSILPESELKRVKKEMIMKYHPKYRKRSS

SEQ ID NO: 21692 - protein, 1017 aa, Pyrococcus abyssi
MVAKGRIIRVTGPLVVADGMKGAKMYEVVRVGELGLIGEIIRLEGDKAVIQVYEETAGVRPGEPVIGTGSSLSVELGPGLLTSIYDGIQRPLEVIREKTGDFIARGVTAPALPRDKKWHFIPKVKVGDKVVGGDIIGEVPETSIITHKIMVPPGIEGEIVEIAEEGEYTIEEVIAKVKTPSGEIKELKMYQRWPVRVKRPYKEKLPPEVPLITGQRVIDTFFPQAKGGTAAIPGPFGSGKCVDGDTLVLTKEFGLIKIKDLYKILDGKGKKTVNGNEEWTELERPITLYGYKDGKIVEIKATHVYKGFSAGMIEIRTRTGRKIKVTPIHKLFTGRVTKNGLEIREVMAKDLKKGDRIIVAKKIDGGERVKLNIRVEQKRGKKIRIPDVLDEKLAEFLGYLIADGTLKPRTVAIYNNDESLLRRANELANELFNIEGKIVKGRTVKALLIHSKALVEFFSKLGVPRNKKARTWKVPKELLISEPEVVKAFIKAYIMCDGYYDENKGEIEIVTASEEAAYGFSYLLAKLGIYAIIREKIIGDKVYYRVVISGESNLEKLGIERVGRGYTSYDIVPVEVEELYNALGRPYAELKRAGIEIHNYLSGENMSYEMFRKFAKFVGMEEIAENHLTHVLFDEIVEIRYISEGQEVYDVTTETHNFIGGNMPTLLHNTVTQHQLAKWSDAQVVIYIGCGERGNEMTDVLEEFPKLKDPKTGKPLMERTVLIANTSNMPVAAREASIYTGITIAEYFRDMGYDVALMADSTSRWAEALREISGRLEEMPGEEGYPAYLASKLAEFYERAGRVVTLGSDYRVGSVSVIGAVSPPGGDFSEPVVQNTLRVVKVFWALDADLARRRHFPAINWLTSYSLYVDAVKDWWHKNVDPEWKAMRDKAMELLQKESELQEIVRIVGPDALPERERAILLVARMLREDYLQQDAFDEVDTYCPPEKQVTMMRVLLNFYDKTMEAISRGVPLEEIAKLPVREEIGRMKFEPDVGKIKALIDKTNEQFEELFKKYGA

SEQ ID NO: 21693 - protein, 103 aa, Pyrococcus abyssi
MKVVVMGDSDTVTGFRLAGVHEAYEFDFSELSIERARNKLKELVERDDVGIILITERLAQRIGDLPQVNLPIILQIPDKFGSIYGEELLREIVRKAVGIEIKR

SEQ ID NO: 21694 - protein, 300 aa, Rhodobacter capsulatus
MADRRDHRIIDGKAVQQRLLAGIRAELEAAAETHPVGRLVSISIGPSPEIEVYVRNQARAAATAGLPFEQVVWEASATQEACKRKIAALNDDPSVLGIILQRPVPAHIHVRSLQSAIHPLKDVEGMNPASIGNIVYNDIALAPCTAAAAVEMVRATGLPLPGLEVVMIGHSEIVGKPVAFLLMAEGATVTVCHHMTRSVAMHSRRADVVIVAVGKAHLIGPEMIKPGAAVIDIGINQVTDAAGKVRILGDVDTEAVREVAGWITPVPGGVGPVTVAMLMRNALTAHRRQVAAGWLEAAKA

SEQ ID NO: 21695 - protein, 656 aa, Rhodobacter capsulatus [sequence omitted]

SEQ ID NO: 21696 - protein, 308 aa, Rhodobacter capsulatus
MTRSSIILGAPIQSGTHQPGCVMGPASLRTAGLIASLTALGWRIEDQGDLSIGPQAAVAHANPAVHHLAETRAWIALLAARAEAAAAQSDLPVFLGGDHSMSAGTMAGVAAHAARLGRPLFVLWLDAHPDLHSLDTTESGNLHGTPVAYACGLGDFAAYPPLAHAIDPSRLCMMGIRSVDPAEHRRILEHGIEVHDMRAIDETGVVAPLRAFIDRVKAANGLLHVSFDVDFLDPGIAPAVGTTVPGGATFREAHLIMEYLCDAGVVTSLDLVELNPFLDERGRTASLICDLAASLFGRRVLDRQTRSF

SEQ ID NO: 21697 - protein, 334 aa, Rhodobacter capsulatus
MARLAINGLGRMGKLLLRRLIDLGRGPEIVLLNDAMGDAETHALLLEFDTVHGRWPTPVAATETGLQIAGQRIRLTREKTLEALPLAEIGVDLVLDCTGQFKTAAKVQPYFDAGVRKVVVSAPVKDTGALNLVYGVNHVLYDGSQRLITAASCTTNCLAPIVKVIHEALGIKHGSITTLHDVTNTQTIVDRPAKDLRRARSALMNLIPTTTGSATAITLIYPELKGRLNGHAVRVPLLNASLTDCVFELDRPTTVAEVNSLLQTAAEGGLNGILGFETRPLVSSDFTNDPRSAVIDGPSTMVVNGTQLKLYAWYDNEWGYVCRMADIARMVAGS

SEQ ID NO: 21698 - protein, 724 aa, Rhodobacter capsulatus
MTHALSPRQQEDIALGSPQMTALRGLFLICLHHGVTLPVTEIPALEEGSIAPRLEATFQRAGFRSRQISGGTWRTAKGLGSAYPALCEGKDGRWFILAHTVDLPAGPHAAILDPAREGEGILFLPQAEFEARWSGRLILARLRKTELSARRPFGLGWFMPALLEQRALFGGVAVAVVAGNLIAFALPFLMQVMIDSVISSHAWNTLAAVLSVYVFLVLFDAAFSYVRQRLMQICGGRLDARIGAAVHAHLLSLPLSMFETTAAGVLARNMQLTEKIRHFLVGRLFQTMLDAALLPVLLTLLALLSGLMTLVVLGFALTIAGLLAVFLPALQRRLSALYDAEAGRQAHLVETLHNMRTVKALVLEGTRRGLWETALARTIRSQWQVGELSATVSALTSLMERLMQVAVLGLGAEQVLSGQISVGTLVAFMMLSGRVTGPLVQIVGLINEWQEAALAVRTLRGVMDHPPERGPEVRPIRPPLRGAIRIEDLCFTYPGTATPALDHLTLDIAAGQVIGIVGRSGSGKTTLTRLLQGIGSAQSGRILYDGNDARHIDLDHLRRSVGIVLQENVLFRGTLRENIALARPDASHEAVLRAATLAGAAEFIDRLPQGLDTPVEEGGANLSGGQRQRIALARALLADPPILILDEATSALDPESEAVVNRNLAAIAQGRTVIVVSHRMSSLAHSDAILVLDRGRIEDFAPHAVLLARSPTYRHLWLQQAGQT

SEQ ID NO: 21699 - protein, 1085 aa, Rhodobacter capsulatus
MHVVFRESHGLEETAVPTDLGQRPADLVVLSLSDSDLGAFAAGWKRAGGRLPSLRLANLVALKHPISVDTYVENTLSGAKGILIRLIGGEAYWPYGLASVQDLCRRKGIALAVLPADGRADDRLDALSTLPVSTLRRLKELCDAGGAVAAQAALAQLALASGLYAPPVPGDKRLPDWGFYDPAAGVIPAPEGDGPLALVSFYRSYLTAADTAPIDALIHGLRARGFAACGLFAPSLKSEGLGDALQARLDGRAPALVVNATAFSAQGADGTTPFDRYDVPVFQVALSTARKRDWALADRGLSPADLAMHVVLPEVDGRLFAGVVSFKAPEPRDPDLEFSRFAHRPDPARVEAALDRICGWHRLRQTPAADRKLAVVLSTYPGRSWQMAHAVGLDALASTEALLAQLATEGYAIAPGAALETLTTARLTWPLSDYLTALDTLPEKLRADLTAAWGPPEADPACADGAFHFAALRRGAALIALQPERGDVQTRDGEYHDLSRVPRHGYVAFYLWLRALGLDALVHMGAHGTLEWLPGKAVALSESCWPEALCPLPVIYPFIVNDPGEAAQAKRRLSAVTLGHLPPPLSQAAVPEGMARLERLLDEYSTADGLDPARRDRLIADIRDEARASGVEDDLGIPATASAAEAITRIDRFVCDIKESLFGDGLHVLGQGACGAAEQAGLSAALAGKRVPPGPSGSPARGRADVLPTGRNLFSVDPRAVPSRAAHAQGVKLAEELLRKHLQDHGDWPRGLVVDLWGSATMRTAGEEFAMALHLAGLKPVWDEGAARVSGVEVIALALLGRPRIDVTLRVSGLFRDIFPGLAQLFETGAEALATREETPEDNPYRAAAPRVFGPRPGQYGLNMGPALEAFTPEARARAGEAWLAASSYTIDKKGEIRSDRAGLEARLMGADSFVHAQDLPESDILLASDYAAHEAGFAAALARLGAEAPALYHLDATDPTRPRARSLPEEIARVVRARAANPAWADGMMRHGFRGGAEIAATLDHMAAFAHLAQVVPAHLFDLYHEATLGRDEVRDFLARENPEALAAMRDLFQRLAEAGLWLTRRNSIAASLEERLEARQPEG

SEQ ID NO: 21700 - protein, 252 aa, Rhodobacter capsulatus
RLTGKRALITGAARGIGRAFAEAYLREGADVTIGDINLEGARKTAAEIGCAAVHLDVTDQASIDAAMAVMRAGGGIDILINNAAIFTAAPIDEITRADYDRVFAINVAGTLFTLQAAAREMIAQGRGGKIINMASQAGRRGESLVAVYCASKAAVISLTQSAGLNLIAHGINVNAIAPGVVDGEHWDGVDAFFAKYEKKPLGQKKKEVGASVPFGRMGTAADLTGMAIFLATPEADYIVAQTYNVDGGNWMS

SEQ ID NO: 21701 - protein, 224 aa, Rhodobacter capsulatus
MFDLIIFDCDGVLIDSEIISAQMLIAELALNGVTIDLDYVATHFLGRSYPTVLQQVRRDFALDLPTDFETRYRERLLAAFERDMQVMPGVAALLDRLTLPWCVATSSSRPRAERSLEIADLSQRVGSRLYTASQVERGKPAPDLFLLAARQMGADPARCLVIEDSLNGIRAGLAAGMTVWRFTGGSHLRGRDLTAPEDARPALDFDDFGQLGALLPGAFDGKTP

SEQ ID NO: 21702 - protein, 465 aa, Rhodobacter capsulatus
MSPAAEAFARLRAGDARRRTEFTVQKRRAVLKRLASEIRAREAEIMAALAADLGKPAVEVRISEIIPILSEIRHTSRHLKAWAGVRRVRPTLSMIGTRATIRPEPKGTVLILAPWNYPLCLALGPLVSAIAAGNAAVVKPSELAPATSALVAKIVAACLPEDLVAVVEGGVETATALLAQPFDHIFFTGSPAVGKVVMAAAAKTLASVTLELGGKSPVILGPDADLKKAARMVAWGKFQNAGQTCIAPDHVFVPRAQEAGFTKALRAEIARMYGARPQASRSFARLIGAKHFERVRGMVTEAVGHGATLITGGEAEAASRYLAPTVLTHVPADAALMREEIFGPVLPVIAYDDLGAVLAGIEAGEKPLALYVFARDRKLIARICAATTSGAVGVNVTLAHFLHLNLPFGGIGQSGLGAAHGRWGFQAFSHEKPVLENRFAVLDPLMPPYGKLSARLARLVQALVG

SEQ ID NO: 21703 - protein, 262 aa, Rhodobacter capsulatus
RFAPSPTGPLHLGHAFAAILAHDMARAAGGRFLLRIEDIDRARAKPQWEAQLLDDLRWLGITWDGPVLRQSDRLPLYRDALERLWQRGLVYSCTCSRRDIEQAASAPQEGAPLGPDGIVYPGSCRDKGRPRPGQALPETALRLRMDLAATETGFEETGPAHRGWHEIRPETMIRAVGDVVLARREMGTSYHLSVVLDDAAQGVTHVTRGEDLFEATCIHVTLQRLLGLPVPVYHHHGLIRDDAGKRLAKRDNARALSKYRAE

SEQ ID NO: 21704 - protein, 480 aa, Rhodobacter capsulatus
IREALTFDDVLLVPAASSVLPSEADVSTRVTRSIRLNIPLLSSAMDTVTEANMAIAMAQAGGMGVIHRNLTVEKQASEVRRVKRFESGIVYNPITLTPEQTLADAKALRERYNVSGFPVVDVAGKVVGIVTNRDMRFATDDATPVHAMMTRENLAMLREPADRDEAMSLMKARRIEKLLVVNADGKLTGLLTLKDSEHSVLHPQACKDEKGRLRVAAASTVGDAGYERSVALIEAGCDLIVIDTAHGHSEGVAKAVERIKLFAPGVQVCAGNVATAEATKALIGAGADAVKVGIGPGSICTTRIVAGVGVPQLSAIMDACSGAGDVPIIADGGIKFSGDFAKAIAAGASCAMVGSAIAGTDESPGEVILYQGRSYKSYRGMGSLGAMARGSADRYFQKDAASDKLVPEGIEGQVPYKGPVATVIHQMVGGLRAAMGYTGHATVASMQGGCQFVRITGAGLKESHVHDVQITRESPNYRIG

SEQ ID NO: 21705 - protein, 323 aa, Rhodobacter capsulatus
TIRAVVRGVGHYLPARVVENAEFEGKLDTTDEWIRSRTGIERRHFAAEGETTSQLAIKAAAAALADAGLSAADIDAIVVATSTPDFTFPSVATMVQAGLGNTNAFAFDVQAVCAGFVFALANANGMILSGQAKRVLVIGAETFSRIMDWADRGTCVLFGDGAGALILEAAEGAGTAADRGILASDLHSDGRYRELLYVDGGVSTNGQSGHLRMQGNAVFKHAVQKLAETAHAALAKAGLTPEDVSWIVPHQANLRIITATAERMGVPMERVVVTVADHGNTSAASIPLALSTARARGQIKAGDLIVTEAIGGGLAWGSVVLRW

SEQ ID NO: 21706 - protein, 403 aa, Rhodobacter capsulatus
MSKIKVANPIVEMDGDEMTRIIWDFIKKKLILPYLDVDLLYYDLGIEERDRTNDQITIDSALKTKEVGVAVKCATITPDEARVAEFNLKQMWKSPNGTIRNILGGVIFREPIICKNVPRLVPGWTQPIVIGRHAFGDQYRATDFHFPGKGTLTMKFVGEDGTVIEKTVFDAPAAGVAMGMYNLDQSIIDFARSSMNYGLLKGWPVYLSTKNTILKAYDGRFKDLFQKVYEEEFADKFKAAGIHYEHRLIDDMVASALKWSGGYVWACKNYDGDVQSDTVAQGFGSLGLMTSVLMTPDGKIVEAEAAHGTVTRHYRQHQAGKETSTNSIASIFAWTGGLKHRAKLDDNAALMNFAQTLEKVCVQTVEDGFMTKDLSLLVGPDQKWLTTMGYLEKVDEYLNKALA

SEQ ID NO: 21707 - protein, 400 aa, Rhodobacter capsulatus
RRVVITGAGTVNALAPDVQGTFAAMAEGRCGIGPLDFPDVERLTIRIGAQVRDFAPESHFDKGKLSLYDRFTQFALVAARQAMAQAGQPQESCDHTRWGAIIGTAGGGNATVNEAYRAVYAEGKNRVHPFTVPRLMGNAAASHLSMEFGLMGPSFAVATACASSNHALGLAFQMIRAGLADGMLAGGAESMLNFGGLKAWEGLRVMSPDGCRPFSASRNGMVQGEGAGVFVLETLEGAKARGAEILAEIKGFAMTSDASDIVMPSREGAARAMRLALADAGLPPEAVEYVNAHGTGTAANDKTEAAALSDIFGAHLPRLPVSSTKAMHGHCIGATGAIELLACLMALNDGVIAPTLGFDAADPDCPLDVVPGTARQARVDTVMSNAFAFGGLNAVLILSK

SEQ ID NO: 21708 - protein, 146 aa, Rhodobacter capsulatus
IVLVGMMGAGKTAVGTALARALRVPFHDSDEEIVRAAQRSVAEIFERDGEPFFRARESEVIERLLSGTPGVVSTGGGAFLSEANRAMIARLGVSVWLQADLELLWTRVKGKTTRPLLRTADPKATLAELIERRYPVYALAQLAVEA

SEQ ID NO: 21709 - protein, 363 aa, Rhodobacter capsulatus
EVVKVELGARAYEVRIGAGLLARAGAEIAPLLRKPKVAVVADATVAGLHLEALRAGLGDVEMVSMTLPSGEGTKSWPHFERVCEWLLAQRVERKDIVVAFGGGVIGDLVGFAAAVLRRGVRFVQIPTTLLAQVDSSVGGKTGINVAAGKNLIGAFHQPSLVLADIGLLDTLAPRDFLAGYGEVVKYGLLGDAAFFDWLEANGPAMAAGDRALRQYAVKRSVEMKAEIVARDETEEGDRALLNLGHTFCHALEAATGYSDRLLHGEGVAIGCALAFELSQRLGLCSQEAPSRVRAHLRDMKMKVELSDIPGELPDAEGLIALMGQDKKVLDGKLRFILARGIGAAFVTSDVPREVLKDLLTEAL

SEQ ID NO: 21710 - protein, 459 aa, Rhodobacter capsulatus
PKGVDYGQGWMKSDWRAKPRVQMPDYPDAAALTAVEAQLGKMPPLVFAGEARRLKADLAKAAKGEAFLLQGGDCAESFTEFSADNLRDTFKVLLQMAIVLTWGAKVPVIKVGRMAGQFAKPRSAPTEIIGGVEYPSYRGDIVNGFEATQEARLPDPNRMLQAYTQAAASLNLLRAFSTGGYADIHRVQSWISGFTDEADAARYREVAERISDAMDFMAAAGVTSETAHQLGKVDFYTSHEALLLEYEEALCRIDSTTGLPIAGSGHMLWIGDRTRQVDGAHVEFCRGVQNPIGLKCGPSTTEEDLKLLMAKLNPQNEPGRLTLIARFGAGKVGEHLPRLIRTVQAEGAQVLWTCDPMHGNTIKSASGFKTRPFDSVLREVREFFAIHKAEATIPGGVHFEMTGKDVTECTGGVRAVSDEDLSSRYHTACDPRLNASQSLELAFLVAEELQDLRVMKKAA

SEQ ID NO: 21711 - protein, 501 aa, Rhodobacter capsulatus
  unsure (1)..(501): unsure at all Xaa locations
SGTEMTMGRDWWRGAVIYQIYPRSFQDSNGDGIGDLKGITERLPHVAALGVDSIWLSPIFRSPMDDMGYDVSDYRDIDPVFGTLADFDALVARAHDLGLKVIIDQVLSHSSDRHPWFADSKRRGPKADWYVWADPKPDGSPPNNWQSVFGGSSWEWSPERGQYYLHNFLISQPDLNLRNPEVQDEMLEVLRFWLDRGVDGFRLDTVNYYIHDGALRDNPPMPPDPTRWPPVSTYDMQDHAHDKNRPENLDFLARMRKLLDQYENRCMVGEIGEVPHRALPLMAEYTSGTAHLHMAYSFDMLGPKFAPAHFRRVLDGFFRAAPDGWPSWSFSNHDVNRHVTRWAGYGDQDAVAKLAISMLASFEGTIGLYQGEELGQTETDLAYEELTDPPGLRFWPENKGRDGCRTPMVWDGTAQGGFSTVKPWLPVKAPRLARNRRRSGGXSRLGAAPYRAVLAFRRASAALRTGRTRFLDLPDPVLGFRRETDTESLTCLFNLGPDPVT

SEQ ID NO: 21712 - protein, 779 aa, Rhodobacter capsulatus
AEILRHLTYSMGKDAGHASLYDWRMALSLALRDHIVGPWFDATRQTYEQGRKRVYYLSMEFLIGRVLEDAAINLGMRAIAREAIEGLGQDWHQVVEDEPDAALGNGGLGRLAACYMESMATLGCAGYGYGIRYEHGLFRQWFDGGRQVETPEDWLKQRHPWEFERPEVCYEIGFKGTVEIVNGKSVWAPAETVIAEAYDMPVIGWQGRWANTLRLWAAKPTTLFDLARFNHGDFAAAAEPEALARTLSRVLYPDDTTFQGKELRLKQEYFLTSAALQDILRRHLTAGLALTDLPDHVAIQMNDTHPAIAGPELIRLLSDVHGMSFEEALEIGVKCLGYTNHTLLPEALERWATYLMGSVLPRHMQIIEAIDAWHLRMNPTRPHYVGIVKHHEVRMGELAFITSHKVNGVSALHTELVKKNLFPELDKLHPGRIINQTNGVTPRRWLRMANPALSRLITGAIGQGWEADLDRLRELDKLSEDKVFRDDFAKAKRANKVALAEWIAQTQGVVVNPDALFDVQVKRIHEYKRQLLNILQTIAEWHVIRSNPTAEVVPRVKIFGGKAAPGYQAAKEVIRLINDVARVVNNDPYVGDRLKIVYPPNYNVSMAERLIPAADLSEQISTAGKEASGTGNMKFALNGALTIGTLDGANVEIRDEVGAENFFLFGLTAEEVTERRKDPEHARHAILKSQPLQDVLQMIAEGRFCPEEPSRYHGLVHNMWHSDYFLVASDFEAYRDAQTEVDQTFAEPDRWWRMAILNTARMGFFSSDRAIRGYMTDIW

SEQ ID NO: 21713 - protein, 716 aa, Rhodobacter capsulatus
ILSAEALALAEGRHDDPFSILGWHQTPEGGRLVALVPGAEHVWAISRETGAEAELQHVTNGLFAGKWEGGRYRLRARNAQSTWDFEDAYAFGPVLGEIDEYLIGEGTHRRLWQVLGAHVIWHEGIRGVHFAVWAPSARRVSVVGNFNIWDGRRHQMRRRGATGVWEIFVPGLMAGEVYKYEILSADGVVQPFKADPVGFGAEHPPQTASQVRELGLHLWGDGAWIGQRQKMQDIHAPISIYEVHLGSWRRVWDQGGRALSYHELAGQLVDYVVEMGFTHIELLPITEFPFDGSWGYQPIGLYAPTIRHGRPEEFAAFVDAAHRRGVGVILDWVPGHFPTDDHGLRRFDGTALYEHADPKEGFHQDWNTLIYNYGRREVKNFLLANALFWLEEYHLDGLRVDAVASMLYRDYSRRDGEWVPNIHGGRENLEAIDFLKEVNAEAYGGAPGIMTVAEESTAFSGVTRPVHLGGLGFGYKWNMGWMNDSLRYFSRDPIHRRWHHNELTFASSYTYSENFILPISHDEVVHGKGSMLGKMPGDGLQKFANLRAFYAYQWAHPGKKLLFMGQEFAQGREWAHQGALDWHLLDDPLHRGMQALVRDLNKLYRDTPALHWGDCDPSGFDWIEADDAEASVYVFERRAPGADPVVVAANLTPLDRTYRIGLPQAGTWCEIFNSDSGYYGGANWGNLGAIEADEIATTRRPFSAEVYLPPLSVVMF

SEQ ID NO: 21714 - protein, 422 aa, Rhodobacter capsulatus
MKPQPNQRLSSQAMAFVLAGGRGSRLKELTDRRAKPAVYFGGKTRIIDFALSNALNSGIRKMAIATQYKAHSLIRHMQRGWNFFRAERNEYLDILPASQRIDESKWYLGTADAVAQNIDIIEDYDVKYVIILAGDHIYKMDYEVMLLQHVLSKADVTIGCLTVPRAEASAFGCMAADKTGRITQFIEKPANPPGLPEDPTHSLVSMGIYVFDWVFLRELLIRDAEDPHSSHDFGHDLIPQIVKYGKAMAHRFSESCVTSGLEHEPYWRDVGTIDAFWQANIDLTEFTPKLDLYDNAWPIWTYAEIVPPAKFIHDEDGRRGSAVSSLISGDCIVSGSEVRNSLLFTGCRSHSWSTVQHVVALPYVDIGERAQLTRCVIDRGVKVPPGLVVGVDPEEDAKWFRRTEGGIVLITQSMLDARAAAL

SEQ ID NO: 21715 - protein, 477 aa, Rhodobacter capsulatus
TAMKRVLSVASEAVPLVKTGGLADVVGALPEALAGQGWEMRVMLPAYRGVLDRLAATTVVWSDPDLFGGPAEVHLGKVGTMEVMALSAPHLYDRAGGPYSDLHGDFGDNAERFAALCWAAAAVAREGAEDWRPDVLHAHDWQGALAPAYLRYAGASLPSLITIHNMAFQGRVGADKMGALRLPREAFHRDGYEFWGDISTLKAGLTTADAITTVSPRYAEELMRGEYGQGLEGVIAARAGVVVGILNGIDDRVWNPETDPECISFSVTNISGKSKNRKALQAEFQLEKKIDEPLVILVSRLTAQKGIDLLPPAVEELVARGGALALLGSGDSWAEDLVRGLAARFPGRVGVRIGYDESLSHRMFAGADAVLVPSRFEPCGLTQLYGLRYGCLPLVSAVGGLADTVIGASPASLAGQAATGVVFHPVDALALRQGMRQLCDLHADRRIWTAMMKRAMKSDLGWSRSAARYAALYERLL

SEQ ID NO: 21716 - protein, 664 aa, Rhodobacter capsulatus
AMKIGPGRAEILGAIPVSGGVNFALFSAHAEKVELCLFDGDQETRLVLPGRAGDVWHGFVPGLVPGAEYGYRVYGPWAPEIGHRFNPSKLLVDPYARALTGPLVWGPSMQGGVGATRPDRRDSAASTARGIVCEIQKPLWDRPTRTWSQTIIYEAHVRGLTMQHPEVPAALRGGYEAVASPPIIEHLKRLGVTALELLPVAAFIDDRFLVEKGLRNYWGYQPIGFMAPDPRYGTRESFRAMVRALHAAGIEVILDVVFNHAGEGDGTGPTVSLRGIDNNSYYRLCEGGRSYVNDTGTGNTLNLAHPMVLRLVMDALRHWVEEMGVDGFRFDLATTLGRASTGEFKELASLISAIRQDPVLNAVKLIAEPWDIGPGGYRLGAFPYPFVEWNDRFRDGVRQFWRGDAGLIPELARRVAGSAEIFDHRGRPATTSVNFLTAHDGFTLHDLVSYAEKRNEANGENNRDGHNANFSQALPDAGAKASRKRAMLATLMLSQGVPMLLAGDELGNSQAGNNNAYAQDNPIGWVDWQTADEGLIAFVSRLIRLRRDHPVLRQTRFLHAKIRAQDGVRDLIWRLPSGAELSSQDWHDAQSRCLCAEVRGAAEGPPGLASGEAMFAVFNAGGATEVHLPDGAWRLLIDTAEPDRPEAPHFAAATCVAAQSVQLF

SEQ ID NO: 21717 - protein, 542 aa, Rhodobacter capsulatus
SMTTHPTRPFEGQKPGTSGLRKKTPVFMQPGYLENFVQSTFDAIGGVAGKTLVLGGDGRYFGVEAAQVILKIAAAGGAARMIVGQGSWLSTPAASNLIRLRKADGGIILSASHNPGGPDEDFGVKYNMANGGPAPEAVTDAIFARTQVIDSYRKLDAPDVNLTMVGESRLGDMVVDVIDPVSAYADMMESIFDFKALRGLFHEGFAMRMDSMCAITGPYAVEIFENRLGAAKGTVVHEQPLPDFGGMHPDPNPTWAHELMAEMMGPDAPDFGAASDGDGDRNMIVGRGIYVSPSDSLAVIAANAHLVPGYAQGLKGVARSMPTSAAVDRVAEALKLACYETPTGWKFFGNLMDAGRVSLCGEESFGTGSDHVREKDGLWAVLMWLNIIAARNMGVAEIMADHWETFGRNYYSRHDYEALPVDQANAMLGDLRDRLSSLKGTQVQGLVVQDADEFSYEDPVDGSISAHQGFRILFEGGSRAVLRLSGTGTEGATLRVYLERYVAGPEGLTEDPQHALAPIIAATEDLVGIKARTGRKGPDVIT

SEQ ID NO: 21718 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGEETSALFNTRGLFRS

SEQ ID NO: 21719 - protein, 657 aa, Rhodobacter capsulatus
MKDLDMAQETRMANAIRALAMDAVEQAKSGHPGMPMGMADVATVLFNRFMKIDPAAPKWPDRDRFVLSAGHGSMLLYALHHLLGYADMDIAQLKNFRQLGARTAGHPEYGHADGIEMTTGPLGQGIATAVGMALAERMKNARYGDDLVDHFTYVIAGDGCLMEGISHEAIDLAGHLGLGRLIVFWDDNRITIDGDTDLSTSTDQKARFAASGWHVQSCDGHAPHEIAAAIEAAKADPRPSMIACRTVIGFGAPNKQGGHDVHGAPLGAEEIAAARAFLDWPHAPFEIPSELTAAWGRVAARGASARANWEARLQNHAARADFIKAEADDTSALPAAIAAYKARLSADKPKVATRKASEMALEVVNATLPHSVGGSADLTGSNLTRSKGMVSVKPGAFAGNYIHYGIREHGMAAAMNGIALHGGLRPYGGTFMAFADYCRPSIRLSALMGVPVTYVMTHDSIGLGEDGPTHQPVEHLASLRAIPNLNVIRPADAVETAEAWEIAMTSKATPNLLVLSRQNLPTLRTTHTAENLTARGAYLLRGPEDRQVTLIATGSEVEIALAAADQLAKEGIRAAVVSAPCFELFAAQPRDYVTKVLGTAPRVGCEAAIRQGWCMLLGPTDAFVGMTGFGASAPAPQLYQHFNITAEALVSEAKNLI

SEQ ID NO: 21720 - protein, 333 aa, Rhodobacter capsulatus
MTVKVAINGFGRIGRNVLRAIVESGRTDIEVVAINDLGPVETNAHLLRFDSVHGRFPATVTTGEDWIDVGRGPIKVTAIRNPAELPWGNVDVALECTGIFTTKEKAAAHLQNGSKRVLVSAPCDNADKTIVFGVNHATLSAEDLVVSNASCTTNCLSPVAKALNDAIGITKGFMTTIHSYTGDQPTLDTMHKDLYRARAAALSMIPTSTGAAKAVGLVLPELKGKLDGVAIRVPTPNVSVVDLVFEAARDTSVAEVNAAIRAAADGPLKGVLGYTDQPNVSSDFNHDPHSSVFHMDQTKVMEGRMVRILSWYDNEWGFSNRMADTAVAMGKLI

SEQ ID NO: 21721 - protein, 354 aa, Rhodobacter capsulatus
MALITLRQLLDHAAEYSYGVPAFNINNMEQGLAIMEAAKAVDAPVIIQASRGARSYANDIMLAKMIEALAAIYPDIPLCMHQDHGNNEATCMTAIRHGFTSVMMDGSLEGDAKTPASYEYNVDITERVSRMAHWVGASVEGELGVLGSLETGQGEAEDGHGAEGVLDHSQLLTDPDQAVDFVKKTQVDALAIACGTSHGAYKFSRKPDGEILAMSVIEAIHKKLPNTHLVMHGSSSVPQDLQDIINEFGGAMPQTFGVPVEEIVRGIKMGVRKVNIDTDCRMAMTGQFRRIAEQNKAEFDPRKFLKPAMDAMRDLCKARLEAFGTAGHASKIKVIPMDDMAKRYASGSLAPKTA

SEQ ID NO: 21722 - protein, 224 aa, Rhodobacter capsulatus
KALIFDVDGTLAETEEVHRQAFNETFAAQGLDWHWSKEDYRTLLRTTGGKERMAKHRETVGSGPSDVDIAALHQAKTQRYVEIIASGQVGLLPGVAALIDRAKASGLRLAIATTTTRANVDALIAATFRRPAGDIFEVIAAGDEVAQKKPAPDVYLLALQGLGLPPAACLAFEDSRAGLASAKAAELRVVLTPSEYTRGDDFTAADWLIPDLTRAATKAIPELP

SEQ ID NO: 21723 - protein, 257 aa, Rhodobacter capsulatus
MSLKGKTAVITGSNSGIGLGVARELARAGADVVLNSFTDRPEDHALAAALGAEFGVTARYIKADMSQGAECRALVAQAGRCDILVNNAGIQHVAPVDQFPVEKWDAIIAINLSSAFHTTAAALPLMRAAGWGRVVNIASAHGLTASPFKSAYVAAKHGIVGFTKTVALETAEEPITCNAICPGYVLTPLVEAQIPDQMKVHGMDRETVIREVMLTRQPSKQFATVEQLGGTTVFLCAEAAAQITGTTISVDGGWTAL

SEQ ID NO: 21724 - protein, 332 aa, Rhodobacter capsulatus
MTLITPPFPTNRLRRMRRTEALRDLAQENRLSVKDLIWPIFITDVPGADVEISSMPGVVRRTMDGALKAAEGSRDAGHSRDLPVPLHDPAVKTETCEMAWQPDNFTNRVIAAMKQAVPEVAIMTDIALDPYNANGHDGLVRDGIILNDETTEALVKMALAQAAAGADILGPSDMMDGRVGAIRQAMEAAGHKDIAILSYAAKYASAFYGPFRDAVGASSALKGDKKTYQMNPANSAEALRNVARDIAEGADMVMVKPGMPYLDIVRQVKDAFGMPTYAYQVSGEYAMLMAAVQNGWLNHDKVMLESLMAFRRAGCDGVLTYFAPAAAKLIGA

SEQ ID NO: 21725 - protein, 182 aa, Rhodobacter capsulatus
MSQSGYVIDQMISAKAIAARVEALGAEITEAFKDTDRLVVVGLLRGSFVFIADLIREIGVPCEVDFLEASSYGNETTSTREVRVLKDLRGIIGGRDVLVVEDIIDTGHTISKVMEMLRARAPRRIECCAMLDKPSRREVDVKARWTGFEIPDEFVVGYGLDYAQNHRNLPFIGTVRFTDPQK

SEQ ID NO: 21726 - protein, 513 aa, Rhodobacter capsulatus
TFLEKSPDWWRGAVIYQIYPRSFQDTNGDGVGDLPGITRRLDHVAGLGVDAIWISPFFTSPMKDFGYDVSDYCDVDPLFGTLADFDALIARAHELGLKVLIDLVLSHTSDQHPWFQESRQSRGNPKADWYVWAEPKPDGTAPNNWLSIFGGPAWAWDARREQYYLHNFLTAQPDLNFHCPAVQEALLGVAKFWLDRGVDGFRLDTINFYMHDAELRDNPPLPVEERNDQTAPKVNPYNHQRHLYDKNHPQNIVFLRKLRKLMDGYKAAAVGEIGDSQRGLEILGEYTSGPDAMQMSYAFELLSGHAALSAGYIAEVFRKLETVAPEGWACWAYSNHDVMRHISRWGLSEAAARCYTTLLMCLKGSVCLYQGEELGLPEAEIAYEDLQDPMARNSGPSSRAVRLPTPMVWQGNDPQGGFSTVKPWLPVPAAHCALAPDVVAGDPGALIHHYRQAIALRHAHPALAKGTMTGISAEAGVLRFLRSEGETELLCLFNLTDNPATVSCPGKWEALEG

SEQ ID NO: 21727 - protein, 715 aa, Rhodobacter capsulatus
KATGKCPVMHGAMTAAGVSNTSWWPNALNLDILHQHDTKGNPLNGFDYRAAVKGLDVAALRADLHALMTDSQPWWPADWGHYGGLMIRMAWHAAGSYRAADGRGGGNTGNQRFAPLNSWPDNVSLDKARRLLWPIKKKYGNAVSWADLILFAGTVAYESMGLKTFGFGFGREDIWAPEKDVYWGAEKDWLAPSDGRYGDLAKPETMENPLAAVQMGLIYVNPEGVNGQPDPARTALHIRETFARMGMNDEETVALTAGGHTVGKAHGNGDAKALGPDPEAADVTDQGLGWSNPHMGGKAAQAVTSGIEGAWTTHPTRWDMGYFEMLFGHDWELTKSPAGAWQWKPVTIAEEAKPLDATDLTTRHDPLMTDADMAMKVDPVYNAICQKFMADPAAFDDAFARAWFKLLHRDMGPKARYIGPDVPAEDLIWQDPVPQGPTGWDVAKVKAQIAASGLSVADLVATAWDSARTFRQSDYRGGANGARIRLAPQKDWAGNEPERLARVLAVLEPIAAAAGASVADVIVLAGNLGVEQAAAAAGFALEVPFTPGRGDATAAMTDGPSFDVLEPVHDGFRNWLKADYAVSPEELLLDRAQLMGLTAPEMTVLLGGLRVIGANHGANPQGVFTERPGVLSTDFFVTLTDMGLSWHRVGGGYELRDRATGAVKYGASRVDLVFGSNAILRAYAELYAQDDAAGKFVTDFTAAWVKVMQADRFDL

SEQ ID NO: 21728 - protein, 269 aa, Rhodobacter capsulatus
DLAVTGVPFDQAVTHRPGTRFGPRAIREASTLQAFDAPYGWGFDPFSELAIADYGDLAFDYAHTASFPDRVTDHIAGILAQGAGVITLGGDHFITLPILRAFAAHHGPVALVHFDAHSDSWADDDMSRIDHGTFLYKALKLGFVAPETTVSVGIRTDNPDTCGVTILDAPFVHQAGVAETVARIRAVAGDRPTYISFDIDGLDPAFAPGTGTPVWGGLASWQAAAILRGLAGINLVGGDVVEVSPPYDPTGATAIAGAHVATELIALYG

SEQ ID NO: 21729 - protein, 140 aa, Rhodobacter capsulatus
MAIERTLSIIKPDATRRNLTGKINAKFEEAGLRIVAQKRIKLSLEQAGKFYEVHKERPFYGELCEFMASEPVVVQVLEGEGAIAKNREVMGATNPANAVDGTIRKEFALSVGENSVHGSDAPETAAVEIAFFFSGLELVG

SEQ ID NO: 21730 - protein, 426 aa, Rhodobacter capsulatus
  unsure (1)..(426): unsure at all Xaa locations
MSTIIDIHAREILDSRGNPTVEVDVTLEDGTMGRAAVPSGASTGAHEAVERRDGDKSRYMGKGVLEAVMAVNGEIAENLVGEDVTDQEGIDKLMIELDGTHNKGRLGANAILGVSLACAKAAADFTAQPLYRYVGGTSARVLPVPMMNIINGGEHADNPIDIQEFMIMPVSAGNIRDAVRMGSEVFHTLKKELSAKGLSTGLGDEGGFAPMLASTRDALDFILKAIEKAGYKPGEDIYLALDCASTEYFKGGKYEMKGEGLSLTSAENVDYLAKLCTEYPIISIEDGCAEDDWEGWKLLTDALGDKVQLVGDDLFVTNPARLAEGIKKGVANAMLVKVNQIGSLSETLKAVEMAHRARYTNVMSHRSGETEDATIADLAVATNCGQIKTGSLARSDRLAKYNQLIRIEEMLGETAEYMGRAILKXA

SEQ ID NO: 21731 - protein, 396 aa, Rhodobacter capsulatus
MAWKTLDEMDLAGKVVLVRVDINVPVENGVVTDATRIEKIAPTVKDILAKGGKPVLLAHFGRPKGKPVPEMSLRPLVPELAKALGVPVKFAEDCIGAPAKTAVAALAAGEVLLLENTRFHAGEEKNDPELSAAMAALGEVYVNDAFSAAHRAHSSTEGVAHILPAVAGRLMAAELKALEAALGNPVRPVCAVVGGAKVSTKLDLLGNLVTKVDHLVIGGGMANTFLVAQGIDVGKSLAEREMAETAREILEKAAAAGCAIHLPADVVVAREFKAGAENEVVGNADCPADAMILDAGPKSVEEIAKVFEASKTLIWNGPLGAFEIAPFDAATNAAAQKAADLTKAGKLVSVAGGGDTVAALNKAGAAEDFSYISTAGGAFLEWMEGKELPGVAALMK

SEQ ID NO: 21732 - protein, 315 aa, Rhodobacter capsulatus
SKEELLTYYRDMLMIRRFEEKAGQLYGMGLIGGFCHLYIGQEAVVVGLEAATKPGDKRITSYRDHGHMLACGMDPKGVMAELTGREGGLSKGKGGSMHMFSKEKHFYGGHGIVGAQVPLGAGLAFADKYLGNDNVTFAYFGDGAANQGQVYETFNMAALWKLPVIFVIENNQYAMGTAQKRSTSTPDIYMRGEAFGIPGEIVDGMDVLAVKAASEKAVAHCRSGAGPYILEVKTYRYRGHSMSDPAKYRTREEVQKMRDERDAIENVRELLISSGQATDEDLKAIDREIKAIVNEAAEFSKESPEPALTELWTDI

SEQ ID NO: 21733 - protein, 449 aa, Rhodobacter capsulatus
MAIDVLMPALSPTMEEGTLAKWLVKAGDVVKSGQILAEIETDKATMEFEAVDEGTVVELLVAEGTSGVKVNAPILRLSGEGVEAAPVPKAAPVAKAPAPVVAAPVAAAPVVSKASADWPEGTAMKTMSVREALREAMAEEMRADQTVFLMGEEVGEYQGAYKVSQGLLDEFGAQRVIDTPITEHGFTGIAVGAAFGGLKPIVEFMTFNFAMQAIDQIINSAAKTLYMSGGQLGCPIVFRGANGAAARVAAQHSQDYAAWYAQIPGLKVVMPYSAADAKGLLKSAIRDPNPVIFLENEILYGRSFEVPVLDDFTVPFGKARIWREGTDVTLVSFGIGMAHALEAADKLAAEGISAEVIDLRTLRPIDYDTVLASVMKTNRCVTVEEGWPVGSIGNHLSATIMERASDYLDAPVINCTGKDVPMPYAANLEKLALVTSDEVVAAVKRVCYR

SEQ ID NO: 21734 - protein, 417 aa, Rhodobacter capsulatus
MAVEILMPALSPTMEEGTLAKWLVKEGDAVKSGQIIAEIETDKATMEFEAVDEGVIGKLLVAEGTSGVKVNAAIAVLIEEGGSAEVAPVAKAAAPAPVAAPAVATPAAPVVPKAAGARIFASPLARRIAADKGLDLAAISGSGPHGRIVKADVEGAVAKPAPAAAPVLVAAPAPAPVSAATVAKLYEGRAYTEIPLDGMRRVIAARLTEAKQTIPHFYLRREVRLDALLSFREELNRQLSARGVKLSVNDFIIKASALALQAIPAANAVWAGDRVLQMQASDVAVAVAIEGGLFTPVLQDADTKSLSQLSAQMKDLAKRARDRKLAPHEYQGGSFAISNLGMMGIESFDAVINPPHGAILAVGAGVKKPVVSASGTIEVATMMALTLSVDHRVIDGALGAELLAAIVSNLENPMAML

SEQ ID NO: 21735 - protein, 350 aa, Rhodobacter capsulatus
DPKEQRKVDEFILYGVAARVQAVKDSGWEPEDEEARCRTGVMIGSGIGGLQTIAETAVLIKEKGPKRVSPFFIPAALINLVSGQVSIRFGFKGPNHAVVTACATGAHAIGDAARLIALGDADVMVAGGAENPISEIGIAGFNACKALSTKRADDPKAASRPWDADRDGFVMGEGAGCVVLEEYEHAKGRGAKIYAEVLGYGLSGDAYHITAPSEDGDGGFRAMTAAVKRAGIDPGEIDYVNAHGTSTMADTIELGAVERLLGDAASKATMSSTKSAIGHLLGAAGAVEAIFCILAIRDQVAPPTLNLDTPAVAAKIDLAPKVAVKRKIDVAMSNSFGFGGTNAALILGKV

SEQ ID NO: 21736 - protein, 76 aa, Rhodobacter capsulatus
MSDIADRVKKIVVEHLGVEEDKVTETASFIDDLGADSLDTVELVMAFEEEFGIEIPDDAAETIQTFGDAVKFITEA

SEQ ID NO: 21737 - protein, 243 aa, Rhodobacter capsulatus
  unsure (1)..(243): unsure at all Xaa locations
MFDLTGKSALVTGASGGIGGEVAKALHAAGAKVALSGTRVEPLEKLAADLGERAFVCPANLSDPASVEALPKGPRGDGSVDILXHAGITGINLFMRMSDEEWAAXSTVNLTASFRLTRGVLAPXXRRRWGRIVNITSVVGQPANPGQGNYAAAKAGLTGMSKSLAYEVASRGITVNCVAPGFIATAMTDKLNDEQKAKILTQIPAGRMGAAEEIAAAVLYLASPEAGYVTGTTLSVNGGMAMI

SEQ ID NO: 21738 - protein, 302 aa, Rhodobacter capsulatus
VAWVFPGQGAQTIGMGKALAEAYPAAKAVFDEVDAALGEKLSALIWEGEIERLTLTANAQPALMATSLAAVAALKAEGIEVGQAAFVAGHSLGEYSALCAAGALSLADTARLLRIRGEAMQSAVPVGVGAMAALLGLDFATAAEVAAEAAQGEVCQAANDNDPAQVVVSGHKAAVERAVEIAKGKGAKRAVMLPVSAPFHCALMQPAADRMAEALAAVTVSAPVVPVVANVRAEAVCDPATIRQLLVEQVTGSVRWRESVLWMVGQGVTDFCEVGAGKALSGMIKRIAKDTTQKAVGTPEDV

SEQ ID NO: 21739 - protein, 577 aa, Rhodobacter capsulatus
LAAVVALTCFGTAQAGGVTEEDLRNDQQTAGDVVTNGMGRDLQRFSPLATLNRDNVKNLMPAWAFSLGGEKQRGQESQPIVYDGVMYITGSYSRLYAIDIHTGKEIWQYDARLPEGILPCCDVINRGAAIYGDNVYFGTLDARIVALDRKTGDVKWNKKIADYKEGYSYTAAPLIVNGLVITGNSGGEFGIVGEVQARNAETGELVWTRPMIEGHMGTLNGKPSTMTGTLNATWPGDLWKTGGGATWLGGSYDAETDTLVFGAGNPAPWNSHLRNAGTPTEGNKGDNLYAASRVGIDPATGEIKWHFQTTPREGWDFDGVNEVVGFVDKDGNKRFATADRNGFFYVLNRADGKFVNAWPFVKNITWAKGIDETGRPIYNEENRPGAPDAAAEAAKGQQIFAVPSFLGGKNWMPMAYSQTTGLFYVPSNEWGMDIWNEPINYKKGAAYLGAGFTIKPLFEDYIGSLKAIDPNTGAVKWEYKNDAPLWGGVMTTAGKLVFTGNPEGEFMALDAETGEKLWSFQTGSGIVGQPITWEQDGEQYVSIISGWGGAVPLWGGEVAKRVNYLNQGGTVWTFRLP

SEQ ID NO: 21740 - protein, 142 aa, Rhodobacter capsulatus
DLSLIKRIIPHRYPFLMVDKVRDIVPFESAVGIKCVTNNEPQFTGHFPEEPVMPGVMIVEAMAQTAAVVVGISMNVIDKPLGTYFMAIDGCKFRRKVVPGDVLEMHVTVKRGGGKVWKFLGESFVEGQLAATAEFTAMMDLK

SEQ ID NO: 21741 - protein, 494 aa, Rhodobacter capsulatus
SPFKPRYDNFIGGKWTPPVGGKYFDNITPITGEKICEVAASTAADVELALDAAHAAKGDWGTTSAAHRSNVLLKIADRLEQNLDLLAAAETWDNGKPIRETTAADIPLSVDHFRYFAGVLRGQEGSMSEIDNDTVAYHYHEPLGVVGQIIPWNFSILMAAWKLAPALAAGNCIVLKPAEQTPSAIMVLIDVIKDLLPPGVLNIVNGMGPDVGAPLARSNRIAKIAFTGSTETGRKIMQYATENLIPVTLELGGKSPNIFFSDVMAKDDAFLDKAVEGFVLFAFNQGEVCTCPSRALIQEDIYEEFIARAIARVKAIKQGDPRLMETMVGAQASQEQQDKILSYLKIGREEGAQVLCGGDAASLGGDLANGFYIQPTILKGHNKMRVFQEEIFGPVVSVTTFKDEDEALHIANDTMYGLGAGVWSRDINTCYRFGRHIQAGRVWVNNYHAYPAHAAFGGYKQSGIGRETHKMMLDHYQQTKNMLVSYNPNKLGFF

SEQ ID NO: 21742 - protein, 243 aa, Rhodobacter capsulatus
RRKLAAGNWKMNGTKASLAEVAALIAAHPDPKSEVLLCPPATLVAAMVATAAGRIAVGGQDCHMKAAGAHTGDIAAEMLADCGASHVILGHSERRADHGESSEMVCAKATAARAAGLVAVICVGETEAQRDAGETLALVGAQLAGSVPDGATAANTVIAYEPVWAIGTGRTPTLEQIAEVHDFLRAELVARFGAEGEGMRLLYGGSVKPSNATEIFATSNVDGALVGGASLKAADFGAILSAL

SEQ ID NO: 21743 - protein, 546 aa, Rhodobacter capsulatus
MYEYSDFDEAFVRNRVAQFRDQVARRLDGSLTEEEFRPLRLMNGLYLQLHAYMLRVAIPYGTLSSNQMRALADVADRFDRGYGHFTTRQNIQFNWIKLTDTPDILERLADDGLHAIQTSGNCIRNVTTDAFAGAAADEIEDPRPYAELIRQWSSDHAEFQFLPRKFKIAITGSPEDRAAIRAHDVGLQLIQRGGETGFRVLVGGGLGRTPMLAPELRDFLPKADLLPYLEAILAAYNLIGRRDNKYKARIKITVFETGIEPFRDLVEQEFERIRPQFTGADQALLAEITPHFALPDLVAKDPAPFAAAQVTDPAFAAWVKHSVTDHKRPDHAVVTISVKTPGEEPGDVSAAQMRAVADLADLHGYGELRISHMQNIVLPHVARADLPALHAALRKVGLAAANVGLISDMIACPGMDYCALATARSIPLAQEIAQHFETLGLVETIGPLPLKISGCINACGHHHLGAIGILGLDRAGAENYQITLGGAEGPEAAIGEKMGPGFAYDAVVPAIERLVRAYLTLRLSEGETFLAALHRLGREPFRAALY

SEQ ID NO: 21744 - protein, 207 aa, Rhodobacter capsulatus
FGDGKGAGRSRHRAGGDGQLVRAESVVLLHMVSLIAPATPVLFVDTMMLFPETLAYQQEVASKLGLSEIRTIRATKAALALDDPDGTLYQFNTDACCNLRKTVPLETALAGFDAWITGRKRYQGATRAEIDFFEVETPNRMKINPLAHWGREDLEEYMVQNRLPRHPLVAKGYPSIGCAPCTSPVKPGEDPRAGRWRGSQKTECGIH

SEQ ID NO: 21745 - protein, 490 aa, Rhodobacter capsulatus
MKEIGHWIDGKMVAGTSGRFAEVMNPATGEVRAKVALATKAELDAAVAAAERAQPGWAATNPQRRARVMMKFADLINTHMDELAELVSVEHGKVLADGRGDVQRGLEVIEVCMGAPAMLKGEYTDGAGPGIDIYAMRQPLGVVAGITPFNFPAMIPLWKMGPALSAGNAMVLKPSERCPSTALRLAELAKEAGLPDGVLQVVNGDKDAVDAILDNETIQAVGFVGSTPIAQYIYGRACANGKRAQCFGGAKNHMLIMPDADMDKAADALVGAGYGAAGERCMAISVAVPVGKGTAEALISRLIPKIEKLKVGPYTGGADVDFGPVITAQARDRIEGLIASGVEQGAQLLIDGRGLTIQGYENGFYTGPSLFDHVTPEMEIYKQEIFGPVLSVVRAESYEEALKLVMDNDYGNGTAIFTADGDTARDFASRVNVGMVGINFPIPVPLSYYSFGGWKKSAFGDLNQYGPDAFRFYTKTKTVTARWFSGIKDG

SEQ ID NO: 21746 - protein, 433 aa, Rhodobacter capsulatus
AHHMHPFTDGDGLAKKGARIITKAKGVWVTDSEGAEILDGMAGLWCVNVGYGREELVEAAARQMRQLPFYNTFFQTSHIPAIQLAKRLAELAPGDLNHVFFNGSGSDSNDTNIRMVRRYWQALEKPEKNVIISRWNGYHGSTMGAASLGGMKGMHAQGGLPIPGVVHIDQPDWWSEGGDLTPEAFGLARARQLEEKILEIGAENVAAFIGEPVQGPGGVIVPPATYWPEIQRICRQYDILLIADEVITGFGRTGNWFGCQTFGITPDIMTVAKGLTSGYIPMGASIVSDRVAAVINGSDEFAHGYTYSGHPVAAAVALENLRLLDEDGIVARVAAETAPYLKAKWEGLAAHPLVGEAKIVGMMGSIALTPNKETRAKFASKSGTVGYICRERCFANNLVMRHVGDRMIISPPLVITPAEIDILIARALKSLDE

SEQ ID NO: 21747 - protein, 739 aa, Rhodobacter capsulatus
VGGMDCAACAGKVRSAVERLPGVEAVEIALMSERLRARLTPGATSPGELERTVTRLGYTITRIGAAPPLPLLKPRHDHGHDHGHDGHDHGGAPACGCGGCGCGAAAPAPAPAPEVTAEVTAAPLPPAAPWLRGPKAARLFWSAGGLALAWGVALMLPALAAPAFALACLGALFPVARQALALARVGQPFSIEMLMTVAAIGALMIGAAAEAAMVVVLFALGELLESIAAARARDGLRALARQMPETALLERDGQTREVAAATLQPGQILRLRPGDRAPVDAEIVEGVSGLDESAVTGESVPVTRGPGDRVLAGSINTEALLRLRVTRAAADSTLARIARMVAEAEAAKAPVERFIDRFSRWYMPLIVGLAALVAVLPPLLTGADWGVWIYRALALLLIGCPCALVISVPAAMAAALSTGARRGLLVKGGAVIEALARLRLVALDKTGTLTPGRPLVTDLRPAAGVAVADLLAHAAAVEAGSSHPLARAILARAAAEGVTAPAATAARVIPGVGAEAQIAGALWRIAAPAAGNPQAAALQAEAKTVVELCRDGVPQGLIALRDEPRPEAGAALAALRALGLDSVMLTGDAEAPARALAAPLGLAVKAGLLPEDKCAEVTRLSAQGGVLMLGDGINDAPALRAADVGVAIGAGTDVAIETADAVLMRNDLTDLPALIRLSRQTLGNIRQNVAIALGLKAVFLVTSVFGITGLWIAVLADTGATVLVTANALRLLRYDPRRA

SEQ ID NO: 21748 - protein, 205 aa, Rhodobacter capsulatus
VEARSGKATSAVIFLHGYGADGDDLLGLAEPLAPHLPNTLFLAPDAPEECVTNPFGRQWFPIPWLDGSAPEEAAAGLTRSSEDLNAFLDQVMAAEGLAAAQIALLGFSQGTMMALQVAPRRAQALAGVVGFSGRLLRADALAAETVTKPPMLLLHGDVDQIVPFGDLKQAADALSAAGFDLRTHVMRGTGHGISPDGLGQALAFL

SEQ ID NO: 21749 - protein, 365 aa, Rhodobacter capsulatus
HSFSPRTEIVFGEGLLERLQAYRGQRVGIVTDEFMARSGPLDRVLAHLDGCTVKIFAEAIPEPPLATVSAGARLFADFRPDVVLALGGGSPIDAAKAILAVVRGIDPSHPIRLVAIPTTSGTGSEVTAFAVISDPANNRKFPLISNDLIPDVAILDPEFVRTAPPRVTADTGMDVITHAIEAVVARGASNFTDAFAEKALELAFAALPRAYDNGNDLAARDAMHQASCLAGMAFTEAGLGLNHGLAHAIGGRLHLVHGRINAVLLPHVIAWNAGLSDDAPGCRETASRYARIAARVGLDVPGTRAGVVALIRAIEALNARFGIPSSLRGLGVAIEEYRRAIPDLAAAAFADACTAGNPRRPALAD

SEQ ID NO: 21750 - protein, 441 aa, Rhodobacter capsulatus
DRAHVWHHLSQHKPYETSDPRVFVEGRGMRLWDATGREFLDATSGGVWTVNLGYGRKDVVEAVAAQLLALPYYAGAAGTVPGARYAEALIAKMPGLSRVYYSNSGSEANEKVYKMVRQISHRHHGGRKGKILFRERDYHGTTIAALATSGQAQRAEHYGPFPDGFVSVPHCLEYRAQWDCANYGERAADAIEEVILREGPDSIGCLVLEPITAGGGVIVPPAGYWEKVSHICRKYNILLHLDEVVCGLGRTGAWFGYQHYGIQPDFVTMAKGVAAGYAAISCTVTTEAVFELFKDAPSDPLCHFRDISTFGGCTAGPAAALETLRIIEEEGLLQNTAQMGERLLANLRDLAERHAVIGDVRGKGLFCGAELVADRRTKEPLAEAKVQAVVADCAAQGVLIGATNRSIPGLNTTLCLAPALIASEAEIDRITETIDAALRRL

SEQ ID NO: 21751 - protein, 289 aa, Rhodobacter capsulatus
PVSGLDLPRFAGVPSFMRLPHVPLDHPRLAEVQIGLIGAPWDGGTTNRPGPRHGPRQLRDASTMIRAVNGATRVAPFDLARCADLGDVAPNPGDLMDSLARIEAFYDRVVAAGIRPLTAGGDHLCTLPILRALAKARPVGLIQFDSHSDLNDVYFGTARYTHGTPFRRAVEEGLIDPSRYCLIGLRGTAFGHEDLDFAAATGIRIIPVAELHARGAAEVMAEARAIAGSGPTYVTYDIDFVDPAFAPGTGTPEVGGPTSWTALEVARGLRGLDIIGADLVEVSPPFDPA

SEQ ID NO: 21752 - protein, 200 aa, Rhodobacter capsulatus
PKRTLVIDLDACTGCHACTIACKGWQNANEDTRLPDADAYGKAPFGAFLNRVHSYEVIADGAPARLIHYPRTCVHCENPPCVPVCPTGASQQTADGLVQIDASRCLGCGLCAWACPYGARELDPVAGVMRKCTLCANRIDDPARPAEDRIPACVRACPTGARHFGDPADAESPLGRLVADRGGFAPMPEFGTKPSSRYLP

SEQ ID NO: 21753 - protein, 490 aa, Rhodobacter capsulatus
LALETFQHIHALSLRYHITRKTGGLSRIVERGVKGVDFLLRFMLFSVGPLILELTLVTLIFAFLFDWRYALVVVGTIWTYVTYTFRVTEWRVAIRKKMNDADTAANQKAIDSLLNFETVKYFSAEKREAARYDASMERYEGAAVKTGQSLAALNAGQTLIITAGLVAVMVMAAMEVQAGTLTVGDFVMVQAYMIQITMPLSFLGTVYREIRQALVDMGEMFDLLHQPAEITDAPGAKPLAVSGGAIAFKGVDFAYSPERPILKGIDLAVAAGQKVALVGPSGSGKSTIGRLLFRFYEVTGGAISIDGQDVRDVTQESLHAAIGVVPQDTVLFNDTIRYNIAYGRAEATQEDIEAAARAAKIHDFVMSLPEGYDTQVGERGLKLSGGEKQRVGIARTLLKNPPILLLDEATSALDTQTERDIQESLDAMGRGRTVIVIAHRLSTIADADRIVVLEAGEIVEEGTHEALLARAGRYAAMWAAQSAEEAAEAA

SEQ ID NO: 21754 - protein, 256 aa, Rhodobacter capsulatus
MTAGLMAGKRGLIMGLANDKSIAWGIAKALGDAGAELAFSYQGEALKKRVEPLAASLGTPLLFECDVANEDSMDALFAGLKDAWGTLDFVVHAIGFSDKNELRGRYVDTSRGNFTMTMDISVYSFTAVCARAAAMMPNGGSLLTLTYYGAEQVMPHYNVMGVAKAALEASVKYIAEDLGKLGIRCNAISAGPIKTLAASGIGDFRYIMKWNELNSPLRRNVTQEEVGKAALYLLSDLGSGTTGENLHVDAGYHVVG

SEQ ID NO: 21755 - protein, 321 aa, Rhodobacter capsulatus
INVSQAAPVDPPPRALRQAIAEAALDTPSAHLYGPVLGNGDLRAEVAAQWSVAYGGTIRPAQVAITQGCNQAFCAAIATLAGAGDEVLLPTPWYFNHKMWLDMAGVRTVPLPTGPGLLPDPDHAAARITPATRAIVLVTPNNPGGVEYPADLVRAFADLARRHGIALILDETYRDFDARNGAPHDLFTDPDWDEGLIQLYSFSKAYRLTGHRVGAIVASPARLAEVEKFLDTVAICPGQLGQIAALWGMRNLRDWVAGERAEILSRRAAMTAGLAALPGWETLGCGAYFAYVAHPSPLPAPDFAKRLVAEASVLALPGTMF

SEQ ID NO: 21756 - protein, 468 aa, Rhodobacter capsulatus
AAMSQKIVTRFAPSPTGYLHIGGARTALFNWLFARGHGGTFLLRIEDTDRARSTPAATAAILKGLDWLGLDYDGEVVSQFDRAPRHAEVAREMLARGAAYKCFATQEEIEAFREAARAEGRSTLFQSPWRDADPATHPDAPYAIRLKAPREGATVIADKVQGEVTVRNDQLDDMVCLRSDGTPTYMLAVVVDDHDMGVTHIIRGDDHLINAARQMQVYHAMGWEVPVFAHIPLIHGPDGKKLSKRHGAVGLEEYQAMGYPAAGMRNYLARLGWSHGDDEVFTDAQAQEWFELEGIGRAPSRLDFKKLENVCGHHMGQIADDDLIAQISGYLEAAKLPALTGTQLAALHKALPVVKSGAKTFGQLLEKARFALICRPVEIDAKAMAALDPVSRGILKELTPQLQNASWVREELESVVARVAEAHGLGLGKIAAPLRAALAGRAATPSVFDMMELLGREEVLARLSDQAA

SEQ ID NO: 21757 - protein, 177 aa, Rhodobacter capsulatus
LRAILWDMDGTLLDSEPVHRLSFVDAARACGLTLPADFHEGLIGKSEDAIHAILAAEHGLTLSLAHWSELRFAAYLARIEEVHPFRIATDLWARAQAAGLSQAIVSNSPEGIVRANLTRLGLAPGAVRTVSRHDVRRGKPDPEPYLLALARLGLPPETVAVVEDSAAGLAAARAAGL

SEQ ID NO: 21758 - protein, 529 aa, Rhodobacter capsulatus
RHLVGVDVGTGSARAGVFDLTGHLLGTDHHPITLFREEGSVVEQSSAEIWAAVGRAVQGALKAAGLTGADVAGIGFDATCSLVVLDPAGRSLPVGPSGDPARDVIVWMDHRATAQTERINATKHRVLEYVGGRISPEMETPKLLWLKEHRRETFDAAGHFFDLTDFLTWKATGSAARSICTVTCKWTYMGHESRWDESYFRQIGLADLAEEGFARIGTEVVMPGTALGAGLTEAAARDLGLLPGTPVAAGLIDAHAGGVGTVGAAGEGGAVANLAYVFGTSSCTMTTTEDPVFVPGVWGPYYSAMVPGAWLNEGGQSAAGAAIDQLLRFHPASAEASAAASRAGLSLPAWLARRAEALAGAGGEVARLAAGLHVVPEFLGNRAPHADPYTRALIAGLGMEDDLDNLVALYVAGICGLGYGLRQILEVQAKRGASVATIVISGGAGRSDLVRQILADATGVPVAAPDTEEPVLLGSAILAAVAAGAAPDVATGMAQMSRIARRYPPGEAALRAFHDARFALFEKFQVLAR

SEQ ID NO: 21759 - protein, 526 aa, Rhodobacter capsulatus
HAATVKDRHILDLFAADPDRAARFSAEFGSWFFDFSKTNIDAAGLKLLIDLAEKTGVAARRDAMFAGEKINETEGRAVLHMAWRNFRDTITVDGHDVMPALRDTLGRMQDFAEDVRTGRFTGQGGRITDVVNIGIGGSDLGPVMASVACTSFADGPRLHFISNVDGAHAHDVLSGLNPETTLVIVASKTFTTIETMTNAETARAWMAAKVTDPAAQFSAISTATDRTAAFGIPPERVFGFEDWVGGRYSVWSPIGLSLMIGIGPGYFAEFHAGAAAMDRHFREAPLAENLPVLLALVGIWHNQVLGHATRAVLPYEQRLARLPAYLQQLEMESNGKRVSMDGADLPWHSGPVVWGEPGTNGQHAFYQLIHQGTRVVPCEFLLAARGREPYLEHQHLLLVANCLAQSEALLRGRSLAEATEIMAKKGLTGAELDRQARHRVFPGNRPSTTLLIEVLTPFTLGGIVALYEHRVFVEGVILGINSFDQWGVELGKELALALAPVLEGSSEGAGKDGSTSGLARRIRAAR

SEQ ID NO: 21760 - protein, 488 aa, Rhodobacter capsulatus
MVSRVIPVDLFDLVIFGATGDLAQRKILPGLYRRFHAGQMPEGARIIGAARSDMDAEGFRAQVTKAIADFVDPAKHDAATIAAFLQSLDYVSVDATGEGGWDSLKAKVDPARINAFYFSVAPMLFGPLADRLKAHGIAGDQSRIVVEKPFGRDLASARALNATLAAHFEESQIYRIDHYLGKETVQNLMAVRFANILFEPLWNAQYIDHVQITVAETVGVGGRGSYYDKSGAMRDMVQNHLMQLLCLIAMEPPYHFDPDAVRDEKVKVIRALQPVPAADIVRGQYLGVKATAGRAEQPGYLADSENPDSRTESYIALKVQVANWRWQGTPFYLRTGKRLRGRASEIAITFKAPPHSIFDQEEASWRENVLVIRLQPDEGMNLKVMIKEPGPGGMRLVQVPLDMSFAEALGEDGADIPDAYERLIMDVIRGNQTLFMRGDEVEAAWAWTDPIIAGWEARGDRPRPYDAGSSGPEDALMLMHRDGRRWRE

SEQ ID NO: 21761 - protein, 234 aa, Rhodobacter capsulatus
LITGGAKRIGAEMARGFAARGFRVVLHYNSSSTEAEALAGELNQSGEICRLVQADLSDAAAVQRVFDVAQGFLGRVDVLLNNASNFMNDDIFSLSDAKMDAHFAVNLKAPLALAARMAAQDRSGEDALILNMLDNKVLALNPDFFSYTLSKAALHAATEMLAMRFGGCPRVNGIAPAITLISGKQTPENFEKSSRINPLGIQVQPADLVRTALYFWEAKGVTGEVIAVDGGQTL

SEQ ID NO: 21762 - protein, 195 aa, Rhodobacter capsulatus
ALVTGASRGLGFAIAEELAAEGWHIMAVARTVGGLEALDDVIQAKGGSATLAPLDITKPEEMETLANGILGRWGGLQLWIHTAVHAAPLSPAAHSDAKDMEKSVATNLTGTATLIPLIDPLLRAGDGTAVFFEDDRAGQPYFGSYGATKAAQIALARSYAVEAAKIGPKVKIVAPRPMATAVRARFFPSEDRTPL

SEQ ID NO: 21763 - protein, 199 aa, Rhodobacter capsulatus
FLYALRSKGVTDARILSAMERIDRGAFVRGIFAERAYEDMPLPIACGQTISQPSVVGLMTQALAVGPRDRVLEIGTGSGYQAAVLSLLCRRVYTVDRHRRLVREAQAVFEALSLPNIVALATDGSRGLPDQAPFDRILVTAAAEDPPGPLLSQLKIGGIMVLPVGQSDTVQSLIRVTRLETGFDYEELRPVRFVPLVEG

SEQ ID NO: 21764 - protein, 258 aa, Rhodobacter capsulatus
MKIATFNINGIKARAEALPAWLRAAEPDVVLLQEIKSTDEAFPQEVLDGTGYTVHTHGQKSFNGVAILSRLPLEDVTRGLPGDDSDDQARWIEATVIGTRAVRVCGLYLPNGNPAPGPKYDYKLAWMARMQARVETLLRSEEPLVFAGDYNVIPQDEDAAKPESWRADALALPETRAAFRRIVNLGLTDAFRARVPGPGQYSFWDYQAGAWQKNNGIRIDHLLLSPQAADLLRDAGIDKEVRAGEKPSDHVPVWIDLD

SEQ ID NO: 21765 - protein, 236 aa, Rhodobacter capsulatus
LLSLENIELYYDHVYALKGVSLNLAEGETVALIGANGAGKSSILRAITGLRKPRAGTITYRGDRIDGKSPAEIVKMGIAMVPEGRRVFPLMSVRDNLLMGAFTRSDTAGIARSLEAVLTRFPRLKERYGQQAGTLSGGEQQMMVIGRALMAAPKLLLLDEPSLGIAPKLVQDIARAIVAISRDEGVSVLLVEQNSRMALSISARAYALSTGTVALSGASADLMHDPRIKAAYLGGD

SEQ ID NO: 21766 - protein, 493 aa, Rhodobacter capsulatus
LAYWQGLAEKLTLRTRHFIGGDYLPSADGRTFQTINPANGAVLAEVARGGQAEIDRAVSVARKVFRSGVWSKMEPRARMAVLEKFAALIEAHGEEFAVLDSLDMGKPVMDMMNIDVPFSATTIKFFGESIDKFHGQVTATATTALHYILNQPLGVVGIITPWNYPLMMAAWKLGPALATGNSVVLKPAEQSPLSACLLAELFIEAGGPPGVLNVVQGLGEEAGKALALHMDVDKIAFTGSTEVGKLLMIYAGQSNMKRVTTECGGKTPQIILGDWDDLDTAATYAVNGIFGNQGEVCNAGSRILVARELHDAFVEKFIATAKQNFILGDPLDPATTMGPLVTTDQQARVLGYIAKGRAEGAVLALGGGTPAGLSHGAYVEPTLFTGVNNAMTIAREEIFGPVGTIIPIDGLEDGLEIANDSPYGLAASVWTRDLAKAHTFGREMEAGVCWVNCFDHGDMTSLWGGFKQTGNGRDKCFEALSQYTQTKSVWINL

SEQ ID NO: 21767 - protein, 95 aa, Rhodobacter capsulatus
MAFKPLHDRVLVKRVQSEEKTKGGLIIPDTAKEKPAEGEVVAVGAGARKDSGELIAPAVAVGDRILFGKWSGTEVTLDGVEMLIMKESDIMGIIS

SEQ ID NO: 21768 - protein, 323 aa, Rhodobacter capsulatus
KYQIVGIGNAIVDVIAQCDDEFLAAMGIEKGIMQLIERERAEKLYAAMAERTEAPGGSVGNTIAGLGNLGLTAAFIGRVADDTLGHFYKAALNAEGTDFPNPPVKGADLPSSRSMIFVTPDGERSMNTYLGISAELSTEDVALEVVENTEMLFLEGYLFDKDHGKAGFLKAAQGCHRGGGRAGISLSDPFCVDRHRDSFRRLVRDEMDFALGNEHEWASLYQTDLESALQQAASECGLVVCTRSGADVVVIRGEERVEVPVNRVVPVDATGAGDQFAAGFLYGIATGQSLEVAGKMGCIAAAEVISHYGARPETDILAQFKQA

SEQ ID NO: 21769 - protein, 303 aa, Rhodobacter capsulatus
MILSCGEALIDMLPRQGTAGEACFAPHAGGSVFNTAIALGRLGVRAGFLSGISTDLFGEVLIGTLAASNVDAGLAIRSDRPTTLAFVKLVDGHASYAFYDENTAGRMILPGDLPALPAAVRALFFGGISLPVDPCGGTYEALMAREAASRVTMIDPNIRPGFIRDEAAYRARLARMIALADIVKLSDEDLRWLEGPGEIAALAQGLLRRGPKLVFVTEGGTGAHAFGAGLSVFAPAQRVTVVDTVGAGDTFNAGVLAALDRAGRLTKAAVAAADAAACVGLSGAWQCGRRDHRQPCGRQPALG

SEQ ID NO: 21770 - protein, 433 aa, Rhodobacter capsulatus
TFENLGLAPMLLKNLAGLGLTKPTPIQAQGIPHIVRGRDILGLAQTGTGKTAAFGLPMLTRILAYGKRPAPKTVRALVLAPTRELATQIHDNLAAYAEGAPVRIQRVVGGASLNVQAEKLSKGCDVLIATPGRLIDLIERRALVLSETKYLVLDEADQMLDIGFIHALRRIAKLIPAERQTLLFSATMPKLMEELAASYLSDPIRVEVATPGKAAEKIDQGVHFTTQGEKAALLAEYISRHPGELAVVFNRTKHGSDKLTKLLEKWGFSVTAIHGNKSQGQRERALSAFRASEVQVLVATDVAARGLDIPQVAHVYNYDLPNVPENYVHRIGRTARAGRDGRAVAFCGPLEMSDLRAIEAAMGAKIPVIGGEAHAEGGSRPAPGRSGQPKKPHRGQGPKPAREGEAKPARKPDAKPAAKRGGRAEGHAPAGGQ

SEQ ID NO: 21771 - protein, 269 aa, Rhodobacter capsulatus
  unsure (1)..(269): unsure at all Xaa locations
MDIDIQEISKLFGTTAALHPVSLAIPSGALVALLGPSGSGKTTLLRILGGLEFPTSGRVLFDGQDATNLRVQDRRAGFVFQSYALFRHMTVFENIAYGLRARPRAERPPKLEIARRVARLLELIQLPDIGSRYPSQLSGGQRQRVALARALAIEPRMLLLDEPFGALDAKVRKELRQGLRDIHDATGLTTVFVTHDQEEAMELADMVVVMSMGRIEQIGRPNDIRARPASSFVRDFITAXPRSGQGHALARRIIGPMTPEGPKALGQRP

SEQ ID NO: 21772 - protein, 827 aa, Rhodobacter capsulatus
VIPLTSELVAIGKTATDKADAIAQAVDLLTAAGKIDPRYGQSMMGREAVANTFLGNGIAIPHGLPQDRDLIHDTAIAVVQLPAGVEWAPGDTARLVVAIAAKSDEHLQVLSNLTDVLGDEAEAERLATTLDAAVIVARLTGAAAPVAAPAETPADFAQGIDVVVTGAHGLHARPATTLVDLAKGFAAEIRIRNGAKVANGKSLISLLNLGAAQGAALRISAEGADATAALAAIAAAFEAGLEDEEDTGAAAPEAATPGLTGAGASMASYEGRTLVGISSSPGYALAPVFRFARDEVVFDTDAADAAFETDRLDTALQTAWHELEELHDEVWKTSGPARAAIFRAHQEFLHDPEMVAEAKALIGQGRSAGFAWHRVFSDRADMLGAMKDAVLSGRAIDLRDAGQRVLQHLGRVRTGETHLPTAPCILLADDLTPSDTARLDPALVRGLATAQGGPTSHTSIIARALDIPAVAGVGPRLLDLATGTPVLLDGGAGVIVVAPTEADKARAETAMAALTAQRELEARERYKPALTVDGARVEVVANISDVAEAIASVEAGAEGVGLLRTEFLFVNREAPPGEDEQLAIYAAMLSALNGLPIIIRTLDVGGDKEIPYLRMPVEQNPFLGERGIRFCLSHEDLFRTQLRAIYRASAGGQVRIMFPMIAMIEELETARRIAEEVRLEVGAAPVEIGIMIEIPSAVMMAPELAKRVDFFSIGTNDLTQYALAMDRMHPVLAKQADGLHPAVLRLIDSTVRAAEAARIWVGACGGIAGDPVGAAVLSGLGVRELSVSIPAVAGIKAQLRHSAMAENRDLARRALACTTAAEVRGLK

SEQ ID NO: 21773 - protein, 425 aa, Rhodobacter capsulatus
LTTDADDFETRFTALLGMKREDSPDVDATVAAIIAEVRDRGDAAVIDYTSKFDRLDLTPATLAFSKAEIAAEIARVPAAERAALELAAERIRAYHARQMPVREERWTEASGAELGWRWSPVSAAGLYVPGGLASYPSSVLMNAIPAKVAGVERLVVVCPTPGGAVNPLVLLAAEIAGVDTVYRIGGAQAVAALAYGTATIAPVDKITGPGNAFVAAAKRRVFGRVGIDMIAGPSEILVIADETANPDWVALDLLSQAEHDQSAQALILTPDAGFAKAVTAAVEKRLETLERRAIAGASWRDFGAVIVTRDLAEAAMLSNRVAPEHLELCVADPEALSARITHAGAIFLGQWTPEAIGDYVGGPNHVLPTARSARFSSGLSVMDFLKRTTLAKMTPEALRAIGPAAETLAISESLQAHGLSVRARL

SEQ ID NO: 21774 - protein, 422 aa, Rhodobacter capsulatus
VDSILVRGNGPLSGQIPIAGAKNACLALMPATLLSEEPLTLTNAPRLSDIRTMTQLLASLGAEVTALQDGKVLATSCHGAINPVADYDIVRKMRASNLVLGPLLARLGHAVVSLPGGCAIGARPMDIHIDALTALGAEIELKEGYLHAQARGGLKGAVHEMRFASVGATENFLMAAVLAKGTSVLKNAAREPEIVDLARCLRAMGAEIEGEGTSDITIQGVDRLHGATHPVVTDRIELGTYMLAPAICGGEVECLGGRIALVESFCEKLDAAGISVEETARGLKVKRKNGRIRAVDVVTEPFPGFPTDLQAQMMALLCTAEGTSVLEERIFENRFMHAPELARMGARIEVHGGVAKVHGVDRLKGARVMATDLRASVSLILAGLAAEGETVVSRVYHLDRGYERVEEKLRAVGAQIERVKGE

SEQ ID NO: 21775 - protein, 804 aa, Rhodobacter capsulatus
KQGQTMTALPSTHPVLPLRDIVVFPHMIVPLFVGREKSVRALEEVMADDRQILLASQIDPSIDDPTHEGIFRVGVLANVLQLLKLPDGTVKVLVEGKSRVRITDFVENDRFFEAQAETLTEVEGDRDTIKALLRSVAEEFERYAKIKKNIPEEAMAAVSETREADKLADLVSGHLGLEVKLKQELLETLDISERLEKVYGLMQGEVSVLQVEKKIKSRVKSQMEKTQREYYLNEQMKPIQRELGDGEDGQNELNELEEKIARTKLSKEAKDKAEGELKKLRSMSPMSAEATVVRNYLDWLLNLPWGVKSRVKKDLIGAEKVLDADHYGLEKVKERIVEYLAVQARSDKLKGPILCLVGPPGVGKTSLGRSVARATGREFIRISLGGVRDESEIRGHRRTYIGSMPGKIIQALKKAKTTNPMILLDEIDKMGHDFRGDPASALLEVLDPEQNGTFVDHYLEVEYDLSNVMFLTTANSYNMPGPLLDRMEIISLAGYTEDEKSEIARQHLIPKQVKAHGLKKGEFTLTDGALSDIVRYYTREAGVRNLEREIAKTARKAVTEILKAKGAVKSVTVDEAKLGDYLGVKRHRYGLAEAEDQVGVVTGLAWTSVGGDLLHIEALKLPGKGRMKTTGKLGDVMKESIEAASSYVRSIAPEIGVKPPKFETLDIHVHVPDGATPKDGPSAGLAMVTSIVSVLTGIPVRKDIAMTGEVSLRGNAMPIGGLKEKLLAALRGGIKTVLIPEENEKDLADIPANVKEGLEIIPVTHVREVLTRALVRAPEPVEWDEAAEEAAAAARAAAKAEAAG

SEQ ID NO: 21776 - protein, 443 aa, Rhodobacter capsulatus
MFDKILIANRGEIALRVIRACREMGIASVAVHSTADADAMHVRMADESVCIGPNPSSESYLSIPAIVAACEITGAQAIHPGYGFLSENATFVQVLEDHGITFIGPKAEHIRIMGDKITAKDTAKKLGIPVVPGSDGGVPDFEAAKKAAAEMGYPVIIKATAGGGGRGMKVAQSEAELEIAFRTARSEAKAAFGNDEVYMEKYLQRPRHIEVQIFGDGRGRAVHLGERDCSLQRRHQKVFEEAPGPCITPEQRARIGGICAKAMGELGYSGAGTIEFLYEDGEFYFIEMNTRLQVEHPVTEGIFGVDLVREQIRVAAGEEIEFTQENLQIRGHAIEVRINAERLPNFAPCPGKITQYHAPGGLGVRIDSALYDGYKIPPYYDSLIGKLIVHGRDRNEALARLNRALGELIVDGVDTTIPLFRQLLEEPDILKGDYSIHWLEKWL

SEQ ID NO: 21777 - protein, 523 aa, Rhodobacter capsulatus
PRRIECPSVLLLSTAALALTAGAAQADYTLHILHTNDLHSRIEEINKYDSTCSEKDAAEAKCFGGIARVAAKVAALRTELAGQNVIVLDAGDQFQGSLFYTTYKGADTAEFMSKIGYDAMAVGNHEFDDGPEGLAAFVAKVQFPLVSGNLDLSRSSLKDKIFDTVVLQAGGEKIGLVSALATDTVETSSPGPDITFQDEIESLKADVQALTDQGVTKIIAIPHTGFVKDQEIAAAVPGIDAVVGGHSHTLFGPKGAAYPTMVGGVPVVSAYAYSKYLGHLVLTFDDAGHLKSAGGEPILLDASVTPDAAVAARVAELAKPLQEIRDKVVAESTSEIDGSRDHCRQTECAMGNLVAEAMLDRVKDQGIAIAITNGGGLRASIDAGPVTMGEVLTVLPFQNTLSTFEAKGATILAALENGVGAVEEGEGRFPQVAGLRYSFDPAKPAGARVSAVQVATALGWAPLDVTATYGVVTNNFLRGGGDGYRMFAAEGMNAYDFGPDLADVTAEFLARHSPYAAAVDGRI

SEQ ID NO: 21778 - protein, 336 aa, Rhodobacter capsulatus
LDPETAHGLALKALQMGLVPGCGPVTGARLATTVAGLALRNPVGLAAGFDKNAVALGPLMRAGFGFLEVGAATPRPQEGNPKPRLWRLAEDRAVINRFGFNNEGMEPIAARLAARPAGVPVGLNLGANKDSADRAADFATVLKRAGAHIDFATVNVSSPNTEKLRDLQGKEALAALLRGVLAARAELGRPLPVFLKIAPDLSPAELEDVAEVARAVGIDGIVATNTTLSREGLKSASSSQAGGLSGAPLFEKSTRVLAHLSKLTEGKLPLIGVGGISSAEEAYEKIRAGASAVQLYSAMVYKGIGLAAEVARGLDALLARDGFASVAEAVGTGRSR

SEQ ID NO: 21779 - protein, 656 aa, Rhodobacter capsulatus
MGKQEQVVAAPEMREVPAGFETAHANGAKYLEMYRESLENPDAFWGREGKRLDWITPYTKVKNTDFTFGKVSIKWFEDGVLNASVNCIDRHLRDRALQTAIIFEPDDPKEPARHITYKELSEKVNRMANVLLSQGIMRGDRVVIYLPMIPEAAYAMLACARIGAIHSIVFAGFSPDALANRINDCGAKLVITADTAPRGGRRTPLKANTDAALLHCSDKVRCLVVKHTGDQISWVHGRDVDLLYLMEHVSPECPPRPMNAEDPLFILYTSGSTGKPKGVVHTTGGYLVYAAMTHQYTFDYKDGDVFWCTADVGWVTGPSYIIYGPLANGATTLMFEGVPTWPDAGRFWAVCEKHKVNQFYTAPTAIRALMGQGPEWVEKYDLSSLRVLGSVGEPINPEAWVWYDKYVGKGKCPIVDTFWQTETGGHMITPLPGATPTKPGSATNPFFGVKPVVLDPQTAVRIGEVECEGVLCISDSWPGQMRTVWGDHDRFQETYFGQYRGYYFTGDGCRRDKDGYYWITGRVDDVINVSGHRMGTAEVESALVAHPQVAEAAVVGYPHDIKGQGIYAYVTLMNGIEPSEDLRKDLVKWVRTEIGPIASPDLIQWAPGLPKTRSGKIMRRILRKIAENDYGALGDISTLADPGVVQELIDNRMNRA

SEQ ID NO: 21780 - protein, 1105 aa, Rhodobacter capsulatus
PEAEVLQALVAQAALPQPQLDRIAARGADLVARIRAEAKPSLMEHFLAQYGLSTREGVALMCLAEAMLRVPDTATIDALIEDKIAPSDWGKHLGTAASSLVNASTWALMLTGKVLDDGAGGIAGTLRGAMRRLGEPVIRAAVGQAMREMGRQFVLGETIEKALERAEKREAEGYTFSYDMLGEAALTAADAERYRLAYAQAITAIGKAATRGSIAANPGISIKLSALHPRYEVAQEARVMAELVPVVRDLARAAARAGIALHIDAEEQDRLALSLRVMAAVIADPETAGWEGFGAVVQAYGKRAGAAIDALAAMARAAGRRINIRLVKGAYWDAEMKRAQVEGHPGFPLFTSKTGTDVAYICLAAKLFGLNDCIYPQFATHNAHTVAAVLEMAAGRPFEFQRLHGMGARLHDIVLRETGGRCRIYAPVGAHRDLLAYLVRRLLENGANSSFVNQIVNESVPPAEVAACPFAALPTARAPRGLLAPADLFGAGRVNAQGFDLSDPEVLARIEAARDVTLPDAAPIVAGPVSGTLRPVRNPATGAVVAQVTEADAATVALALDAAQVWSAPAATRAAVLCRAADLYEENFGPIFAALAQEAGKTLGDAVSELREAVDFLRYYAAEGAADTRPPRGAVVAISPWNFPLAIFTGQVAAALMAGNAVLAKPAEQTPIIAALAVRLLHQAGVPETALQLLPGDGPTVGAALTRDPRVAGVVFTGSTETAQIIARAMAAHLAPGTPLIAETGGLNAMVVDSTALPEQAVRDVVASAFRSAGQRCSALRCLYVQDDIAPHLIGMLKGAMEELVSGDPARLSTDVGPVIDAEAKAGIETYLAANKARILHRSTAPEGGHFVAPALLQVGGIADLEREIFGPVLHLATFAAEDLPAVIAAINARGYGLTFGLHSRIDARVETVAETIRAGNIYVNRNQIGAVVGSQPFGGEGLSGTGPKAGGPLYLNRFYAPEPVVAVGGWTEAATPILPEARETQLDEIFLPGPTGELNRLTRHQRGPILCLGPGAEAASAQAAAVVALGGQAVQASGAVSPKALETLTPLAGVLWWGAAEMGRAYAQALAVRPGPLVPLITAKPDLAHVAHERHLCVDTTAAG

SEQ ID NO: 21781 - protein, 478 aa, Rhodobacter capsulatus
VLAIDQGTTNTKALVVAGDGSVLARAAAPLVTQYPQSGWAEQSAEALWASVQQVIAQALQAAPGPVDAIAIANQRETLVLWDAVTHQPLCPAMIWQCRRTAEDCAALAATGIGPVVAAATGLGLNPLFPASKLAWALRNIPAVAAAQDSGRLRAGTVDAWLLWNLTGGAVHATDHSNAARTLLFDTASLSFSPELAAIFAVPMACLPQPLPSDSLFGTTAAGVTALPAGVSIHAMMGDSHAALYGHGVRAPGAVKATYGTGSSLMTLTPARVTSRHGLSGTIGWTDRQGTAYALEGNITVSAQAAAFMAKLLGLADARALSDLAQTVPDAGGVSFVPALAGLGAPHWNDAARGTLTGMSHATGPAHLARAALDAIAHQIADVFEAMQADIGHPLAALSADGGASGNDFLMQLQADLIGRPVQVAALEEVGAMGVAAMAMAALGHRLPLAAPKPPFHPGLRPAERDRQRRAWAHAVAQA

SEQ ID NO: 21782 - protein, 556 aa, Rhodobacter capsulatus
GHPGGDFSAIDILATLYFGVMRHDATRPDWAERDRFIMSKGHATGALYTALCAAGYFPEGWLQTYMQPRSKLNGHPNRNYLPGIETNTGPLGHGFPVATGIAIAGQLTGADYRTFVLTGDGEQQEGSNWEAAMTAGFRKLENLTLIIDRNRLQQGQSTEETSGMEPLDERYRAFGFEVAVVDGHDLGALLDVLSAAPKGRGKPLCVIANTVKGKGVSFMENQAKWHHGVPDDAQIRASDEGAGVMSHAAPIKAGLADCRNAWVETLEALAAEDERIVAVVNDSVGSSKLNGFQKKFPDRLINVGIAEQLMVGVAAGLANGGRIPFVSAASCFLTGRALEQVKADVAYAGFNVKLVGQSSGVAYGELGATHHSIEDFAWLRPLTTITTIAPADAWETAEAVKWAAGHDGPVYLRLSRMPVPDLDIPGRKFTPGKAEVVRKGGDVTVIACGTTVHLAAEAADRLSDKGLSVRVLNMATINPIDVDAILAAARETGAIVTVEEASVRGGLGGAVAEITAGECPVPVERLGFPGFVPTGSTEWLFEEYGLSVAGISAAVR

SEQ ID NO: 21783 - protein, 409 aa, Rhodobacter capsulatus
MRRVVITGLGIVSPIGNSAEEVSASLRAGRSGIVFAPEYAERGFRSQIHGAPQIVLEDHIDKRNLRFMGRGAAYNFLSMEQAIRDSGLEESDISNPRTGLIMGSGGPSTSNFFEAHQTVLQKGAPKRMGPFMVTRCMSSTNSACLATPFKIKGVNYSITSACSTSAHCIGNAAELIQMGKQDIIFAGGGEELDWTLSCLFDAMGAMSSKYNDTPTTAARAFDATRDGFVIAGGGGVLVLEELEHAKARGAKIYAEVTGYGATSDGYDMVAPSGEGGERSMRLALGTLPEGRQITYINAHGTSTPAGDVTEVEAVRRVFGAGKVPPISSTKSLTGHSLGATGVHEAIYCLLMMQGKFITASANVTELDPAIKPEEIATKLVENVEFDSVLSNSFGFGGTNATLVMSAYKG

SEQ ID NO: 21784 - protein, 264 aa, Rhodobacter capsulatus
VFLFAGRAEYAEKYGPAAADLAARGYGTLVIDWRGQGLSDRLIADPVKGFVGKFSDYQRDVDAMLAAAAQLDLPRPWVVLAHSMGGTIALRRLMGTHPFAAVAFSAPMWGVGLPRAIRPFGPVLARMTGSSPFALRYAPGWGPVTFVHRAGFHDNFLTTDPDMWALLLRQVAKAPGLAIAGASLHWVAEAVLECEALADVPAPDLPCHCALGTRERIVPKAPIRDRMASWPRAELALYDGAEHEVMMEGPAMRARFYDACAALF

SEQ ID NO: 21785 - protein, 426 aa, Rhodobacter capsulatus
PMTDQAFDTLQIHAGAEPDPATGARQVPIYQTTSYVFKDADHAARLFGLQEVGYIYSRLTNPTVSALAARVAALEGGVGAVCCSSGHAAQIMALFPLMGPGLNIVASTRLYGGTITQFSQTIKRFGWSCTFVDFDDLAALEAAVDDNTRAIFCESISNPGGYITDLPAVAAVANKVGLPLIVDNTLASPYLCRPIEHGATLVVHSATKYLTGNGTVTGGVIVDSGKFDWSASGKFPSLSAPEPAYHGLKFHEALGPMAFTFHSIAVGLRDLGMTMNPQGAHYTLMGIETLSLRMDKHVANAKAVAEWLAKDPRIDFVTWAGLPSSPWHERAERLCPKGAGALFTVAVKGGYEACVKLVNNLKLFSHVANLGDARSLIIHSASTTHRQLTEEQQIKAGAAPNVVRLSIGIENAADLIADLDQALAAA

SEQ ID NO: 21786 - protein, 438 aa, Rhodobacter capsulatus
WLKEHPEVRTIRVAAADLNGVARGKRIPARFASKVFSEGTRFPFSVMNLDIWGEDIEESPLVFETGDCDGLLRPTERGFMPMPWLEAPTALLPIWMFHMDGRPYSGDPRQALARVKDRYTEKGLTPVVATELEFFLIDDSGTKLRVPPSPRSGKRRTGGEILSLRALDAFDGFFTALYEACEVMDIPADTAISEAGPGQFEINLMHQADPLKAADDTWLFKMLVKGLARQHGFAASFMAKPYDLWSGNGMHTHFSILDQNGENIFNDGTEKGSDALRSAVAGCLAALPGSTLIFAPHQNSYTRLVPNAHAPTGIGWAYENRTAALRIPSSGPAARRIEHRVAGGDVNPYLMIAAILGAALVGLEDKMVPDEPIVGNAYAQYLPQLPATWNLAINQFDSCPLIKRIFEEELIENFLMTKRQEIHYMAELSEEEQTELYL

SEQ ID NO: 21787 - protein, 332 aa, Rhodobacter capsulatus
MGYKVVVVGATGNVGKEMLNILAEREFPVDEIAALASRKSLGTEVSFGDRTLKTQDLDTFDFTGWDIALFAIGSDATKVYAPKAASQGCVVIDNSSLYRYDPEIPLIVPEVNADDVVRYTNKMIIANPNCSTAQMVVALKPLHDRAKIKRVVVSTYQSVSGTGKEAMDELWNQTKGMYVPGQEVAPKVYPKQIAFNVIPHIDVFLDSGETKEEWKMVAETKKILDPSIKVTATCVRVPVFVGHSEAVNIEFEEFLDWEEATEILREAPGVLVVDKREAGGYITPVECVGEYATYISRIRQDSTIENGLNLWCVSDNLRKGAALNAVQIAEVL

SEQ ID NO: 21788 - protein, 230 aa, Rhodobacter capsulatus
MLTLDNLLIEQDDFRLSADFAIPPAARVALLGPSGAGKSTLLATLAGFLAPGRGRILWRGADITGLAPGARPLSILFQDQNLFPHLNVAQNLGLGLSPKLRLARADHAQIAAALDRVGLSGLGDRRPATLSGGQQSRVALARCLLRAKPLLLLDEPFAALGPALKSDMLALVAEIAADQHATVLMVSHEPADAVALCPQTVLVAEGVAHPPAATAGLLADPPPALAAYLG

SEQ ID NO: 21789 - protein, 455 aa, Rhodobacter capsulatus
EKALIVKRLRAILPRDSVIDDPAETRAYECDALSAYRCAPLAVVLPRTTEEVAACLKLCHEMGVPVVPRGAGTSLAGGSMPSADAVVLGLARMNRVLEVDYANRFIRVEAGRTNLSVTGAIEGEGWFYAPDPSSQLACAIAGNIGMNSGGAHCLKYGVTTNNLLGVKLVTMQGEVVEIGGPYCDAGGLDLLGVICGSEGQLGVVTEATLRILRQPEGARPVLIGFSSNEVAGACVADIIRAGILPVAIEFMDRPCIEATEAFCHAGYPDCEALLIVECEGSPAEIAEQLGLIRQIATGHDPVEFREAQSPEEAKRIWLGRKSAFGAMGQKGDYMCLDGTIPVSALPMVLRRIGEISRDFGLEVGNVFHAGDGNMHPLIIYNANQPGQQELCERMGAEILKLCVEAGGCLTGEHGVGIEKRDLMAVQFAPEDLEAQMRVKDVFDPKWLLNAAKVFP

SEQ ID NO: 21790 - protein, 214 aa, Rhodobacter capsulatus
MLEFDNVSKSFWTGKRRKVILDRASFRVELGNSLGILAPNGTGKTTIINMMAGLEKPDEGEIRKTCRISFPLGFMGGVVPRHSGRENTRFIARLYGLDPDYVEAFCRWLCGLEEYFDMPVGTYSQGMRARLTFALLLALEFDIYLIDEGMPSTTDVEFNRKAGAILRDRLREATVIVVSHQASTLEKFCRSAAVLRDGQLYMFDTLEEAKRMYD

SEQ ID NO: 21791 - protein, 528 aa, Rhodobacter capsulatus
ARLVAEDLMTTHLLVLDAGTGSGRAVVFDRAGNQVGVAQEEWRHLPEPGVPGSMAFDIAGGWALLRRCIQGALASCGLTGRDIAAISATSMREAIVLYDGAGREIWACANVDSRAGAEVAELRARSAGFERDFYDISGEAFALGALPRLNWVRRHAPEVFERVRAISMVNDWIGKRLTGEITVEPTNGSTNGLLDLTTRQWSEVLIAKAGLDRAIFPRIVEPGTVIGEVTAAAAADTGLRAGTPVVAGGGDVQLGAIGLGVVELGAAAVLGGTFWQQVVNIPQGKVDETMRLRVNAAALPGMNQAEALTFFVGLTARWFRDAFCQEEVRRAAETGRDAYALMEELAMQVPAGSHGIIPVFSDAMDFGNWYHAAPSLLNLSIDPAVANKGSIFRAIQENAAIVAAVNLARVEAFAGVGGTGPLVLAGGAAKGVLWPQILADVTGREIHIPVVREATALGGAAAAATGVGQFATIAEAGRAFVRWDRTIRPDATNRAVYDEARGRWQAAYAAQKALVDAGLTTSMWRAPG

SEQ ID NO: 21792 - protein, 613 aa, Rhodobacter capsulatus
  unsure (1)..(613): unsure at all Xaa locations
PPRPTTLSPPGMSRLARVLALFAPYRRRIAGVVALMLLAAAIGLAGPFLLRAVIDVALPGQDLGLLLLLVGGMVTVALAAAAVGAWQVVLTARIGQAILHDLRVRLYAHLQSLSLRFFTGTRTGEVQSRIAGDISGLQAMLTETASELGRALSAVVMTAIAIVILDWRLALFVLVIVPGTVLISHRVARLREALMWQRQARAADLSAAVQETLSVPGIILARTMGRGPHLTRRFARLSDDLARLDARAQTAGEGQWMLIGFALAVLPALTLLAGGLLMRSDDPASIGTLVAMIALQEQLLWPFEQLLEIGRDLRKTRALFARIFEYLDTPVEITERPAPVTLERARMRGAIELDHVSFSYAGAARPAVDDISLNIPAGSHVAIVGPTGSGKTTLGYLLARLYDVDHGAIRFDGIDLRDLSFGTLSQMLGVVSQEPYLLHASVAENLRFARPEASDAELIAAAKVAQIHDHIAALPEGYETRVGEGGFRFSGGEKQRLALARTILRDPPILLLDEATSALDTRTERAMSEALDGLARGRTTITIAHRLSTVRHADRIVVMQAGRVVEEGPHETLRAQGGLYAKLLRGTXARDAGLCSVPASGGPCCARSASGRT

SEQ ID NO: 21793 - protein, 259 aa, Rhodobacter capsulatus
MTGQLAGRTIFITGSGGVLGSTYVRRMLDQGARVVATDLPGHRAEALQAAHAGNAAFRFYDLDVGDEAQVTEIFKRVLADGWEPNVVLNNAAITGEMLMGAGKPFPDFADTSVADFERTLRTNLTGAFMVARQMDRDIVGRWPATLINVASMYALNGAHHPIYDGMPFKNFSAYGVTKAGIHGLTVWLAGYWAPRGATVNTIAPGAVFNNHSEEFQRRVGELIMMGRMAKPDEIADAMLFLCSAGAGYMTGQLVNVDGG

SEQ ID NO: 21794 - protein, 472 aa, Rhodobacter capsulatus
MASKGKVTQVIGAVVDVQFEDGLPAILNALETTNNGKRLVLEVAQHLGENTVRTIAMDATEGLVRGAAVSDTGGPITVPVGNATLGRILNVIGEPVDERGDVSKAEARAIHQPAPDFAAQSTESQILVTGIKVIDLLAPYSKGGKIGLFGGAGVGKTVLIMELINNIAKVHSGFSVFAGVGERTREGNDLYHEMIESGVINLEKLEESKVALVYGQMNEPPGARARVALTGLTLAEQFRDQSGTDVLFFVDNIFRFTQAGSEVSALLGRIPSAVGYQPTLATDMGALQERITSTKAGSITSVQAIYVPADDLTDPAPATSFAHLDATTVLSRAISELGIYPAVDPLDSTSRILDPQVVGEEHYQVARDVQGMLQRYKSLQDIIAILGMDELSEEDKLTVARARKIQRFLSQPFDVAKVFTGSDGVQVPLEDTIKSFKAVVAGEYDHLPEAAFYMVGGIDDVIAKAQRLAAAA

SEQ ID NO: 21795 - protein, 290 aa, Rhodobacter capsulatus
MPSLKDLKNRIVSVKNTRKITKAMQMVAAAKLRRAQESAEAARPYAERMNAVMSSLAGAVGSTDGAPRLLAGTGSDKVHLLVIMTGERGLCGGFNANIAKLAKAKAMELLAQGKTVKILTVGKKGRDALRRDLGQYYIDHIDLSDVKKLSYPVAQKISQNIIDRFEAGEYDVATIFFSVFQSVISQVPTAKQVIPAQFETDAASASAVYDYEPGDQEILTALLPRAVATAIFAALLENNASFNGAQMSAMDNATRNAGDMIDRLTIEYNRSRQAAITKELIEIISGAEAL

SEQ ID NO: 21796 - protein, 509 aa, Rhodobacter capsulatus
MGIQAAEISAILKEQIKNFGQDAQVAEVGRVLSVGDGIARVHGLDNVQAGEMVEFPGGIRGMALNLEVDNVGIVIFGSDRDIKEGDTVKRTNAIVDVPAGEGLLGRVVDGLGNPIDGKGPIVAKERRIADVKAPGIIPRKSVHEPMATGLKSVDAMIPIGRGQRELIIGDRQTGKTAIALDTILNQKSYNDANPGNKLHCFYVAIGQKRSTVAQLVKKLEEAGAMEYTTVVAATASDPAPMQFLAPYSATAMAEYFRDNGMHALIIYDDLSKQAVAYRQMSLLLRRPPGREAYPGDVFYLHSRLLERSAKLNEDFGSGSLTALPVIETQGGDVSAFIPTNVISITDGQIFLETELFYQGIRPAVNTGLSVSRVGSSAQTNSMKSVAGPVKLELAQYREMAAFAQFGSDLDAATQKLLNRGARLTELMKQPQYSPLTNAEIVAVIFAGTNGFLDAVPVKEVGRFEKGLLAYLRSTRKDVLEWLTKEDPKIKGDAEKKLKDAIAEFAKTFA

SEQ ID NO: 21797 - protein, 186 aa, Rhodobacter capsulatus
VSEPASISAAIAGRYATAIFDLAQEAKGIDALSADVDALTAALAGSAELRDLISSPVYTREEQGDAIAAVAAKMGLSAPLANGLKLMATKRRLFALPQLLKGLAAAIAEAKGEMTADVTSATALSAAQAEKLAATLAKQTGKTVKLNVAVDESLIGGMIVKLGSRMIDTTVKAKLASLQNAMKEVG

SEQ ID NO: 21798 - protein, 740 aa, Rhodobacter capsulatus
FSTTLEQAIHAALALANTRKHELATLEHLLLALIDEPDASRVMRACGVDLGELRTTLTEFIDDDLSTLITEVEGSEAVPTAAFQRVIQRAAIHVQSSGRTEVTGANVLVAIFAERESNAAFFLQEQDMTRYDAVNFIAHGVAKDPAFGESRPVIGAEEETAKAEAAQPGEAKESALGKYCVNLNQKSQKGDIDPLIGRAEEVERCIQVLCRRRKNNPLLVGDPGVGKTAIAEGLALKITRGETPDILARSTIYSLDMGALLAGTRYRGDFEERLKAVMKELEDHPDAILFIDEIHTVIGAGATSGGAMDASNLLKPALQGGKLRCMGSTTYKEFRQHFEKDRALSRRFQKIDVNEPSVGDSIKILMGLKPYFEEHHDVRYTNDAIKSAVELAARYIHDRKLPDKAIDVIDEAGAAQHLLPDSKKRKTLGAKEIEAVVAKIARIPPKSVSKDDAAILRDLEKTLKRVVFGQDKAIETLASAIKLARAGLREPEKPIGNYLFAGPTGVGKTEVAKQLANTLGVELLRFDMSEYMEKHAVSRLIGAPPGYVGFDQGGLLTDGVDQHPHCVLLLDEIEKAHSDVFNILLQVMDHGKLTDHNGRQVDFRNVILIMTSNAGAAEQAKSAIGFGRERREGEDTAAIERTFTPEFRNRLDAVVSFAPLPRDTILQVVDKFVLQLEAQLIDRNVHIELTPEAAEWLAVKGYDDKMGARPLGRVIQEHIKKPLAEELLFGRLIKGGVVRV

SEQ ID NO: 21799 - protein, 350 aa, Rhodobacter capsulatus
IRPQPGILDIALYEGGASHVAGISDAIKLSSNENPHGASDRAKEAFSRTVHKLHRYPSTDHAALRQAIGDVHGLDPARIICGVGSDEIIRMIVNAYAGPKDEVVHSEHGFLMYRIAALGAGATPVSVPERERTLDVDAILKACGKKTKLVFIANPNNPTGTMVGLAELERLAMGIPKQAMLIIDSAYAEYVEGYDGGADLASRLPNVMMTRTFSKIYGLGGLRIGWGYGPKDIIDVLNRIRDPFNLSTSQLETAEAAVRDQDWVVQSRSENARLRHWLSEALAERGVPNDTSMANFVLARFGSEAEAEACDEFLKKDGLIVRRVASYGLPHCLRITVGDEPSCRRVAHMI

SEQ ID NO: 21800 - protein, 246 aa, Rhodobacter capsulatus
VFVVTGGGSGLGAAVARMVVDAGGKVVIVDLNAEAGMAMASDLGAASRFCRADVTQEGDGRAAIDLAVSVFGRLDALVNCAGIAPGEKILGREGPHRLESFARAVTVNLVGTFNMLRLAAEAMAGNAPGPGGERGVIVNTASIAAFDGQIGQAAYAASKGGVAALTLPAARELARHGIRVVTVAPGIFRTPMMAGLPQEVQDSLGASVPFPNRLGDPAEYAALVRHICENQMLNGEVLRLDGALRM

SEQ ID NO: 21801 - protein, 389 aa, Rhodobacter capsulatus
MDPVVIAGAARTPMGGFQGAFSELAAADLGAVALGAALDRAGVPAAEVDEVLMGCVLPAGQGQAPARQAALKAGLPLAAGATTINKMCGSGMKAAMLGHDLLLAGSARVVLAGGMESMTNAPYLLPKARGGLRLGHGQVLDHMFLDGLEDAYDRGRLMGTFAEDCAEAFGFTRQAQDDYAIASLTRAQAAIASGAFAAEIAPVEAGRAGLITTDEQPGKARLDKIATLKPAFRPGGTVTAANSSSISDGAAALVLMRASEAEARGLTPLARVLGHATHADAPNLFPTAPIGALTKLAEKLDLDLRRIDLFEVNEAFAVVAMAAMAALDLPHDRVNPHGGACALGHPIGASGARVLVTLLAALRRHGLRTGVATLCIGGGEATAMAVELM

SEQ ID NO: 21802 - protein, 410 aa, Rhodobacter capsulatus
IDTMGQAARTAAAELAFAPAPRKRAALIAAAEAVAARQDEILAANAEDMIFGRDKGLSPAMLDRLRLDETRLRGIVEGLRAVAEQHDPVGEVIAEWDRPTGLHIQRVRTPLGVIGVIYESRPNVTADAGALCLKAGNAVILRGGSESFHSSRAIHACMVAGLKAADLPEAAIQLVPTRDRAAVAAMLRAVAHIDVIVPRGGKGLVGLVQAEARVPVFAHLEGICHIYADADADLEKARRVVVNAKTRRTGICGAMECLLIDRAFYAKHGAVLIEDLIAKGVEMRVSADLAHIPGTKPAAEEDFGREFLDMICAAKLVDGVDGAIAHIRRYGSSHTESILTENDATAARFFERLDSAILMRNASTQFADGGEFGMGAEIGIATGKLHARGPVGAEQLTSFKYLVRGDGTIR

SEQ ID NO: 21803 - protein, 949 aa, Rhodobacter capsulatus
  unsure (1)..(949): unsure at all Xaa locations
DMGTPKREGAPVHLTIDGVEVTVPAGTSVLRAAAEAGISIPKLCATDNVEPVGSCRLCMVEIEGMRGTPTSCTTPVAPGMRVHTQTPQLQKLRRGVMELYISDHPLDCLTCAANGDCELQDMAGAVGLREVRYSGEGHPFRAPRCTGPNPRYIPKDNSNPYFSYDPAKCIVCMRCVRACEEVQGTFALTVMGRGFDARISPAAPDFLSSDCVSCGACVQACPTATLVEKSVERIGTPERKVVTTCAYCGVGCSFEAHMLGDQLVRMVPWKGGAANRGHSCVKGRFAYGYATHQDRILKPMIRDKITDPWREVNWTEALDFTATRLRALRDSHGADALGVITSSRCTNEETYLVQKLARAVFGTNNTDTCARVCHSPTGYGLKQTFGTSAGTQDFDSVEETDLALVIGANPTDGHPVFASRLRKRLRAGAKLIVVDPRRIDLLNTPHRGEAWHLQLKPGTNVAVMTAMAHVIVTEQIFDKRFIGDRCDWDEWADYAEFVANPEYAPEAVESLTGVPAGLLRQAARAYAAAPNAAIYYGLGVTEHSQGSTTVIAIANLAMMTGNIGRPGVGVNPLRGQNNVQGSCDMGSFPHEFPGYRHVSDDATRGLFERTWGVTLSSEPGLRIPNMLDAAVEGRFKALYVQGEDILQSDPDTRHVSAGLAAMDLVIVHDLFLNETRIYAHVFLPGSTFLEKDGTFTNAERRINRVRRVMAPKAGFADWEVTQMLANALGAGWHYTHPSEIMAEIAATTPGFAAVTYEMLDARGSVQWPCNEKAPEGSPIMHVEGFVRGKGRFIRTAYLPTDEKTGPRFPLLLTTGRILSQYNVGAQTRRTENTVWHGEDRLEIHPTDAETRGIRDGDWVRLASRAGETTLRATVTDRVSPGVVYTTFHHPDTQANVVTTDTSDWATNCPEYKVTAVQVAASNGPSDWQQDYAAQAAAARRIEAAEXACP

SEQ ID NO: 21804 - protein, 426 aa, Rhodobacter capsulatus
QPLRLGIAGLGTVGIGVVKIVQRHADLLAARSGRPVVITAVSARDRTKNRDADLSGYAWETDPVALALRDDVDVLVEVMGGHEGPAKDATEAALKAGKDVVTANKALLAHHGQALAELAEGLGRVIRYEAAVAGGIPVIKALTEGLAGNQIRRVMGVMNGTCNYILTRMETAGLPYETVFEEARQLGYLEADPNLDVGGIDAGHKLSILASIAFGTKVSFANVVLEGIGCISIDDIRRAGDMGYKIKLLGVAQMTGRGLEQRMMPCLVPAASPLGQLQGGTNMVVIEGDSVGQIVLRGAGAGEGPTASAVMGDVLDIARGLRLPTFGQPAAGLADPIPAAVSAPAPYYLRLELMDKPGALAKVAAVLGEAGVSISRMRQYGHEDTSAPVLIVTHKTTRDAIDVAIAALPATGVVLGAPVALRIEEV

SEQ ID NO: 21805 - protein, 168 aa, Rhodobacter capsulatus
IRTIADFPHEGIMFRDVTTLFADPRGFRMAIDQLLHPWAGEQIDKVVGLEARGFILGGAIAHQLSKGFVPIRKKGKLPGQTISQSYKLEYGEAIMELHDDAIQPGEKVLVVDDLLATGGTCEAAIKLVERLGGEIVGCSFIVDLPELGGRNLLRDLGMQVHVLCEFDG

SEQ ID NO: 21806 - protein, 450 aa, Rhodobacter capsulatus
VPGLWLGEAEPRYLEEPRGRWRGQAGVLARPESVAQVSALLAFCHAEAVGVVPFGGGTGLVGGQVAPEGPAPVLLSLERMRAVRQVTPQALVIEAGATLQAVQDAAAAAGKRFPLTLASQGSAQIGGCLATNAGGVNVLRYGSARALCLGLEVVLADGTIWHGLKRLAKDNTGYDLRDLIIGSEGSLGIITAASLRLHEPPAVEGVALMAVPSPAAAVQLLGLAQARFAGCVSAFELISGQGLAFLREVGPEVALPFAADPDWSVLIELGLPAGMAAEAAFADLYEAAGDLVTDAVVAQSGAQAAALWAMRESIPLANRRIGAISSHDIAVPVADIPAFIAAATERLADMGDFRINCFGHVGDGNLHFNVFPAGGRRRDDYEPIRSAVMAAVHRLVVDSFDGSISAEHGIGRLKVGELARSADPAKMEMMRAIKSALDPRGILNPGVILP

SEQ ID NO: 21807 - protein, 399 aa, Rhodobacter capsulatus
TTLPNGLRIVTERMPGLASASVGVWVLAGGRHERLEQNGIAHFLEHMAFKGTKTRTALQIAEAIEDVGGYINAYTSREATAYYARVLKADVGLALDVISDIVLNSVFDPREIEVERHVILQEIGQALDTPDDIIFDWLQEAAYPDQAMGRTILGPSENIERFGREDFERFVAEHYGPDQMILSAAGAVDHAAIVKQAERLFGHLRPIGAPAVQLARWSGNERRELKDLEQVHFALAFEGPGYRDADLYTAQVYATALGGGMSSRLFQKIREERGLCYSIFAQAGAYDDTGMITIYAGTSGEEVADLCGLTIDELKRAAEDMTEAEVARARAQMKAGMLMGLESPSSRAERMARNLAIWGRVPGLDEVSTLIDGVTVEAVRSYAGRMIAQDRTALALYGP

SEQ ID NO: 21808 - protein, 335 aa, Rhodobacter capsulatus
VPFVGPETQERLRGRPFRARLGANENGFGPSPRAIAAMAAAAGEAWMYGDPENHDLKVALAHAHGCGVENVVVGEGIDGLLGTLCRMVLKPGDAVVTSEGAYPTFNFHVAGFGGVLHKAPYRNDAEDPEALLALAQQVRPKLLYIANPDNPMASHHPGAVIAAMLDHLPEGTLMVLDEAYVELAPEGTAAPVAADDPRVIRMRTFSKAHGLAGARVGYALGAAPLIAAFDKIRNHFGISRISQAGTLAALSDTTWQVYMRRLVAASRDRIAAIAADNGLSALPSATNFVAVDCGGDGAFARAVLEELTAADIFVRKPAVAPMDRCIRISCGPEAE

SEQ ID NO: 21809 - protein, 187 aa, Rhodobacter capsulatus
DFAARRTMMVDTQVRPNDVTKFPIIEAMLAVPREAYVPDARREAAYVGENLDLGQGRWLLEPRNFAKMLDALDIQPGDLVLDIGAGMGYSSAVLARMAKAVVALEEGTLAASAEAHLSVQDIEGVTVVEGRLEAGVADEGPYDAIVIEGGVEQVPAAIEAQLKEGGRIAAIFMQGPLGTVRIGRKID

SEQ ID NO: 21810 - protein, 309 aa, Rhodobacter capsulatus
  unsure (1)..(309): unsure at all Xaa locations
FLDIHTTSPADLRSMIDSARAMKTARLGRPKGALDDDQPLAGCMVALIFEKPSTRTRVSFDVGVRQMGGQTMVLSGKEMQLGHGETIADTARVLSRYVDLIMIRTFEEATLLEMAEYASVPVINGLTNRTHPCQIMADIMTYEEHRGPIAGRKVVWSGDGNNVCASFLQAAGQFGFDLTFTGPQALDPERDWIEFARSKGVNVVIERDPAKAVEGADLVVTDTWVSMHDPESAKERRHNQLRPYQVNETLMAKAKPDALFMHCLPAHRNDEATSAVMDGPHSVIFDEAENRLHAQKAIMRWALGKXRLG

SEQ ID NO: 21811 - protein, 390 aa, Rhodobacter capsulatus
PFSGAANDASVLPTYTRAPLAFVRGEGSWLWTADGSRYLDLGAGIAVNALGHAAPDLVATLTEQAGKLWHVSNLYRIPEQERLADMLVAKTFADTVFFTNSGTEACELAVKMVRKHFYDKGQPERTEILTFSGAFHGRSSAAIAAAGTEKMVKGFGPLLPGFVHLPWGDLDAVKAAVTETTAAILIEPIQGEGGIRPAPEGFLRALREICDETGTLLVFDEVQCGVARTGKLFAHEWAGVTPDVMMVAKGIGGGFPLGAVLATEDAASGMIAGTHGSTYGGNPLGCAIGAKMIEIVTAPGFLDEVSRKAGFLRQWLEGLVAAHPDIFEEVRGQGLMLGLRLKLPPGDVVKAAYAQNLLTVPAADNVLRLLPALTISEDDMAEAVRRLDAA

SEQ ID NO: 21812 - protein, 597 aa, Rhodobacter capsulatus
RSKPKGEPMARRPATPLEDRPKPKRVGAIRGLAPFIAPYRRLALATAAALVLTAMVTLILPIAARRVVDGFQQGGEMLDSYFLAAHVIAAALALGTGLRYWLVTRFGERVVADIRKAVFGRVIELSPAFYEKILTGEIISRITTDTTLILSLLGSSISVAARNILILLGGLTMLLVTSAKLTGLVLLIVPLVIVPIVVMGRRLRRLSRENQDWIASSSGSASEALSSVQTVQAFTHEALTRKAFSEVTEKALASANDRITTRAIMTMIVIFLVFAGIVGVLWIGARDVQAGLMTVGQLVQFVIYAIMVSAAVGALTEIWGEVQRAAGATERLVELLHAGDTVTDPARPLALPSPVKGAIAFEDVTFHYPSRPETSALNAVSLQVAPGETVALVGPSGAGKTTIIQLIERFYDPEQGRITLDGIDLRDLARAEYRRALALVPQDPVIFAASARENIRFGRPDASDAEVEAAARAAYAHDFLTALPQGFDTYVGERGIMLSGGQKQRIAIARAILRDAPVLLLDEATSALDAASERAVQAAVDDLRATRTTLIVAHRLATVKKADRIVVFDQGRIVAQGTHEALVAEGGLYAELARLQF

SEQ ID NO: 21813 - protein, 514 aa, Rhodobacter capsulatus
KDHSLTMTWAEVLARVTQAANLLRRMGVGEKDTVAYLLPNSLETAVVLLGGATAGIVNPINPLLEPEQISAILRETKAKVLVTLKSFPKSDIAQKAAEAVKHAPNVKTILEVDLNRYLTAPKSWIVPFVRPKTHFRHHADVYDFNTACDGQPADKLVFADATADRVAAYFHTGGTTGMPKVAQHKYSGMVYNGWLGGTLLFRHTDVMICPLPLFHVFAAYPILMSAIHSGAHVVFPTPAGYRGEGVFDNFWKLVERWQVTFLITVPTAIAALMQRKVDADISSLRTAISGSAPLPVELYNRFKDATGVEICEGYGLTEATCLVSINPVDGLKKVGSVGIPLPYSHVRILRKTEAGFVECAADEVGEICVANPGVFDGSTYTEVDKNHDLFAEERFLRTGDLGRIDPDGYLWITGRAKDLIIRGGHNIDPAEIEEALLSHPSIAFAGAIGQPDAFAGELPCAYVELIKEATITPEELMAHAKRHIHERAAVPKHIEVLDELPKTAVGKIFKPDLR

SEQ ID NO: 21814 - protein, 418 aa, Rhodobacter capsulatus
TSPDLSARRAAAIAKGVGVTTQIYAERAENAEIWDKNGTRYIDFAAGIAVVNTGHRHPRVIEAVKAQLDAFTHTCHQVVPYENYVILAERLNAAVPGDFAKKTIFATTGAEAVENAIKIARHYTGRAGIVAFAGGFHGRTFMGMTLTGKVQPYKAGFGPMMNDVWHLPFPCPLHGVTGEDAVAALERLFKADIEPARVAAIIVEPVQGEGGFYPVPEGFMRKLREIADKNGIVLIADEVQTGFARTGKLFAMEHHGVAADITTMAKGLGGGFPISAVTGRADIMDSPNPGGLGGTYAGAPIAVAAAHAVLDVIEDEQLCARAERLGARLKQRLAALQDSVPEIIDIRGPGFMNAVEFNVAGSDTPNPEMTNRVREEALKRGLILLTCGVYGNVIRFLAPLTIQDAVFDEALDILEASI

SEQ ID NO: 21815 - protein, 528 aa, Rhodobacter capsulatus
FDYVILGGGSAGSVLAARLSENPATRVCLVEAGDAARDILVRAPALVAALVPGYLYAHNWALHTVPQPGLNGRRGFQPRGRGLGGSSAINAMLYVRGHPSDYDRWAAEGAVGWDWAACQPWFLKSERNMRGASAHHGADGPLQVGDQRRPRPITRAFVQACGAVDCPETDDFNGACQEGAAPFQVTQFWDGPKKGERCSAAAAYLHPVMDRPNLTVLTGARAEKVLISEGRATGALVRQGRHRLRLEAAREVILSAGAFGSPQLLMLSGIGPGAHLRDLGIDVVQDLPGVGANLQDHLDYTISHFSPRRDVVGLNPRGLWRLARAAGGWMRHGEGLFASPMAEGGAFLRSAPGVTVPDLQIHFVVGIVDAHMRKLHVADGWSAHICVLRPQSRGTVRLASKNPRKAPLIDPAFLADPRDEALMLRAARMLEEIVGAAALAPWRGDRLYPHDGSEAGLMADIRARADTIYHPVGTCRMGTDAIAVVDPQLRVRGIEGLRVVDASVMPSLIGGNTNAPTIMIAERAAAMI

SEQ ID NO: 21816 - protein, 468 aa, Rhodobacter capsulatus
MRRLRNVKIVATLGPASSDYKTIRALFEAGADVFRLNMSHGTHAEHKVRYDIIRQIEADTGRPVAVLADLQGPKLRVGTFAAGAADLEEGEPFRFDLDPTEGDGHRVCLPHPEIFAALEVGARLLVNDGKIRLRVTACGPDFADCIVTVGGTISNRKGVNVPDVVLPLAALSAKDRDDLEFACDLGADWLALSFVQRPEDVIEAKALARGRAQVLSKIEKPQAERAFDEILKVSDGIMVARGDLGVELPVESVPPIQKRLIRKCRAAAKPVIVATQMLESMIESPMPTRAEISDVATAIYEGADAIMLSAESAAGRYPVEAVQTMNAVARSVESDPTYRDIIEASRSAKRQTVADGIVAAAREIAETTDVSAICCYTQSGKTVALVCRERPRVPVIALSPITQTLRKLCLNWGVHAVRCDEVSRFKEAVVNAARAARDYGFADESHQIIVIAGVPFNVQGTTNILRVA

SEQ ID NO: 21817 - protein, 422 aa, Rhodobacter capsulatus
MDHFLYRNGVLHAEDVALTEIAAAVGTPFYVYSAATLTRHFQLFDAALAGTDHLVCFAIKSNSNLAVLKLLGDLGAGMDVVSGGEYRRAKAAGVPGDRIVFSGVGKTRDEIRLALTGGIRQFNVESEPELRAISEIATALGVTAPIALRVNPDVDAKTHEKIATGKSENKFGIPIAKARAVYAEAAKLPGIEVIGVDVHIGSQLTDLAPFEAAFTKVRELTLALREDGHKIRRLDLGGGLGIPYHQRSNEAPPLPTDYGAMITRVLGDLGCEIEIEPGRLISGNAGLMVTSVIYLKEGEGRNFLIVDAAMNDLVRPSMYGAHHDIVPVIEPAPGLAPQPFDVVGPVCETGDTFTKGRELPPMAEGDLVAFRSAGAYGAVMASEYNSRPLIPEVLVSGDHFAVIRQRPSFEEMLARDSIPEWL

SEQ ID NO: 21818 - protein, 457 aa, Rhodobacter capsulatus
MTDDTNSSNAMWGGRFAAGPDAIMEAINASISFDKRLYAQDIRGSRAHAAMLAATGILTNSDAEAIGEGLLTVLSEIEAGDFPFSTALEDIHMNVEARLKALIGEPAGRLHTARSRNDQVATDFRLWVRDQADAAITSLTALMKVLVAQAEKGADWVMPGFTHLQTAQPVTWGHHMMAYVEMFARDRSRFEDARKRMNECPLGSAALAGTGFPIDRHMTAQALGFDRPMANSLDGVSDRDFALEFLSAAAICSVHLSRLAEELVIWSSAQFRFVAMSDKWSTGSSIMPQKRNPDAAELIRAKIGRVLGAAVALFTVMKGLPLAYSKDMQEDKEQVFDAADTLMLALAAMTGMMSDLTVNTAKLEAAASSGFSTATDLADWLVREAGLPFRDAHHVTGSLVALAEKKGCDLPDLSLEELKSAHPALTEAVYSVLGVHNSVASRQSYGGTAPDQVRAQV

SEQ ID NO: 21819 - protein, 389 aa, Rhodobacter capsulatus
MTNVVIVSAARTAVGSFNGAFANTPAHELGAAAIEAVVARAGIDKAEVSETILGQVLTAGQGQNPARQAHIKAGLPIESAAWGINQVCGSGLRTVALGAQHIQLGDAAIVVAGGQESMSLSAHVAHLRAGTKMGDMKMIDSMIKDGLWDAFNGYHMGQTAENVAAQWGITREMQDEFALASQNKAEAAQKAGKFVDEIIPFTVKTRKGDIVVDADEYIRHGATLESMQKLKPAFTKDGTVTAGNASGINDGAAVVLLMTEEEAAKRGLTPLARIASYATAGLDPSIMGCGPIPASRKALEKAGWTAADLDRIEANEAFAAQACAVNKDMGWDVSKVNVNGGAIAIGHPIGASGCRILNTLVFEMKRSGAKKGLATLCIGGGMGVAMCLE

SEQ ID NO: 21820 - protein, 238 aa, Rhodobacter capsulatus
MSRVALVTGGSRGIGAAISMALKDAGYTVAANYAGNDEAAAKFTAETGIKTYKWSVADYDACAAGIAQVEADLGPVDVLVNNAGITRDAPFHKMTRDQWDQVIGTNLNGIFNMTHPLWNGMRDRKFGRIINISSINGQKGQFAQANYSAAKAGDIGFTKALAQEGARAGITVNAICPGYIATEMVMAVPEKVREQIIATIPVGRLGETGDIARCVVFLASDDAGFITGATLTANGGQY

SEQ ID NO: 21821 - protein, 312 aa, Rhodobacter capsulatus
MAAVNALIRERMSSEHAPRIPEVTAHLIEAGGKRLRPMLTLAAARLVGYGGPFHVHLAATVEFIHTATLLHDDVVDESRQRRGRPTANLLWDNKSSVLVGDYLFARSFQLMTDTGNMRVMEILANASAVIAEGEVLQLTAAQNLATTEDIYLRVIRGKTAALFSAATEVGGIIGGAPEDQVQALFDYGDALGIAFQIVDDLLDYGGKSAEIGKNTGDDFRERKLTMPVIKAVALADEAERAFWKRVIEKGDQQDGDLEHAMALMTKHGTLEATRLAAIGWTDTARKALAKLPDHPLRQMLDDLADYVVERVR

SEQ ID NO: 21822 - protein, 297 aa, Rhodobacter capsulatus
  unsure (1)..(297): unsure at all Xaa locations
AKIIDGKAFAARVRAEVATHVARLQETQGLTPGLAVVLVGEDPASQVYVKNKGIQTREVGMNSYEHKLSADTSEADLLALIARLNADPAVHGILVQLPLPKHLDADLVINAIDPAKDVDGFHISNVGLLGTGQKAMVPCTPLGCLMMLRDHHGSLAGLTAVVVGRSNIVGKPMAQLLLADSCTVTIAHSRTKDLAEVCRRADILVAAVGRPEMIPGDWVKPGATVIDVGINRIERDGKGKLVGDVHFDSAVQVAGAITPVPGGVGPMTIACLLANTLTACCRAHGLAEPEGLTAXAR

SEQ ID NO: 21823 - protein, 629 aa, Rhodobacter capsulatus
NLRNIAFWALLFVLILVLFNLLGSGQGPLNARQVSYSDFIAAVDKGDVKQVQLDGEDVRYQDSKGDNYSTTKEGTDAIADKLVAKGITVNVVKQQQSGLMSILGVWLPFLVMIGLWVFFMNRMQGGGKGGAMGFGKSKAKLLTEKHGRVTFDDVAGIDEAKEELEEIVEFLRNPQKFSRLGGKIPKGALLVGPPGTGKTLLARAIAGEAGVPFFTISGSDFVEMFVGVGASRVRDMFDQAKKNAPCIVFIDEIDAVGRARGVGIGGGNDEREQTLNQLLVEMDGFEANEGIIIVAATNRKDVLDPALLRPGRFDRQIHVPNPDIKGREKILSVHANKIPRGPDVDLRTIARGTPGFSGADLANLVNEAALMAARVGRRFVTMEDFENAKDKVMMGVERRSMVLTPEQKEMTAYHEAGHAVVGMKLPKCDPVYKATIIPRGQALGMVVSLPEMDRLNYHKDEAKQKIAMTMAGKAAEILKWGEEAVSNGPAGDIMQASAIARAMVMRWGMSDKVGNIDYSEAHEGYQGNTAGFSVSTKTKELIEEEVRILIENGYIEARRILEENIEEWERLAQGLLEYETLTGDEIRKVMAGETLGGDDDRPSGSLPTVTSLPRTKPVAKPGIAPEPNA

SEQ ID NO: 21824 - protein, 482 aa, Rhodobacter capsulatus
ILALDQGTTSTRAIVFDAGLRPLATASREFPQIFPAPGWVEHDPEAIWATVLSTIREALAQAGPVAALGLTNQRETTVIWDRATGVPLHNAIVWQDRRTAEICADLRAAGLEARMTAKTGLLLDPYFSGTKVKWLLDTIPGARERAERGELAFGTIDSFLIWRLTGGRVHATDATNAARTLLYDIGRNAWDAEICALLGVPMALLPEVKDCADDFGVTDPALFGAAIPITGVAGDQQAATVGQACFAPGMLKSTYGTGCFALLNTGAARVVSQNRLLTTIAYRLNGETTYALEGSIFIAGAVVQWLRDGLGLIARAAETQDLAEAADPAQDLVIVPAFTGLGAPYWAPDCRGAIYGLTRNTGPAEFARAALESVGLQTRDLLEAMRADWGAAGQNVLRVDGGMAASDWTMQYLADILGAPVDRPVITETTALGAAYLAGLGAGICPPPAEFAAQWALDRRFTPAMAETERARKLARWQRAVA

SEQ ID NO: 21825 - protein, 511 aa, Rhodobacter capsulatus
QPGVVDLFIIGGGVNGCGIARDAAGRGLSVTLAEQGDLAQGTSSASTKLFHGGLRYLEFFEFRLVREALEERETLLVAMPHISWPLRFVLPVHAGIRFDTTTPTSRLLNLMFPWMKGRRPAWLLRLGLFLYDSMGGRKILPGTRKLDLTRDKIGRALKPGMGLAWEYSDCWVDDARLVVLNARDAQARGANVLVGTRVTAAARQGDLWRIETEGPAGKAVHLARGLVNAAGPWVGQVLGLIEGPKPAAQVRLVRGSHIVTRRLHDDPRALFLQGSDGRIIFIIPYEQDFSLIGTTEAAHEAAPEAAACSAAERDYLLAFVSQYLAKPVTARDVVWSYAGVRPLYDDGASSATAASRDYVLDLQAGGPVLLNVFGGKITTYRRLAEAALAKLAPHFPGLGPDWTARVPLPGGDFFQTGVKALIERLRVRYAFLGQAGAGRMVRAYGTEAFAILGEAKTRADLGRDFGAGLSEAEVIWLMDREWARRAEDVVWRRTKLGLRLSADQIAVLDRF

SEQ ID NO: 21826 - protein, 202 aa, Rhodobacter capsulatus
LALALALATPAFAEEFRVIPPPAVDAAALTGPETAIFAGGCFWGVQGVFQHLNGVISATSGYAGGTAATAHYDQVSGGETGHAEAVQVVFDPKQISYGDLLQVFFSVAHDPTQLNRQGPDVGPQYRSALFPVTEDQARIAKAYIDQLGRARAFDAAIVTQLDPGAAFYPAEAYHQNFLTLNPDHPYIVQVDMPKIAALERMF

SEQ ID NO: 21827 - protein, 501 aa, Rhodobacter capsulatus
RPNILVIMVDQANGTLFPDGPAPFLHTPHLKRLAKRSTRFANTYTASPLCAPARASFMSGQLPSRTRVYDNAAEFASDIPTFAHHLRRAGYATTLSGKMHFVGPDQLHGFEERLTTDIYPADFGWTPDYTKPGERIDWWYHNLGSVTGAGVAEITNQMEYDDEVAYHATRKLYDLSRRQDDRPWCLTVSFTHPHDPYVARKRFWDLYEESPALDPTVPALPFEDQDPQSRRILESCDFRNFEITPEMIRRARQGYFASISYIDEKIGEILDVLERGRMADNTIIVFVSDHGDMLGERGLWFKMNFFEGSARVPMMIAAPGWKPGRIDTPVSTLDITPTLAALAGIDISTLARWTDGVDLDPVAQGGARAAVPMEYAAESTIAPMVCLREGRYKLMLCAVDPPMLYDLEADPQELVNLATAPEHADTLKRLTDQALTRWDLGAFDAAVRESQARRWAVYDALRNGAYFPWDYQPLQKASERYMRNHMDLNVLEENQRYPRGE

SEQ ID NO: 21828 - protein, 385 aa, Rhodobacter capsulatus
GLDDELEMIRDQFHRYAEERVIPNAHDWHLKDELIPMEIIEELAELGVFGLTIPEEYGGLGLSKASMVVVTEELSRGYIGVGSLGTRSEIAAELILCGGTEEQKQKWLPGLASGEILSTAVFTEPNTGSDLGSLRTRAVKDGDDWVITGNKTWITHAQRTHVMTLLARTEPDTTDWRGLSMFLAEKTPGTDENPFPTPGMTGGEIEVLGYRGMKEYELGFDGFRVKGENLLGGETGRGFKQLMETFESARIQTAARAVGVAQAACEIGMRYAIDRKQFGKSLIEFPRVGGKLAMMAVEIMIARQLTYFSAWEKDHGHRCDVEAGMAKLLGARVAWAAADNALQIHGGNGFALEYAISRILCDARILNIFEGAAEIQAQVIARRLL

SEQ ID NO: 21829 - protein, 369 aa, Rhodobacter capsulatus
ERFANLPEYAFPRLRTLLDHLKPGGEPVAMTIGEPRHPMPDFVGPVLAASLSEFGQYPANDGTPALLAAISGWLGRRYGVDVAQNRLMVLNGTREGLFNAAIALCPETKRGKRPVVLVPNPFYQVYAVAAATVGAEVVFVPASEETGFLPDYESLPAEILDRTTIAYLCSPANPQGSVAGRDYLARLLALAEKHDFRLFSDECYSELWRNAPPPGAIEVAAETGTDPERVVIFHSLSKRSNLPGLRSGFCAAGPQAMQRIRQLRAYAGAPLPQPIQRVSERAWADEAHVIQNRALYAEKYADAAEIFSGVNSFRLPEGGFFLWLPVENGEEAAVKLWTETGVRVLPGAYLARDVNGENPGKGYIRVALV

SEQ ID NO: 21830 - protein, 258 aa, Rhodobacter capsulatus
LATWNINSVRLREALVCKLMTEEAPDVLCLQECKSPVDKIPFAAFAELGYRYHVARGQKGYNGVAILSKLPMVEAGAGDYANLGHARHIAGRLENGVTIHNFYVPAGGDIPDRAENEKFGQKLDFLSHMRDDFHAQRPDRAILVGDLNIAPREDDVWNHKALLKIVSHTPIEVEHLAAAQDAGGWVDVTRADIPEGQLYSWWSYRSPDWDGADKGRRLDHIWATPDIAGAAHGSRILRAARGWEQPSDHAPVFATFDL

SEQ ID NO: 21831 - protein, 379 aa, Rhodobacter capsulatus
SGSIVKPKKSVALSGVVAGNTALCSVGQTGNDLHYRGFDILEIAESCEFEEVAHLLIHGTLPTLAELASYRTKLRALRGLPLAVRQTLEAIPAAAHPMDVLRSGVSALGCVLPEAADHNTPGARDIADRLIAVQGSMLLYWYHFAQNGRRIEVETEDDSIAGHFLHLLHGRPAGEEAVRALHTTLNLYAEHEFNASTFTARTIAGTGSDLYSCVAGAIGALRGPKHGGANEQAFEIQKRYATPDAAEADIRARVAAKEVIIGFGHPVYTIADPRNVVIKQVARRLALHHGALRMFDIAERIEQVMAETKAMFPNLDWYSAVSYHQLGVPTMLFTPIFVIARSAGWGAHVIEQRLDGKIIRPSANYTGPETRAFLPLEAR

SEQ ID NO: 21832 - protein, 412 aa, Rhodobacter capsulatus
VTDDLAFDAAHVWHPYTARFTAAPQHKIVAAKGIWLTLEDGRQMIDAMSSWWCAAFGHAPEPLVRALQAQAATLPHVMFGGLTHRPAIELTRRLVRALPEGLDQVFYSDSGSVAVEVAVKMAVQAQLAQGRRGRTRLATARGGYHGDTWTAMSLCDPEAGMHAHFGSAIAPQHFVARPPVAYGADWPEDDRRNGLAEVEALFERHGAQIAAFILEPIVQGASGMHFHHPAYLRGLRALCDRHDIALIFDEIATGFSRTGSDFALHRAGVVPDILCLGKALTGGMMSLAATVATRDLAGRVGALMHGPTFMANPLACAVAAAAMDLWQGHDWSAEARRIEAQLTQELAPARGFAGVADVRCLGGIGVIEMKAPLPLAPIHRFCAQTGVWLRPFGRVLYAMPPLTIGPDDLSRV

SEQ ID NO: 21833 - protein, 259 aa, Rhodobacter capsulatus
  unsure (1)..(259): unsure at all Xaa locations
GSPMFSLEGQKALVVGIANEQSIAFGIARALRAQGADLAVTWLNDRAEPHVRPLAEDLEAEIMMPLDVAEPDQLAAVFEAIADRWGRLDTLVHSIAFAPRADLHGRVVDCSSEGFALAMDTSVHSFLRMIHLAEPLMTAGGTCLSVSFFGSTRVVRHYNLMGPVKAALESAVRYAAAELGEKGIRVHALSPGPLATRAASGIDHFDEMMAEAAERAPTHQLATIEDIGAMAAFLAAPEAKNLTGGIHEIDGGYSITAXG

SEQ ID NO: 21834 - protein, 293 aa, Rhodobacter capsulatus
EAMTGGCAMALDDPKTLVSTDWLEAHLRDPDLRVLDASWFLPSMERDAKAGYAAAHIPGARFFDIDEISDTRSELPHMAPPVEKFMSRMRAMGVGDGHQVVIYDQMGIFSAPRVWWLFRLMGKTDVAVLDGGLPKWLAEGRETEDMAPIPRDRHMTVQRQAHLIKDVTQVAHASKLGDHEIIDARPRGRFLGTDPEPRPGLRSGHIPGAKNVPWNSVLTETNTMKSPEDLRAVFTAAGVDLAKPAIATCGSGISAAVLVLALERIGHRNHALYDGSWAEWGMFNDLRVATGEA

SEQ ID NO: 21835 - protein, 393 aa, Rhodobacter capsulatus
MFNSLKAQAPDKILALMGQFRADPRTDKIDLGVGVYKDAEGRTPVMRAIKSAEKQLWETETSKTYTALAGEPAFHAAMAEMVLGAGYPADRLSCLATVGGTGACRQAFELARLANPGCTVWVSDPTWPNHLSILAFMKQDTKLYRYFDSAARAVAFDAMMEDLQAIKAGDVVLLHGCCHNPTGANLTLEQWAAVADLLEAKGAVPMIDLAYQGFGDGLEEDAAGTRLIASRLPEVMIAASCSKNFGIYRERTGCLLVLSDAASKDVTQGTLAYLNRQNYSFSPDHGARLVTMVLTDPTLRAEWMTELEEVRKGMLGLREQLAAELRQLSNSDRFDFVARHRGMFSRLGASPEQVEKMRVDNAIYMVGDSRLNIAGLNAKTVPILARAIIAAGV

SEQ ID NO: 21836 - protein, 460 aa, Rhodobacter capsulatus
MTCQVTQKAREGTINPIFTCQPAGAQFASIGIKDCIGIVHGGQGCVMFVRLLISQHMKESFEIASSSVHEDGAVFGALDRVETAVEVLLTRYPDVKVVPIITTCSTEIIGDDVDGLLSKLEDELLPTKFPGREVHLLTVHCPSFVGSMITGYDKAVHDFVKKFATKDEPSDKINLITGWVNPGDVKELKHLLEVMEVKANVLFEVESFDSPLMPDLEHHSHGSTTIEDLRDTANAKGTIALNRYEGMKAADYLKKKFKVPAVIGPTPVGIRNTDAFLKAVSEMTGQPIPAQLVKERGLALDAIADIGHMFLADKRVAIYANPDLAIGLTEFCLDLEMKPKLLLLGDDNSGYVKDPRVLALQENAPDLEIVTNADFWDLESRIQQGLELDLILGHSKGRFISIDYKVPMVRVGFPTYDRAGMYRHPVLGYGGAMFLAETMANTLFADMEAKKNKEWILNVW

SEQ ID NO: 21837 - protein, 527 aa, Rhodobacter capsulatus
MPYHEFEVSKCIPERREHAVMKAAGEDLTSCLPKGYLNTIPGTISERGCAYCGAKHVIGTPMKDVIHISHGPNGCTYDTWQTKRYISDNDNFQLKYTFATDVKEKHVVFGAEGLLKKSMHEAFDAFPNIKRMTVYQTCTTALIGDDVDAIAKEVMEERGDVDVFVCNSPGFAGPSQSGGHHKINIAWLNQKVGTVEPDYLGEHVINYVGEYNIQGDQEVMIDYFNRMGIQVLSTFTGNGSYDSLRMMHRAHLNVLECARSAEYICDELRARYGIPRLDIDGFGFEPLANSLRKVALFFGIEDKAEAIIAEEYAKWKPQLDWYKERLKGKKVCLWPGGSKLWHWAHAIEEEMGLKVVSVYTKFGHQGDMEKGVSRCGEGALAIDDPNELESVEAIEMLKPDIIFTGKRPGEFVKKHGVPYLNAHAYHNGPYKGFEGWVRFARDIYNAIYSPMRQLAALDISAPDAAITSGFRTAKMNADLTVSDEVKFSEVLHEYTGKYDSIAEIRARNQPMPPSRKALRDAVQPAAE

SEQ ID NO: 21838 - protein, 512 aa, Rhodobacter capsulatus
MPQSADKVLDHSKLFFEPEYKEMLANKKATFECGHSAETLAQIGDWTASWEYREKNLAREALTINPAKACQPVGAVFAAQGYEGTLPFVHGSQGCVAYYRSHLSRHFKEPSAAVSSSMTEDAAVFGGLTNMVEGLANAYALYKPKMIAVSTTCMAEVIGDDLSSFIIKAKEAESVPVDFPVPFAHTPAFVGSHVDGYDNTQKGILSLFWAGAERVANDSLNIIPGFDGYAVANNREIKRLLDTMGVSFTFLSDVSEVYDTPSDGHYRMYAGGTKLEDAKAAVNAKATLSMQEWCTPKTLEYVETTGQETAVFNYPMGVSATDSFLMKVSELTGKAIPDSIKLERGRLVDAIADSQAYLHGKTFSIFGDPDFVLGMAKFIMEMGGEPVHCLATNGSKKWAKQMEEVLAASPFGKQGQVWAGKDLWHMRSFLMTEPTDFLIGSSYGKYLERDTGIPLIRLTFPIFDRHHHHRFPTWGYQGGLTVLVKILDAIFVKADARAGDWGKTDISFDLTR

SEQ ID NO: 21839 - protein, 204 aa, Rhodobacter capsulatus
MHTEAIARSYKRWAPIYDKTFGKITHAGRHHAVREVNATGGAVLEVGIGTGLALDLYEPSKVAVTGIDLSPDMLAKAQARAEAQGLRNVAGLHIMDARELAFDDESFDHVVALHIMSVVPEPRRVMAEMARVCRVGGTVLITNHFAREKGGWGVAAKLAAPMADALGWHSDFARAEVMSEPRLKLVEETRLPPFGLMTFLRFRR

SEQ ID NO: 21840 - protein, 418 aa, Rhodobacter capsulatus
MPVCPFPIRHPAGPDQRVGLDPSGPDQIADHQFVHRAFALARPCVMPRLRHETLAQTLLAWHLSLRQDGATIAETKMTQKIAILGASGYTGAELARIIATHPEMEITALSGDRKAGMRMGEVFPHLRHIGLPDLVKIEEIDFSGIDLAFCALPHATSQAVIAELPRDLKVVDLSADFRLRDAAEYEKWYGKPHAAMDLQAEAVYGLTEFYREELKTARLCAGTGCNAAAGQYAIRPLIEAGVIDLDEIVIDLKAGVSGAGRSLKENLLHAELAGGTMPYSAGGKHRHLGEFDQEFSKVAGRPVRVQFTPHLMPFNRGILATVYVRGTPEDIHAALASRYENEVFLEVLPFGQLASTRSVAGSNFVHLGVIGDRLPGRAVVTVALDNLTKGSSGQAIQNANLMLGLPETLGLMLAPVFP

SEQ ID NO: 21841 - protein, 446 aa, Rhodobacter capsulatus
HLIGGAMTAPGPQLAVHNPATDEPLAEVTRGSAADVTAAVAAARAAAPGWTALSGHERAKWLYALARNLQKREAFLRILEVLDTGKPIRECRDIDLPLAIREVYHHAGWAELCAGEFPGLEPLGVVGAILPSGCPLPGLLRTLAPALAAGNTVVVKPAEETPLSALALAEICLEIGLPAGVLNIVTGDGATGAALVAAEVDKIAFTGATDIGRAIRKATAGSGKALGLELGGQSPVLVFADADLDAAVEGVVTAAWTGQGESSAGGARILVAEAVAERFTARLTARMEKLRLGDPLDKGTDIGALVSAAQRDRVLALLARGVAAGARLLQSSAPLPAQGNFVAPGLLLDAQPTNPCVTEDGLGPIATLASFRTPAEAIALANASRQGRAASVWSENITLAQDVAAKLATGTVWINSHGTADAAAPSDGKRESGLGRTGGRAALRAF

SEQ ID NO: 21842 - protein, 1110 aa, Rhodobacter capsulatus
MPKRTDIQSILIIGAGPIIIGQACEFDYSGAQACKALREEGYRVILVNSNPATIMTDPEMADATYIEPITPEVVAKIIEKERPDALLPTMGGQTGLNTSLALADMGVLEKFGVELIGANREAIEMAEDRKLFREAMDRIGLENPKATIISAPKLENGKYDISAGVRQALIDLEHIGLPAIIRPAFTLGGTGGGVAYNRDDYEAIVRSGLDASPVAQVLIDESLLGWKEYEMEVVRDKADNAIIVCSIENVDPMGVHTGDSITVAPALTLTDKEYQIMRNGSIAVLREIGVETGGSNVQWAINPKDGRMVVIEMNPRVSRSSALASKATGFPIAKIAAKLAVGYTLDELDNDITKVTPASFEPTIDYVVTKIPRFAFEKFPGSKPELTTAMKSVGEAMAIGRTFHESVQKALASMETGLTGFDEIAIEGAPDKAAVIKAISRQTPDRMRLIAQAMRHGLSDEEIVTATAFDPWFLARIREIVEAEAAIRKNGLPLDEKGLRKLKMMGFTDARLAKLTGRDEGQVRRARRNLGVTAVFKRIDTCAAEFEAQTPYMYSTYEVPAMGDVECEARPSDRKKVVILGGGPNRIGQGIEFDYCCCHACFALTKAGYETIMINCNPETVSTDYDTSDRLYFEPLTLEHVLEILRVEQDNGTLHGVIVQFGGQTPLKLANALEAEGIPILGTTPDAIDLAEDRERFQQLLNDLELKQPVNGIASTEAQAFEIAGRVGYPLVIRPSYVLGGRAMEIVRDTEHLKRYITTAVTVSGDSPVLLDSYLSGAIEVDVDALSDGKTVHVAGIMQHIEEAGVHSGDSACSLPPYSLSRETVAELKAQTEKMALALGVVGLMNVQFAIKDGVIYVLEVNPRASRTVPFVAKATDSAIASIAARLMAGEPMANFPLRAAYPEGVGPETPLPFADPLTLADPNTPWFSVKEAVLPFARFPGVDTLLGPEMRSTGEVMGWDRNFPRAFLKAQMGAGTHLPESGRVFLSIKDADKSDDLANAARDLIAMGFTLVATRGTGAWLKEKGVEAEAVNKVYEGRPNIVDRLKNGDIALVFNTTDGNQSVSDSREIRAVALYDKIPYFTTAAASIAAVAAMKSRAEGEISVRPLQA

SEQ ID NO: 21843 - protein, 705 aa, Rhodobacter capsulatus
  unsure (1)..(705): unsure at all Xaa locations
DGVAVITWDVPGKSMNVMSLEGFAQLSALVDGCLADPACKGIVLTSGKKDFAGGMDLNVIAKMREGGAEAIFAGVMQMHAVLRKIERAGMDPKTLKGGKPIACVLPGTALGIGLELPLSCHRIFAAENPKAKIGLPEIMVGIFPGAGGTTRLVRKMGAMMAAPFLLEGKLSDPKAAKAAGIIDEVSADPMAAARDWVLNATEADLVKPWDAKGYKMPGGAPYHPAVSXPMSALPPWCRRRRWGSIRPPRRLLSAVYEGALVPFDQALRIEARWFTKVLMNPSSTAMIRSLFINKEALEKGANRPKVADQSVKKLGVLGAGMMGAGIAYVSANAGIEVVLIDASQEAAERGKAYATGILDKGIQRRKVTEAKKAEVLGRITATTDYAALAGCDLVVEAVFEDPAVKAEVTAKAEAVIPETAIFATNTSTLPISGLAKASQRPAHFIGIHFFSPVDKMNLVEIIKGKDTGEVAVAKALDFVRAIRKTPIVVNDARFFYANRCIIPYINEGIRMVAEGVNPVLIENAAKLVGMPLGPLQLVDETSIDLGVKIAKATKAAMGEAYPDGAVDAVVFWMAEQGRLGKKADAGFYTYDAGKRGGMWEGLAAQYPRAAAQPELSHVQHRLLMVQVLEAVRAFEQGVLTDIREGDVGAILGWGFAPWSGGPFAWLDILGAARAVEICDALSARYGARFETPALLRDIAAKGDSF

SEQ ID NO: 21844 - protein, 402 aa, Rhodobacter capsulatus
TEAYIYDACRTPRGKGRADGSLHEVTSVALSARLLDAVAERNGLTGPAVEDVIWGNVTQVGEQGGCLARSAVLLSGLDESIPGLSINRFCASGMEAVNLAANQVKAGAGAAYIAGGVEMMSRVAMGSDGAAIAVDPSLAMKTYFVPQGISADIIATEYGFTREMADALAVESQRRAAEAWAEGRFAKSIVPVKDQNGLTILDRDEYLRPGTTLEDLAKLKPAFKDMGEVMPGFDKVAMLKYPHLERIEHIHHAGNSSGIVDGAAAVLIGSKEFGEAHGLKPRARIRATAKIGTDPTIMLTGPVPVTEKILRDSGMSIADIDLFEVNEAFAAVVLRFMQAFDVGQDRVNVNGGAMALGHPLGATGAIIIGTLLDELERRDLSTGLATLCIASGMGAATIIERV

SEQ ID NO: 21845 - protein, 473 aa, Rhodobacter capsulatus
MIEKRHFYIDGTWVGPHQPRDHAVIDPSTEEPCAVISLGDRADTDAAVAAALRAGPGWAATPPAARLATVERLLAIYQSRAEEMAQAMSLEMGAPIDFARDSQVGAGIWHISNFIRAAKDFEWLHPLGDGTPGAMIAYEPVGVVGLITPWNWPMNQVTLKVVPALLAGCTMVLKPSEEAPLSSLLFAEFVHAAGVPAGVFNLVNGDGAGVGTQLSTHPDVEMISFTGSTRAGKAISQAAAATLKRVCLELGGKGANLVFADADDTAIARGVRHCMNNSGQSCNAPTRMLVERPLYDRAVQIAAEVAAAIKVAPAQAPGRHIGPVVNAAQFDKIQSLIETGIKEGARLVAGGLGRPEGLNKGFFIRPTVFADVTPEMTVMREEIFGPVLSIMPFDTEEEAVAIANATPYGLTNYVQSQDSARRNRLARLLRSGMVEMNGQSRGAGAPFGGVRASGRAREGGRWGIEEFCEVKSI

SEQ ID NO: 21846 - protein, 263 aa, Rhodobacter capsulatus
IVITGISGRMGRMLAATVAASDKARLVGAVERTGHDWIGRDLGEALGGAKNGVIVSDDPLEAFAKAQAVIDFTAPAATLEFARLAAQARAVHVIGTTGFEKEQIAALEPASRHSVQIRAGNMSLGVNLLTKLAKTVAAALDADWDIEVVEAHHNRKVDAPSGTALMLGQAAAEGRGIDLDGMTESGRHGITGARKHGAIGFSAIRGGDIVGEHDVIFAAAGERIVLRHIATDRAIFARGALRAALWGQSQKPGQYDMIDVLGI

SEQ ID NO: 21847 - protein, 403 aa, Rhodobacter capsulatus
MTQTRLITPVLVGGAIILMLGFAIRASFGVFQIPIATEFGWPRAEFSLAIAIQNLAWGIGQPIFGAIAEKFGDRKAIVLGALMYALGLVLSAFATQPWQHDLLEIFVGFGIAGTGFGVILAVVGRAASDENRSLTLGIATAAGSAGQVFGAPVAEALLSQFPWQTVFVIFAVTILLALLALPLLRSPARTAHHGQTEPMGTVLKRALKDPSFTLIFLGFFSCGYQLAFITAHFPAMVTEMCGAVPPGSLLAAVGIESLSTLGAVAISLIGLANIAGTIFAGWAGRHYSKKYALAIIYLLRTIAAAAFILAPMTPATVLVFSLVMGALWLATVPLTSGLIADLYGLRYMGTLYGVVFFSHQLGAFLGVWLGGRLYDIAGDYTLVWWVGVGMGAFSALVHLPVKD

SEQ ID NO: 21848 - protein, 637 aa, Rhodobacter capsulatus
MAKVIGIDLGTTNSCVAIMDGSQPRVIENSEGARTTPSIVAYTDNERLVGQPAKRQAVTNPTNTVFAVKRLIGRRTTDAEVEKDKKLVPYNIVDGGNGDAWVEVRGEKFSPAQVSAVILQKMKETAESYLGETVTQAVITVPAYFNDAQRQATKDAGKIAGLEVLRIINEPTAAALAYGLDKKDSKTIAVYDLGGGTFDITILEIDDGLFEVKSTNGDTFLGGEDFDMRIVNYLADEFKKEHGVDLTKDKMALQRLKEAAEKAKIELSSASQTEINQPFISMNAATGVPLHMVMKLTRAKLESLVDDLIKASLKPCAAALKDAGVSKDEIDEVVLVGGMTRMPRVVEEVTKFFGKEPHKGVNPDEVVALGAAIQAGVLQGDVKDVVLLDVTPLSLGIETLGGVFTRLIDRNTTIPTKKSQIFSTAEDNQNAVTIRVFQGEREMAADNKMLGMFNLENIPPAPRGVPQIEVTFDIDANGIVSVKAKDKGTGKEQQITIQASGGLSDDDIEKMIKDAEANAEADKKRKELVEAKNTGESLLHSTRKSLEEHGDKVDGSTVEMIELACNALEESLKSEDPGKIKGAVQNLTDAAMKLGEAIYKAQASEAGPASDDEDGPRSVDDDIVDADFEDMGENKRK

SEQ ID NO: 21849 - protein, 384 aa, Rhodobacter capsulatus
MAKRDFYEVLGVSKGASAEEIKKAYRSKAKELHPDRNQDNPQAEAQFKEVNEAYDVLKDGDKKAAYDRYGHAAFEGGMGGGGPRGPYGQGADFSSAFSDVFEDLFGDFMGGRGGPGGGGRSRATRGSDLRYNMRVTLEEAFKGAQKTITVPGSAACGSCNGTGAEGGAEPQTCPTCSGLGKVRAQNGFFTVERTCPTCGGQGQVVKNPCRVCHGSGRIEKERTLSVNIPAGVETGTRIRLAGEGEAGMRGGPSGDLYIFIEVREHAIFQRDGVNLFCRVPVSMVSAALGGEVEVPTIDGGRSKVKVPVGSQSGRQMRLRGKGMPALRGGGIGDMVIELAVETPVNLTARQKELLDEFQRIQAENNPEGASFFQKVKSFWDGMKG

SEQ ID NO: 21850 - protein, 400 aa, Rhodobacter capsulatus
LPVIAGVSFAAAAAGVRYAGRTDVMLAQIAPGATLAGVFTTSTTRAACVLDCQAKLAGAADESTGAAIVVNSGNANAFTGAAGQASVDAVTGAVAEALDLPINRVFSSSTGVICEPLPHDRIVAAGARPCSPRWNPAGMEAAPRAIMTTDTFPKGACAEVQGDGGLIRIAGIAKGSGMIAPNMATMLVYLFTDAKIPAKLLQKMLSRHVDDTFNAITVDSDTSTSDALILAATGRSAAAEITDLRSRAAKDFEAALRGVMLDLAQQVVRDGEGATKFVEIRVSGAASADDAHKVAMAVANSPLVKTAIAGEDANWGRVVAAVGKSGAKADRDKLRISFGDMVLAENGWRVPDYSEEAASAYMKGQELVIGIDLGLGKAAKSVFTCDLTHRYIDINADYRS

SEQ ID NO: 21851 - protein, 401 aa, Rhodobacter capsulatus
KKVVLAYSGGLDTSIILKWLQTEYGCEVITFTADLGQGEELEPARAKAELMGIKKENIHIVDVREEFVRDFVFPMFRANALYEGLYLLGTSIARPLISKHLVEIAQKHGADAVAHGATGKGNDQVRFELSAAALDPSIRVIAPWRLWDLTSRTKLLEFAEANQIPIAKDKRGEAPFSVDANLLHTSSEGRVLEDPAQEFPNYVLQRVVPVEEAPDTPEMVEITFERGDAVAINGEAMSPATILAKLNEIGGKHGVGVLDLVENRFVGMKSRGVYETPGGTILLEAHRGIEQITLDAGAGHLKDSIMPRYAELIYNGFWFSPEREALQALIDKTQEHVSGTVRVKLYKGKASTVARWSDHSLYSEKHVTFEEDAGAYDQKDAAGFIRLNALRLRLIATRNAR

SEQ ID NO: 21852 - protein, 363 aa, Rhodobacter capsulatus
IPTPFYLIDETALLQNLQKIDLLREASGAKALLALKCFATWSAFDIMRPHMDGTTSSSLYELRLGREKFGKETHAYSVAWSDREIDEACAYADKIIFNSVGQLTRFAEPSQGIQRGVRLNPRFSTSGFDLADPARPFSRLGEWDVTKLLGVADLISGVMIHYNCENRDFALFDDQLGRIEREFAPLLEKLDWVSLGGGIHFTGEGYPLEELAKRLKTFSDRFGVQVYLEPGEASITKSTTLEVTVLDLLDNGKQLAIVDSSIEAHMLDLLIYRESAKLPQEGDHAYQICGKSCLAGDIFGEARFPRPLKVGDRISVADAAGYTMVKKNWFNGVNMPSIAIKRASGQIDLIREFTYEDYLSSLS

SEQ ID NO: 21853 - protein, 351 aa, Rhodobacter capsulatus
MTIANRILPHAPADHPPVPVPRVGVLLANLGTPDATDYWSMRRYLNEFLSDRRVIDYPIWKWQPLLQLIILSKRPFTSGNNYRSIWNEERDESPLMTITRDQVRKLRAAVETRYGAGNVVVDFCMRYGNPSTRDVLDDMLAQGCERILFLPLYPQYAGATSATANDQFFRALMQVKRQPAARTVPEYFARPSYIEALASSVERVYATLDTRPDVLVASYHGMPKRYHREGDPYHCQCQKTSRLLRERLGWGPDSIDTTFQSVFGTEEWLRPYTVEHVVQLAEAGKKNIAVISPAFSADCIETLEEINGEIREAFEHAGGESFTYVPCLNDDDLHIAALLEVVEENLAGWID

SEQ ID NO: 21854 - protein, 588 aa, Rhodobacter capsulatus
PPSRLIPFLRWCINGAWPAVWIAGAASALAGSMEVGAAWLLGLVIDSVVGADPATHAGQHLWLLLAFVVFYLLIRPGAFGLSTWTMNMLVAPNVMPQVLSRLHRWTMGHSVTFFDNDFAGRIAQKQMQTARAVTDVIAEVIGTVFFALASIIGSVVLLAGIDTWGALALALWLVFYLLLIRAFLPHVRGRSKARASARAMVTGQVVDTITNIKTVKLFAHDDHEDRVALGAMEGYRSATKRFGVTTTWYRLSQITFSGLLPILLVGGAMLMWRKGAATPGDIAAAGAVAMRIAQMSGWVSQSLMALWSNIGEVEDGMRTLTPAHAITDAEGAQVLGRVQGEVRFDQVSFAYGREKGGIDGVDLTIKPGERIGIVGASGAGKSTLVALLLRLYDTEKGRVMIDGTDLRDVTQESLRRNIGMVTQETAMFNRSARENILYGRPDATEEEMIAAAKAAEAHDFILGLVDHTGKTGYEAALGERGVKLSGGQRQRIALARAFLKNAPILVLDEATSALDSEVEAAIQKALGRVMEGKTVLAIAHRLSTIAEMDRIVVLDQGRIVEEGSHAELLAQNGLYARYWNRQSGGFLG

SEQ ID NO: 21855 - protein, 289 aa, Rhodobacter capsulatus
ILTVGVVGAGQMGNGIAHVFALSGYDVLLNDVAPESLDRALGMIGKNLDRQLHRGKISAEERAAALGRIRTTLTIADLGQTDLIIEAATERETVKQAIFDSLLPHLKPETILATNTSSISITRLASRTDRPEKFIGVHFMNPVPVMQLVELIRGIATGEETYRTLLGVIERLGKTPASAEDFPAFIVNRILIPMINEAVYTLYEGVGNVQSIDMAMKLGANHPMGPLELADFIGLDTCLAIMNVLYDGLADTKYRPCPLLTKYVEAGWLGRKTGRGFYDYRGETPVPTR

SEQ ID NO: 21856 - protein, 286 aa, Rhodobacter capsulatus
MKRKVTKAIFPVAGLGTRFLPATKSIPKEILTLVDRPLIQYAIDEARAAGIKEFIFVTSRGKSALEDYFDDAPELETSLRKKGKTDLLEALKATNMDSGAIAYVRQNRPMGLGHAVWCARRLVGNEPFAVILTDDVIAAEKPCLQQMMEAYNETGGNVVAAMEVPHEKTSSYGVLDIAEDMGSLVKVKGMIEKPAPDVAPSNLAVIGRYILTPRVMQNLNKKKEGAGGEIQLTDAIAEEIEAGQPVYGFRFRGQRYDCGSKAGFLQATVAFGLAREDLRDEFGDFL

SEQ ID NO: 21857 - protein, 317 aa, Rhodobacter capsulatus
VLVTGGAGYIGSHACKALARAGYVPVTYDSLVTGWRDAVKFGPLEEGDLSDRAWLDAVFARWQPVAVMHFAALSLVGESMKNPGLYWRHNVLSSLTLIEAACAAGCLDFVFSSTCATYGDQDGVVLDETTTQAPINAYGGSKQAIEMILRDFEASHGLRSVIFRYFNVAGADPEGEVGEFHRPETHLVPLMLDAIDGKRPALTVYGSDYPTKDGTCIRDYVHVSDLVDAHVLGLQWLQAGKGSEVFCLGSGTGFSVREVIAQSKAVTNRAVPIVEGARRPGDAAVLVSGSTKAIRDLGWAPKRSDLTTMIADAWRWH

SEQ ID NO: 21858 - protein, 248 aa, Rhodobacter capsulatus
AKRIDAESLTGLDVTSLRKSYRKRLVLRDVSLRLERGEVVALLGPNGSGKTTCFYAIAGLVAPDAGRVSIDGIDATGLPMYRRARLGIGYLPQEASIFRGLTVEQNIMAVLEIAVADPHHRRERLEELLGDFAITHLRQAPALALSGGERRRVEIARCLAADPKYLLLDEPFAGVDPIAVAEIRALVSHLKERGIGVLITDHNVRETLEIVDRAYILHDGRVLMSGRTEEVVQDENVRRVYLGENFRI

SEQ ID NO: 21859 - protein, 247 aa, Rhodobacter capsulatus
PMTRALGITFDKVNKWYGRMHVLRDVSFSVAPGEKIVVCGPSGSGKSTMIRCINRLEEHQSGTITVNGVEVNDQRRNVDQVRRQVGMVFQNFNLYPHLSILDNCTVAPRWVRNIPRAEAEERAMHYLERVRIPDQAHKYPSQLSGGQQQRVAIARSLCMQPEIILFDEPTSALDPELVREVLDTMVSLAEDGMTMICVTHEMGFARQVADRVIFMDRGAIVESAAPDDFFRNPREERTRLFLSQILH

SEQ ID NO: 21860 - protein, 255 aa, Rhodobacter capsulatus
LIAVGDNCLDVYLTKGHMAVGGNALNVAAQWRRKGLAARYLGVVGPDAEGAVILDALAGVGLDPADVERRPGNTAVTLIRDHHGDRRFLLEDLGVGDGWRPDAAHQAALQAARWVHLGTNADPGLLRWLLEAGVGFSIDVSTRHADLPLAGVPLVFASGPEDPAEPIEPVLAAFRARGARRTVVTCGSRGAFFDDGGTVCSVAARKIAVRDTCGAGDSFIATFLAALIGAHRPGPEALQLATLAAAETCQHEGGF

SEQ ID NO: 21861 - protein, 256 aa, Rhodobacter capsulatus
MKAVILAGGRGTRLSEETGRRPKPMVDIGGQPILWHILKIYAAHGVNEFVLCLGYRGWQIKDYFLNSARLSSDLTVDLASGVVEMLRPASEPWKIHLIDTGEDTQTGGRLKRVGHLLRDDDAFCLTYGDGLGDVHITAAIAFHRAHGKAATVTAVVPPGRFGALDRQGDRVSAFVEKPAGDGGTINGGFFVLSPSVLDRIEGDATVFEQELLKGLARDGELRAFDHRGFWQPMDTLRDRDHLQALWDGGAAPWKIW

SEQ ID NO: 21862 - protein, 253 aa, Rhodobacter capsulatus
NLRGKRALITGGTQGAGAATVALFRDLGAQVLTTARNRPETLPEAMFVAADLSTVQGCERVARAVQDRMGGVDVLVHMLGGSTAPGGGFAALGEAEWQAELNLNLMPAVRLDRALLPGMVAQRAGVVVHVTSIQRLMPLPAATTAYAAAKAALSVYSKSLSKEVAPAGLRVLRVAPGWIATAASIRLAGRLAEAAGTDLEGGKRMIMDSLGGIPLGRPSTPEEIASLIAFLASDRASSITGTEHVIDGGTVPT

SEQ ID NO: 21863 - protein, 85 aa, Rhodobacter capsulatus
QKRLAEGALLVDVREADEVAACGFAGCAVMTIPLSQFEARFAEIPRDREVILACATGDRSLKATYFLMYQGYAKVTNMKHGLARW

SEQ ID NO: 21864 - protein, 335 aa, Rhodobacter capsulatus
MARLAINGLGRMGKLLLRRLIDLGRGPEIVLLNDAMGDAETHALLLEFDTVHGRWPTPVAATETGLQIAGQRIRLTREKTLEALPLAEIGVDLVLDCTGQFKTAAKVQPYFDAGVRKVVVSAPVKDTGALNLVYGVNHVLYDGSQRLITAASCTTNCLAPIVKVIHEALGIKHGSITTLHDVTNTQTIVDRPAKDLRRARSALMNLIPTTTGSATAITLIYPELKGRLNGHAVRVPLLNASLTDCVFELDRPTTVAEVNSLLQTAAEGGLNGILGFETRPLVSSDFTNDPRSAVIDGPSTMVVNGTQLKLYAWYDNEWGYVCRMADIARMVAGSL

SEQ ID NO: 21865 - protein, 564 aa, Rhodobacter capsulatus
MLRKFIAHYRPHRRLFWLDFGSAVASGLLELAFPLAITFFIDRLLPLGDWSLTIAAAAALLAVYALNTVLMGIVIYWGHMLGIEIETEMRRQAFAHLTRLSWRWYDRARTGKLVARVTRDLEDIGELAHHGPEDLFIAIMTFVGAFALMAALHPVLALITAAIVPLTVWLVAVYGGRMTRTWQEIYGRVGQFNVRLEEAVGGIRLVQAFANERHEERLFDRDNRAYRATKLQAYRLMAVSSAIHYMGLRFVQVVVMVAGAGFVLAGSLSTGGFVGFLLLVGVFFRPLEKIAAVIETYPKGIAGFRRYLELLETETEIADAPDARPVTALRGAITFDRVRFGYDAARPVLQDVSLSIAAGETVAFVGPSGAGKTTLLALLPRFYDPDSGTIRIDGLPLHAMTLESLRNQIGIVSQDVFLFGTSLRENIAYGRLDATEAEIRAAAEKAQLSALIAALPEGLETLVGERGVMLSGGQKQRVAIARAFLRNPPILILDEATSALDSETEREIQAALEALSRGRTTLVIAHRLGTIRAADRIVVMEDGRVQEIGSHAALLARGGLYARL

SEQ ID NO: 21866 - protein, 444 aa, Rhodobacter capsulatus
FDAAALERMCALNEAHAVMLAECGLIPAEIARTLLRGIATIRAEGPGAIDLDPQFEDSYFAFENRLGQVIGKATAGWLHIGRSRNDIGATLDRMAAREVCLGLLAEMAATRRACLAAAARHKMTVMPGYTHLQPAQPITFGYYLANVARGMERDYDRLAAVYDRADACALGMAALAGTSFAIDRPRVAQMLGFSGLATPGLDAVASRDFVTEMLWAVTSAQVLFSRVAQDFYVFTTWEFGALGFPDRVAGTSSIMPQKKNMLPLEYFRAEAGRSIGALAGALSAVKGSNYSIGLDSVREGVTDAWPTFERFRATLPLLRLIFETATPDAERLLARCSANFSTATDLADGLVRDFGVSFRDAHHVVGRAVQMVIAAGGDARQLTVQVLNAAAEEEIGRSFDLAEDKLRRWMDPVQAVSARKVPGGTAPEAVEAMLQEMQGRLDAD

SEQ ID NO: 21867 - protein, 200 aa, Saccharomyces cerevisiae
MEMTDFELTSNSQSNLAIPTNFKSTLPPRKRAKTKEEKEQRRIERILRNRRAAHQSREKKRLHLQYLERKCSLLENLLNSVNLEKLADHEDALTCSHDAFVASLDEYRDFQSTRGASLDTRASSHSSSDTFTPSPLNCTMEPATLSPKSMRDSASDQETSWELQMFKTENVPESTTLPAVDNNNLFDAVASRWQTHSATI

SEQ ID NO: 21868 - protein, 368 aa, Saccharomyces cerevisiae
MKLDSIDITHCQLVKSTRTARIYRSDTYAIKCLALDFDIPPHNAKFEVSILNKLGNKCKHILPLLESKATDNNDLLLLFPFEEMNLYEFMQMHYKRDRRKKNPYYDLLNPSIPIVADPPVQKYTNQLDVNRYSLSFFRQMVEGIAFLHENKIIHRDIKPQNIMLTNNTSTVSPKLYIIDFGISYDMANNSQTSAEPMDSKVTDISTGIYKAPEVLFGVKCYDGGVDVWSLLIIISQWFQRETSRMGHVPAMIDDGSDDMNSDGSDFRLICSIFEKLGIPSIQKWEEVAQHGSVDAFVGMFGADGDGKYVLDQEKDVQISIVERNMPRLDEIADVKVKQKFINCILGMVSFSPNERWSCQRILQELEKP

SEQ ID NO: 21869 - protein, 431 aa, Saccharomyces cerevisiae
MSDAAPSLSNLFYDPTYNPGQSTINYTSIYGNGSTITFDELQGLVNSTVTQAIMFGVRCGAAALTLIVMWMTSRSRKTPIFIINQVSLFLIILHSALYFKYLLSNYSSVTYALTGFPQFISRGDVHVYGATNIIQVLLVASIETSLVFQIKVIFTGDNFKRIGLMLTSISFTLGIATVTMYFVSAVKGMIVTYNDVSATQDKYFNASTILLASSINFMSFVLVVKLILAIRSRRFLGLKQFDSFHILLIMSCQSLLVPSIIFILAYSLEPNQGTDVLTTVATLLAVLSLPLSSMWATAANNASKTNTITSDFTTSTDRFYPGTLSSFQTDSINNDAKSSLRSRLYDLYPRRKETTSDKHSERTFVSETADDIEKNQFYQLPTPTSSKNTRIGPFADASYKEGEVEPVDMYTPDTAADEEARKFWTEDNNNL

SEQ ID NO: 21870 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 21871 - protein, 511 aa, Saccharomyces cerevisiae
MAFQQGVLSRCSGVFRHHVGHSRHINNILYRHAIAFASIAPRIPKSSFHTSAIRNNEAFKDPYDTLGLKKSATGAEIKKAYYKLAKKYHPDINKEPDAEKKFHDLQNAYEILSDETKRQQYDQFGPAAFGGGGAAGGAGGGSGSPFGSQFHDFSGFTSAGGSPFGGINFEDLFGAAFGGGGRGSGGASRSSSMFRQYRGDPIEIVHKVSFKDAVFGSKNVQLRFSALDPCSTCSGTGMKPNTHKVSCSTCHGTGTTVHIRGGFQMMSTCPTCNGEGTMKRPQDNCTKCHGEGVQVNRAKTITVDLPHGLQDGDVVRIPGQGSYPDIAVEADLKDSVKLSRGDILVRIRVDKDPNFSIKNKYDIWYDKEIPITTAALGGTVTIPTVEGQKIRIKVAPGTQYNQVISIPNMGVPKTSTIRGDMKVQYKIVVKKPQSLAEKCLWEALADVTNDDMAKKTMQPGTAAGTAINEEILKKQKQEEEKHAKKDDDNTLKRLENFITNTFRKIKGDKKN

SEQ ID NO: 21872 - protein, 109 aa, Saccharomyces cerevisiae
MSDAGRKGFGEKASEALKPDSQKSYAEQGKEYITDKADKVAGKVQPEDNKGVFQGVHDSAEKGKDNAEGQGESLADQARDYMGAAKSKLNDAVEYVSGRVHGEEDPTKK

SEQ ID NO: 21873 - protein, 546 aa, Saccharomyces cerevisiae
MVSSSVSILGTSAKASTSLSRKDEIKLTPETREASLDIPYKPIIAYWTVMGLCLMIAFGGFIFGWDTGTISGFINQTDFKRRFGELQRDGSFQLSDVRTGLIVGIFNIGCALGGLTLGRLGDIYGRKIGLMCVILVYVVGIVIQIASSDKWYQYFIGRIVSGMGVGGVAVLSPTLISEISPKHLRGTCVSFYQLMITLGIFLGYCTNYGTKKYSNSIQWRVPLGLCFAWAIFMVIGMVMVPESPRYLVEKGKYEEARRSLAKSNKVTVTDPGVVFEFDTIVANMELERAVGNASWHELFSNKGAILPRVIMGIVIQSLQQLTGCNYFFYYGTTIFNAVGMQDSFETSIVLGAVNFASTFVALYIVDKFGRRKCLLWGSASMAICFVIFATVGVTRLWPQGKDQPSSQSAGNVMIVFTCFFIFSFAITWAPIAYVIVAETYPLRVKNRAMAIAVGANWMWGFLIGFFTPFITRSIGFSYGYVFMGCLIFSYFYVFFFVCETKGLTLEEVNEMYEERIKPWKSGGWIPSSRRTPQPTSSTPLVIVDSK

SEQ ID NO: 21874 - protein, 779 aa, Saccharomyces cerevisiae
MGSFPLAEFPLRDIPVPYSYRVSGGIASSGSVTALVTAAGTHRNSSTAKTVETEDGEEDIDEYQRKRAAGSGESTPERSDFKRVKHDNHKTLHPVNLQNTGAASVDNDGLHNLTDISNDAEKLLMSVDDGSAAPSTLSVNMGVASHNVAAPTTVNAATITGSDVSNNVNSATINNPMEEGALPLSPTASSPGTTTPLAKTTKTINNNNNIADLIESKDSIISPEYLSDEIFSAINNNLPHAYFKNLLFRLVANMDRSELSDLGTLIKDNLKRDLITSLPFEISLKIFNYLQFEDIINSLGVSQNWNKIIRKSTSLWKKLLISENFVSPKGFNSLNLKLSQKYPKLSQQDRLRLSFLENIFILKNWYNPKFVPQRTTLRGHMTSVITCLQFEDNYVITGADDKMIRVYDSINKKFLLQLSGHDGGVWALKYAHGGILVSGSTDRTVRVWDIKKGCCTHVFKGHNSTVRCLDIVEYKNIKYIVTGSRDNTLHVWKLPKESSVPDHGEEHDYPLVFHTPEENPYFVGVLRGHMASVRTVSGHGNIVVSGSYDNTLIVWDVAQMKCLYILSGHTDRIYSTIYDHERKRCISASMDTTIRIWDLENIWNNGECSYATNSASPCAKILGAMYTLQGHTALVGLLRLSDKFLVSAAADGSIRGWDANDYSRKFSYHHTNLSAITTFYVSDNILVSGSENQFNIYNLRSGKLVHANILKDADQIWSVNFKGKTLVAAVEKDGQSFLEILDFSKASKINYVSNPVNSSSSSLESISTSLGLTRTTIIP

SEQ ID NO: 21875 - protein, 1225 aa, Saccharomyces cerevisiae
MGRLVGLELSNFKSYRGVTKVGFGESNFTSIIGPNGSGKSNMMDAISFVLGVRSNHLRSNILKDLIYRGVLNDENSDDYDNEGAASSNPQSAYVKAFYQKGNKLVELMRIISRNGDTSYKIDGKTVSYKDYSIFLENENILIKAKNFLVFQGDVEQIAAQSPVELSRMFEEVSGSIQYKKEYEELKEKIEKLSKSATESIKNRRRIHGELKTYKEGINKNEEYRKQLDKKNELQKFQALWQLYHLEQQKEELTDKLSALNSEISSLKGKINNEMKSLQRSKSSFVKESAVISKQKSKLDYIFKDKEKLVSDLRLIKVPQQAAGKRISHIEKRIESLQKDLQRQKTYVERFETQLKVVTRSKEAFEEEIKQSARNYDKFKLNENDLKTYNCLHEKYLTEGGSILEEKIAVLNNDKREIQEELERFNKRADISKRRITEELSITGEKLDTQLNDLRVSLNEKNALHTERLHELKKLQSDIESANNQEYDLNFKLRETLVKIDDLSANQRETMKERKLRENIAMLKRFFPGVKGLVHDLCHPKKEKYGLAVSTILGKNFDSVIVENLTVAQECIAFLKKQRAGTASFIPLDTIETELPTLSLPDSQDYILSINAIDYEPEYEKAMQYVCGDSIICNTLNIAKDLKWKKGIRGKLVTIEGALIHKAGLMTGGISGDANNRWDKEEYQSLMSLKDKLLIQIDELSNGQRSNSIRAREVENSVSLLNSDIANLRTQVTQQKRSLDENRLEIKYHNDLIEKEIQPKITELKKKLDDLENTKDNLVKEKEALQNNIFKEFTSKIGFTIKEYENHSGELMRQQSKELQQLQKQILTVENKLQFETDRLSTTQRRYEKAQKDLENAQVEMKSLEEQEYAIEMKIGSIESKLEEHKNHLDELQKKFVTKQSELNSSEDILEDMNSNLQVLKRERDGIKEDIEKFDLERVTALKNCKISNINIPISSETTIDDLPISSTDNEAITISNSIDINYKGLPKKYKENNTDSARKELEQKIHEVEEILNELQPNARALERYDEAEGRFEVINNETEQLKAEEKKILNQFLKIKKKRKELFEKTFDYVSDHLDAIYRELTKNPNSNVELAGGNASLTIEDEDEPFNAGIKYHATPPLKRFKDMEYLSGGEKTVAALALLFAINSYQPSPFFVLDEVDAALDITNVQRIAAYIRRHRNPDLQFIVISLKNTMFEKSDALVGVYRQQQENSSKIITLDLSNYAE

SEQ ID NO: 21876 - protein, 215 aa, Saccharomyces cerevisiae
MSGLRTVSASSGNGKSYDSIMKILLIGDSGVGKSCLLVRFVEDKFNPSFITTIGIDFKIKTVDINGKKVKLQLWDTAGQERFRTITTAYYRGAMGIILVYDVTDERTFTNIKQWFKTVNEHANDEAQLLLVGNKSDMETRVVTADQGEALAKELGIPFIESSAKNDDNVNEIFFTLAKLIQEKIDSNKLVGVGNGKEGNISINSGSGNSSKSNCC

SEQ ID NO: 21877 - protein, 878 aa, Saccharomyces cerevisiae
MSESNLSSFISTNYFNLRSAANSSNSISKPSTKKSIRNQKSPTNISSWALKKKTLQIAETTWENNEKDSTHSHYLMTGSMASRTATSLSRYSTNASLLGPSIDCVLCCIYEVPRDISTRIGLCIINCNTGQMYLSDFMDSQIYIRVVHKLQIYQPTEILIPSSSLAPTVSKLATMIKFNVAETVKIEEGSRKCFNSQDGLAAITKYLMDDTKKDLKIEEIIDKTFALCAASAAISYMEEIISKSSRNLNAFRKLRIQFEGTENTMLIDSKTVRGLELVENKLDKNGISLWKFLDTTSTKMGQRSLRNSILQPLTDRGSIEMRLEALEELKANDDLLQKLRLEMKSLPDLDKLFSRLLCINHSAIKPDQRINYVLLLKETLQSVKSLKDALNDQLIQSRLISETKKIFNNDAIMEIEKLINSCINEDCVWASSAIQLLNQRSYAVKSDSNGLLDVSRQIYKEVKEEFFREVEDLTAKNKINLDHNYDSARGFYLRIKRQEFTDDVATLPDVFISRTIKKNYIECTTLNIIKKNARLKEVMEEILLLSEETVDELLDKIATHISELFMIAEAVAILDLVCSFTYNLKENNYTIPIFTNNLLIRDSRHPLLEKVLKNFVPNTISSTKHSSSLQIITGCNMSGKSVYLKQVALICIMAQMGSGIPALYGSFPVFKRLHARVCNDSMELTSSNFGFEMKEMAYFLDDINTETLLILDELGRGSSIADGFCVSLAVTEHLLRTEATVFLSTHFQDIPKIMSKKPAVSHLHMDAVLLNDNSVKMNYQLTQKSVAIENSGIRVVKKIFNPDIIAEAYNIHSLLKIAKARTENEDSNGVVDQKTINQMKRIHNLVAILKECAGNEKEPLTLGKLKEINSDFIENFEE

SEQ ID NO: 21878 - protein, 606 aa, Saccharomyces cerevisiae
MSKSLEWDNLGFSLLPWIRTGLDVMGFETMTPVQASTIPMLAGNKDVVVDSVTGSGKTAAFVIPVLEKVVKEEANTSKFKKAHFHSLIIAPTRELSRQIESVVLSFLEHYPSDLFPIKCQLLVGTNEATVRDDVSNFLRNRPQILIGTPGRVLDFLQMPAVKTSACSMVVMDEADRLLDMSFIKDTEKILRLLPKQRRTGLFSATMRSAGSDIFKTGLRNPVRITVNSKNQAPSSLKLNYCVVNPAEKLQLLVSILNNYKFKKCIVYFPTCVSVSYFYSFIQYLGKRNILVNEVEIFSLHGKLQTSARTKTLTAFTDSLSNSVLFTTDVAARGIDIPDVDLVIQLDPPTNTDMFMHRCGRTGRANRVGKAITFLNEGREEDFIPFMQVKNVELEELDLEVKGITTNFYEDFRNWILEDRDRFDKGVKAYVAFIKYYSNHSATSIFRLQSLDYVGIAKLYGLFRLPRMPEITKYLATEKQEGIFPGNWLVDPPVNMDEYKYKDKKREKERQETLKNISLINDKKKLKSELKKKNLAWSDKTLTKERKLERKEKMSLKRKAIEEELKAEELDENAEEERIKEDWKEIVLQNKRKKVSSKAIQGNFDDL

SEQ ID NO: 21879 - protein, 306 aa, Saccharomyces cerevisiae
MERLQRLMMNSKVGSADTGRDDTKETVYISSIALLKMLKHGRAGVPMEVMGLMLGEFVDDYTVNVVDVFAMPQSGTGVSVEAVDDVFQAKMMDMLKQTGRDQMVVGWYHSHPGFGCWLSSVDVNTQKSFEQLNSRAVAVVVDPIQSVKGKVVIDAFRLIDTGALINNLEPRQTTSNTGLLNKANIQALIHGLNRHYYSLNIDYHKTAKETKMLMNLHKEQWQSGLKMYDYEEKEESNLAATKSMVKIAEQYSKRIEEEKELTEEELKTRYVGRQDPKKHLSETADETLENNIVSVLTAGVNSVAIK

SEQ ID NO: 21880 - protein, 535 aa, Saccharomyces cerevisiae
MCLEPISLVVFGSLVFFFGLVKYFKRGERQRTRGILQPEYKDKYYYSKEKGEEMGEVANVNEIPVKIRNHKYPAKEHNLRVKDLLLNRNPKLSKISTAFFIAGEELEGNKYCDTNKDFRQNRYFYHLSGVDIPASAILFNCSTDKLTLFLPNIDEEDVIWSGMPLSLDEAMRVFDIDEALYISDLGKKFKELQDFAIFTTDLDNVHDENIARSLIPSDPNFFYAMDETRAIKDWYEIESIRKACQISDKSHLAVMSALPIELNELQIQAEFEYHATRQGGRSLGYDPICCSGPACGTLHYVKNSEDIKGKHSILIDAGAEWRQYTSDITRCFPTSGKFTAEHREVYETVLDMQNQAMERIKPGAKWDDLHALTHKVLIKHFLSMGIFKKEFSEDEIFKRRASCAFYPHGLGHMLGLDVHDVGGNPNYDDPDPMFRYLRIRRPLKENMVITNEPGCYFNQFLIKEFLEKHPERLEVVDMSVLKRYMYVGGVRIEDDILVTKDGYENLTGITSDPDEIEKIVQKGLKKPRSGFHVIV

SEQ ID NO: 21881 - protein, 499 aa, Saccharomyces cerevisiae
MSGETFEFNIRHSGKVYPITLSTDATSADLKSKAEELTQVPSARQKYMVKGGLSGEESIKIYPLIKPGSTVMLLGTPDANLISKPAKKNNFIEDLAPEQQVQQFAQLPVGFKNMGNTCYLNATLQALYRVNDLRDMILNYNPSQGVSNSGAQDEEIHKQIVIEMKRCFENLQNKSFKSVLPIVLLNTLRKCYPQFAERDSQGGFYKQQDAEELFTQLFHSMSIVFGDKFSEDFRIQFKTTIKDTANDNDITVKENESDSKLQCHISGTTNFMRNGLLEGLNEKIEKRSDLTGANSIYSVEKKISRLPKFLTVQYVRFFWKRSTNKKSKILRKVVFPFQLDVADMLTPEYAAEKVKVRDELRKVEKEKNEKEREIKRRKFDPSSSENVMTPREQYETQVALNESEKDQWLEEYKKHFPPNLEKGENPSCVYNLIGVITHQGANSESGHYQAFIRDELDENKWYKFNDDKVSVVEKEKIESLAGGGESDSALILMYKGFGL

SEQ ID NO: 21882 - protein, 446 aa, Saccharomyces cerevisiae
MDDKVSEKESSPKQTEEDSEGKMAHVQPASYVNKKKYVFGKTLGAGTFGVVRQAKNTETGEDVAVKILIKKALKGNKVQLEALYDELDILQRLHHPNIVAFKDWFESKDKFYIITQLAKGGELFDRILKKGKFTEEDAVRILVEILSAVKYMHSQNIVHRDLKPENLLYIDKSDESPLVVADFGIAKRLKSDEELLYKPAGSLGYVAPEVLTQDGHGKPCDIWSIGVITYTLLCGYSAFRAERVQDFLDECTTGEYPVKFHRPYWDSVSNKAKQFILKALNLDPSKRPTAAELLEDPWIICTELKTHNLLPGLKEGLDARQKFRNSVERVRLNMKIQKLRDLYLEQTESDSDFDEGSQANGSVPPLKATDTSQLSKKLSEEEQSKLKSELTSKAFAQLVNTVLAEKEKFLNINRVCSSDSDLPGSDIKSLDEAKEKPEGKDTKTEE

SEQ ID NO: 21883 - protein, 708 aa, Saccharomyces cerevisiae
MARDLQNHLLFEVATEVTNRVGGIYSVLKSKAPVTVAQYGDNYTLLGPLNKATYESEVEKLDWEDESIFPEELLPIQKTLMSMREKGVNFVYGNWLIEGAPRVILFELDSVRHFLNEWKADLWSLVGIPSPEHDHETNDAILLGYVVVWFLGEVSKLDSSHAIIGHFHEWLAGVALPLCRKKRIDVVTIFTTHATLLGRYLCAAGDVDFYNNLQYFDVDQEAGKRGIYHRYCIERAAAHTADVFTTVSQITALEAEHLLKRKPDGILPNGLNVVKFQAVHEFQNLHALKKDKINDFVRGHFHGCFDFDLDNTVYFFIAGRYEYKNKGADMFIESLARLNYRLKVSGSKKTVVAFLIMPAKTNSFTVEALKSQAIVKSLENTVNEVTASIGKRIFEHTMRYPHNGLESELPTNLDELLKSSEKVLLKKRVLALRRPYGELPPVVTHNMCDDANDPILNQIRHVRLFNDSSDRVKVIFHPEFLNANNPILGLDYDEFVRGCHLGVFPSYYEPWGYTPAECTVMGVPSITTNVSGFGAYMEDLIETDQAKDYGIYIVDRRFKSPDESVEQLADYMEEFVNKTRRQRINQRNRTERLSDLLDWKRMGLEYVKARQLGLRRAYPEQFKQLVGETISDANMNTLAGGKKFKIARPLSVPGSPKVRSNSTVYMTPGDLGTLQDANNADDYFNLSTNGAIDNDDDDNDTSAYYEDN

SEQ ID NO: 21884 - protein, 335 aa, Saccharomyces cerevisiae
MHSHHSHSGDYSAHGTDPLDSVVDQVVNLNFHTYCLTEHIPRIEAKFIYPEEQSLGKNPEEVITKLETSFKNFMSHAQEIKTRYADRPDVRTKFIIGMEIESCDMAHIEYAKRLMKENNDILKFCVGSVHHVNGIPIDFDQQQWYNSLHSFNDNLKHFLLSYFQSQYEMLINIKPLVVGHFDLYKLFLPNDMLVNQKSGNCNEETGVPVASLDVISEWPEIYDAVVRNLQFIDSYGGAIEINTSALRKRLEEPYPSKTLCNLVKKHCGSRFVLSDDAHGVAQVGVCYDKVKKYIVDVLQLEYICYLEESQSPENLLTVKRLPISQFVNDPFWANI

SEQ ID NO: 21885 - protein, 551 aa, Saccharomyces cerevisiae
MRRSVYLDNTIEFLRGRVYLGAYDYTPEDTDELVFFTVEDAIFYNSFHLDFGPMNIGHLYRFAVIFHEILNDPENANKAVVFYSSASTRQRANAACMLCCYMILVQAWTPHQVLQPLAQVDPPFMPFRDAGYSNADFEITIQDVVYGVWRAKEKGLIDLHSFNLESYEKYEHVEFGDFNVLTPDFIAFASPQEDHPKGYLATKSSHLNQPFKSVLNFFANNNVQLVVRLNSHLYNKKHFEDIGIQHLDLIFEDGTCPDLSIVKNFVGAAETIIKRGGKIAVHCKAGLGRTGCLIGAHLIYTYGFTANECIGFLRFIRPGMVVGPQQHWLYLHQNDFREWKYTTRISLKPSEAIGGLYPLISLEEYRLQKKKLKDDKRVAQNNIEGELRDLTMTPPSNGHGALSARNSSQPSTANNGSNSFKSSAVPQTSPGQPRKGQNGSNTIEDINNNRNPTSHANRKVVIESNNSDDESMQDTNGTSNHYPKVSRKKNDISSASSSRMEDNEPSATNINNAADDTILRQLLPKNRRVTSGRRTTSAAGGIRKISGSIKK

SEQ ID NO: 21886 - protein, 1035 aa, Saccharomyces cerevisiae
MPVEFATNPFGEAKNATSLPKYGTPVTAISSVLFNNVDSIFAYKSFSQPDLLHQDLKKWSEKRGNESRGKPFFQELDIRSGAGLAPLGFSHGLKNTTAIVAPGFSLPYFINSLKTVSHDGKFLLNVGALNYDNATGSVTNDYVTALDAASKLKYGVVTPISANEVQSVALLALAIATFSNNSGAINLFDGLNYSKTVLPLVESVPEASILAKLSKVIAPDAAFDDVLDKFNELTGLRLHNFQYFGAQDAETVFITYGSLESELFNSAISGNNSKIGLINVRVPLPFNVAKFVTHVPSTTKQIVVIGQTLDGSSPSFLRSQVSAALFYHGRTSISVSEYIYQPDFIWSPKAVKSIVSSFIPEFTYNADSSFGEGFIYWASDKSINIDVASKLVKALSLEDGKFVSLRTKFDNLANAGTFQAQFVTSKEQIPVSNIDSTKLSVVEDVSLLKHLDVAATVAEQGSIALVSQKAVKDLDLNSVESYVKNLGIPESFLISIAKKNIKLFIIDGETTNDESKLSLFIQAVFWKLAFGLDVAECTNRIWKSIDSGADISAASISEFLTGAFKNFLSEVPLALYTKFSEINIEKKEDEEEPAALPIFVNETSFLPNNSTIEEIPLPETSEISDIAKKLSFKEAYEVENKLRPDLPVKNFVVKVKENRRVTPADYDRYIFHIEFDISGTGMTYDIGEALGIHARNNESLVKEFLTFYGLNESDVVLVPNKDNHHLLETRTVLQAFVENLDIFGKPPKRFYESLIPYASNEEEKKKLEDLVTPAGAVDLKRFQDVEYYTYADIFELFPSVRPSLEELVTIIEPLKRREYSIASSQKVHPNEVHLLIVVVDWVDNKGRKRYGQASKYISDLAVGSELVVSVKPSVMKLPPSPKQPVIMSGLGTGLAPFKAIVEEKLWQKQQGYEIGEVFLYLGSRHKREEYLYGELWEAYKDAGIITHIGAAFSRDQPQKIYIQDRIKENLDELKTAMIDNKGSFYLCGPTWPVPDITQALQDILAKDAEERGIKVDLDAAIEELKEASRYILEVY

SEQ ID NO: 21887 - protein, 1170 aa, Saccharomyces cerevisiae
MKVEELIIDGFKSYATRTVITDWDPQFNAITGLNGSGKSNILDAICFVLGIASMSTVRASSLQDLIYKRGQAGVTKASVTIVFDNTDKSNSPIGFTNSPQISVTRQVVLGGTSKYLINGHRAPQQSVLQLFQSVQLNINNPNFLIMQGKITKVLNMKPSEILSLIEEAAGTKMFEDRREKAERTMSKKETKLQENRTLLTEEIEPKLEKLRNEKRMFLEFQSTQTDLEKTERIVVSYEYYNIKHKHTSIRETLENGETRMKMLNEFVKKTSEEIDSLNEDVEEIKLQKEKELHKEGTISKLENKENGLLNEISRLKTSLSIKVENLNDTTEKSKALESEIASSSAKLIEKKSAYANTEKDYKMVQEQLSKQRDLYKRKEELVSTLTTGISSTGAADGGYNAQLAKAKTELNEVSLAIKKSSMKMELLKKELLTIEPKLKEATKDNELNVKHVKQCQETCDKLRARLVEYGFDPSRIKDLKQREDKLKSHYYQTCKNSEYLKRRVTNLEFNYTKPYPNFEASFVHGVVGQLFQIDNDNIRYATALQTCAGGRLFNVVVQDSQTATQLLERGRLRKRVTIIPLDKIYTRPISSQVLDLAKKIAPGKVELAINLIRFDESITKAMEFIFGNSLICEDPETAKKITFHPKIRARSITLQGDVYDPEGTLSGGSRNTSESLLVDIQKYNQIQKQIETIQADLNHVTEELQTQYATSQKTKTIQSDLNLSLHKLDLAKRNLDANPSSQIIARNEEILRDIGECENEIKTKQMSLKKCQEEVSTIEKDMKEYDSDKGSKLNELKKELKLLAKELEEQESESERKYDLFQNLELETEQLSSELDSNKTLLHNHLKSIESLKLENSDLEGKIRGVEDDLVTVQTELNEEKKRLMDIDDELNELETLIKKKQDEKKSSELELQKLVHDLNKYKSNTNNMEKIIEDLRQKHEFLEDFDLVRNIVKQNEGIDLDTYRERSKQLNEKFQELRKKVNPNIMNMIENVEKKEAALKTMIKTIEKDKMKIQETISKLNEYKRETLVKTWEKVTLDFGNIFADLLPNSFAKLVPCEGKDVTQGLEVKVKLGNIWKESLIELSGGQRSLIALSLIMALLQFRPAPMYILDEVDAALDLSHTQNIGHLIKTRFKGSQFIVVSLKEGMFANANRVFRTRFQDGTSVVSIM

SEQ ID NO: 21888 - protein, 124 aa, Saccharomyces cerevisiae
MIRRAPTTLQLSHDDVTSLIDDLNEQKLKQQLNIEKTKYFQGKNGGSLHSNTDFQDTSQNIEDNNNDNDNDIDEDDDMSSYNDKAASVAHTRVLNSLHLSTDSNTAHETSNANDNHNPFYIREE

SEQ ID NO: 21889 - protein, 778 aa, Saccharomyces cerevisiae
MSRCSNAALMTVVEDAVGARVAARTRNMSNGVNYREKEVNDLTADISDSDSDLDSEDNKHGKGDNDTAPIWLQDDVHSDEDIQLDSEDDSDTEAVQAQVVDKLAKDTKSEQKSLDDELSEMDTKTVSLKLKKLNEFVRQSQVYSSIIADTLLHRSNEVANANTKDNSNSDDEEHSSKKRKTKKKSITDFFKKQKKNEDTTTQNGAPDDAAIKQPRLLKNCILKPYQLEGLNWLITLYENGLNGILADEMGLGKTVQSIALLAFIYEMDTKGPFLVTAPLSTLDNWMNEFAKFAPDLPVLKYYGTNGYKERSAKLKNFFKQHGGTGIVITSYEIILRDTDLIMSQNWKFLIVDEGHRLKNINCRLIKELKKINTSNRLLLTGTPLQNNLAELWSLLNFIMPDIFADFEIFNKWFDFDSLNLGSGSNSEALNKLINDELQKNLISNLHTILKPFLLRRLKKVVLANILPPKREYIINCPMTSAQEKFYKAGLNGKLKKTMFKELIKDFFTLNDEYIGHVSNRSIRDFINYKLSGNETSNTDNKINPTLLQMDKLYKKNLQMEISNKKLQNMMMQLRQIIDSTFLFYFPYLHPEDLTLETLLKTSGKLQILQKLIPPLISEGHKVLIYSQFVNMLDLIEDWCDLNSFATFRIDGSVNNETRKDQLEKFNSSKDKHNIFLLSTRAAGLGINLVGADTVVLFDSDWNPQVDLQAMDRCHRIGQESPVIVYRLCCDNTIEHVILTRAANKRNLERMVIQMGKFNNLKKLALNEGFFFEGKQSGC

SEQ ID NO: 21890 - protein, 905 aa, Saccharomyces cerevisiae
MNSSESSTTSFSSGSTSKTDLDEEDISNATAPMMVTTKNLDNSFIERMLVETELLNELSRQNKTLLDFICFGFFFDKKTNKKVNNMEYLVDQLMECISKIKTATTVDLNNLIDYQEQQQLDDSSQEDVYVESDTEQEEEKEDDNNSNNKKRRKRGSSSFGNDDINNNDDDDDANEDDESAYLTKATIISEIFSLDIWLISESLVKNQSYLNKIWSIINQPNFNSENSPLVPIFLKINQNLLLTRQDQYLNFIRTERSFVDDMLKHVDISLLMDFFLKIISTDKIESPTGIIELVYDQNLISKCLSFLNNKESPADIQACVGDFLKALIAISANAPLDDISIGPNSLTRQLASPESIAKLVDIMINQRGAALNTTVSIVIELIRKNNSDYDQVNLLTTTIKTHPPSNRDPIYLGYLLRKFSNHLSDFFQIILDIENDANIPLHENQLHEKFKPLGFERFKVVELIAELLHCSNMGLMNSKRAERIARRRDKVRSQLSHHLQDALNDLSIEEKEQLKTKHSPTRDTDHDLKNNNGKIDNDNNDNDDESDYGDEIDESFEIPYINMKQTIKLRTDPTVGDLFKIKLYDTRIVSKIMELFLTHPWNNFWHNVIFDIIQQIFNGRMDFSYNSFLVLSLFNLKSSYQFMTDIVISDEKGTDVSRFSPVIRDPNFDFKITTDFILRGYQDSYKFYELRKMNLGYMGHIVLIAEEVVKFSKLYKVELISPDIQVILQTEEWQYYSEEVLNETRMMYSKILGGGSYIDDGNGNIIPQLPDNTTVLTPNGDASNNNEILDSDTGSSNGTSGGGQLINVESLEEQLSLSTESDLHNKLREMLINRAQEDVDNKNTENGVFILGPPEDKNSNSNINNTNHNSNNSNNNDNNDNNDNDNDNTRNYNEDADNDNDYDHE

SEQ ID NO: 21891 - protein, 178 aa, Saccharomyces cerevisiae
MIDHKKLEKNQPVVNAKATFHKVATKSTPVARIEKLLPAVKHMYQTRGPAAFVQGTTATIFRQIANTSIQFTAYTAFKRLLQARNDKASSVITGLATSFTLVAMTQPIDVVKTRMMSQNAKTEYKNTLNCMYRIFVQEGMATFWKGSIFRFMKVGISGGLTFTVYEQVSLLLGFSSRS

SEQ ID NO: 21892 - protein, 266 aa, Saccharomyces cerevisiae
MNHDPFSWGRPADSTYGAYNTQIANAGASPMVNTQQPIVTGTSVISMKYDNGVIIAADNLGSYGSLLRFNGVERLIPVGDNTVVGISGDISDMQHIERLLKDLVTENAYDNPLADAEEALEPSYIFEYLATVMYQRRSKMNPLWNAIIVAGVQSNGDQFLRYVNLLGVTYSSPTLATGFGAHMANPLLRKVVDRESDIPKTTVQVAEEAIVNAMRVLYYRDARSSRNFSLAIIDKNTGLTFKKNLQVENMKWDFAKDIKGYGTQKI

SEQ ID NO: 21893 - protein, 485 aa, Saccharomyces cerevisiae
MVHLGPKKPQARKGSMADVPKELMDEIHQLEDMFTVDSETLRKVVKHFIDELNKGLTKKGGNIPMIPGWVMEFPTGKESGNYLAIDLGGTNLRVVLVKLSGNHTFDTTQSKYKLPHDMRTTKHQEELWSFIADSLKDFMVEQELLNTKDTLPLGFTFSYPASQNKINEGILQRWTKGFDIPNVEGHDVVPLLQNEISKRELPIEIVALINDTVGTLIASYYTDPETKMGVIFGTGVNGAFYDVVSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFENLEDTDDIFQKDFGVKTTLPERKLIRRLCELIGTRAARLAVCGIAAICQKRGYKTGHIAADGSVYNKYPGFKEAAAKGLRDIYGWTGDASKDPITIVPAEDGSGAGAAVIAALSEKRIAEGKSLGIIGA

SEQ ID NO: 21894 - protein, 165 aa, Saccharomyces cerevisiae
MQLFSILSLLSSLMCSLTVLGSSASSYVKFPVQKFADIINIGTQDVSTVFKRNEVLNTTVINGIGVYVVKMEIGTPPQTVYLQLDTGSSDMIVNNADIAYCKSMSDGSDYASTDNYELTATFTGPRSTTTSPELITLSALIGVNSMQETHLLLRITRLSSMTYTY

SEQ ID NO: 21895 - protein, 465 aa, Saccharomyces cerevisiae
MLGITYAVNSTKQLIFCCLKYLTLLGYILLSNRKKGQRTNMYKRVISISGLLKTGVKRFSSVYCKTTINNKFTFATTNSQIRKMSSVTGFYIPPISFFGEGALEETADYIKNKDYKKALIVTDPGIAAIGLSGRVQKMLEERDLNVAIYDKTQPNPNIANVTAGLKVLKEQNSEIVVSIGGGSAHDNAKAIALLATNGGEIGDYEGVNQSKKAALPLFAINTTAGTASEMTRFTIISNEEKKIKMAIIDNNVTPAVAVNDPSTMFGLPPALTAATGLDALTHCIEAYVSTASNPITDACALKGIDLINESLVAAYKDGKDKKARTDMCYAEYLAGMAFNNASLGYVHALAHQLGGFYHLPHGVCNAVLLPHVQEANMQCPKAKKRLGEIALHFGASQEDPEETIKALHVLNRTMNIPRNLKELGVKTEDFEILAEHAMHDACHLTNPVQFTKEQVVAIIKKAYEY

SEQ ID NO: 21896 - protein, 486 aa, Saccharomyces cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 21897 - protein, 724 aa, Saccharomyces cerevisiae
MTKLFSKVKESIEGIKMPSTLTINGKAPIVAYAELIAARIVNALAPNSIAIKLVDDKKAPAAKLDDATEDVFNKITSKFAAIFDNGDKEQVAKWVNLAQKELVIKNFAKLSQSLETLDSQLNLRTFILGGLKYSAADVACWGALRSNGMCGSIIKNKVDVNVSRWYTLLEMDPIFGEAHDFLSKSLLELKKSANVGKKKETHKANFEIDLPDAKMGEVVTRFPPEPSGYLHIGHAKAALLNQYFAQAYKGKLIIRFDDTNPSKEKEEFQDSILEDLDLLGIKGDRITYSSDYFQEMYDYCVQMIKDGKAYCDDTPTEKMREERMDGVASARRDRSVEENLRIFTEEMKNGTEEGLKNCVRAKIDYKALNKTLRDPVIYRCNLTPHHRTGSTWKIYPTYDFCVPIVDAIEGVTHALRTIEYRDRNAQYDWMLQALRLRKVHIWDFARINFVRTLLSKRKLQWMVDKDLVGNWDDPRFPTVRGVRRRGMTVEGLRNFVLSQGPSRNVINLEWNLIWAFNKKVIDPIAPRHTAIVNPVKIHLEGSEAPQEPKIEMKPKHKKNPAVGEKKVIYYKDIVVDKDDADVINVDEEVTLMDWGNVIITKKNDDGSMVAKLNLEGDFKKTKHKLTWLADTKDVVPVDLVDFDHLITKDRLEEDESFEDFLTPQTEFHTDAIADLNVKDMKIGDIIQFERKGYYRLDALPKDGKPYVFFTIPDGKSVNKYGAKK

SEQ ID NO: 21898 - protein, 1004 aa, Saccharomyces cerevisiae
MDINELIIGAQSADKHTREVAETQLLQWCDSDASQVFKALANVALQHEASLESRQFALLSLRKLITMYWSPGFESYRSTSNVEIDVKDFIREVLLKLCLNDNENTKIKNGASYCIVQISAVDFPDQWPQLLTVIYDAISHQHSLNAMSLLNEIYDDVVSEEMFFEGGIGLATMEIVFKVLNTETSTLIAKIAALKLLKACLLQMSSHNEYDEASRKSFVSQCLATSLQILGQLLTLNFGNVDVISQLKFKSIIYENLVFIKNDFSRKHFSSELQKQFKIMAIQDLENVTHINANVETTESEPLLETVHDCSIYIVEFLTSVCTLQFSVEEMNKIITSLTILCQLSSETREIWTSDFNTFVSKETGLAASYNVRDQANEFFTSLPNPQLSLIFKVVSNDIEHSTCNYSTLESLLYLLQCILLNDDEITGENIDQSLQILIKTLENILVSQEIPELILARAILTIPRVLDKFIDALPDIKPLTSAFLAKSLNLALKSDKELIKSATLIAFTYYCYFAELDSVLGPEVCSETQEKVIRIINQVSSDAEEDTNGALMEVLSQVISYNPKEPHSRKEILQAEFHLVFTISSEDPANVQVVVQSQECLEKLLDNINMDNYKNYIELCLPSFINVLDSNNANNYRYSPLLSLVLEFITVFLKKKPNDGFLPDEINQYLFEPLAKVLAFSTEDETLQLATEAFSYLIFNTDTRAMEPRLMDIMKVLERLLSLEVSDSAAMNVGPLVVAIFTRFSKEIQPLIGRILEAVVVRLIKTQNISTEQNLLSVLCFLTCNDPKQTVDFLSSFQIDNTDALTLVMRKWIEAFEVIRGEKRIKENIVALSNLFFLNDKRLQKVVVNGNLIPYEGDLIITRSMAKKMPDRYVQVPLYTKIIKLFVSELSFQSKQPNPEQLITSDIKQEVVNANKDDDNDDWEDVDDVLDYDKLKEYIDDDVDEEADDDSDDITGLMDVKESVVQLLVRFFKEVASKDVSGFHCIYETLSDSERKVLSEALL

SEQ ID NO: 21899 - protein, 283 aa, Saccharomyces cerevisiae
MRQNKRRLYKRKKVLNKLTTEGGKNNTRFRSQIMDPIGINKVLDHLAPSELIKPVKSCHNKPSVLVLDDRIVDAATKDLYVNGFQEEIQYQNPTPENLQHMFHQGIEILDSARMINVTHLALWKPSSFKLGNPVDFALDDNYDTFWQSDGGQPHQLDIMFSKRMDICVMAIFFSMIADESYAPSLVKVYAGHSPSDARFYKMLEVRNVNGWVALRFLDNREDDQLLKCQFIRLLFPVNHENGKDTHLRGIRLYVPSNEPHQDTHEWAQTLPETNNVFQDAILR

SEQ ID NO: 21900 - protein, 802 aa, Saccharomyces cerevisiae
MLNILVLGNGAREHVLVTKLAQSPTVGKIYVAPGNGGTATMDPSRVINWDITPDVANFARLQSMAVEHKINLVVPGPELPLVNGITSVFHSVGIPVFGPSVKAAQLEASKAFSKRFMSKHNIPTASYDVFTNPEEAISFLQAHTDKAFVIKADGIAAGKGVIIPSSIDESVQAIKDIMVTKQFGEEAGKQVVIEQFLEGDEISLLTIVDGYSHFNLPVAQDHKRIFDGDKGLNTGGMGAYAPAPVATPSLLKTIDSQIVKPTIDGMRRDGMPFVGVLFTGMILVKDSKTNQLVPEVLEYNVRFGDPETQAVLSLLDDQTDLAQVFLAAAEHRLDSVNIGIDDTRSAVTVVVAAGGYPESYAKGDKITLDTDKLPPHTQIFQAGTKYDSATDSLLTNGGRVLSVTSTAQDLRTAVDTVYEAVKCVHFQNSYYRKDIAYRAFQNSESSKVAITYADSGVSVDNGNNLVQTIKEMVRSTRRPGADSDIGGFGGLFDLAQAGFRQNEDTLLVGATDGVGTKLIIAQETGIHNTVGIDLVAMNVNDLVVQGAEPLFFLDYFATGALDIQVASDFVSGVANGCIQSGCALVGGETSEMPGMYPPGHYDTNGTAVGAVLRQDILPKINEMAAGDVLLGLASSGVHSNGFSLVRKIIQHVALPWDAPCPWDESKTLGEGILEPTKIYVKQLLPSIRQRLLLGLAHITGGGLVENIPRAIPDHLQARVDMSTWEVPRVFKWFGQAGNVPHDDILRTFNMGVGMVLIVKRENVKAVCDSLTEEGEIIWELGSLQERPKDAPGCVIENGTKLY

SEQ ID NO: 21901 - protein, 910 aa, Saccharomyces cerevisiae
MDQEGQPLLSKDFQQVLLATASGNNSSWTERAVLNNESTDAVKHEPALGQNDVFDLDPLSFDKWVPFLRRALDKNQLDPVIDELENSIEDNFQGLELQLLQDSQMNDKLETSIDEIANIQGMVQDTLSSEISKFQIRLSESANELIVKKQMYVNNKKISLKISEATILITKVVRILELSSKCQELITERKFFKVLQNLDSLEKLYLQEFKNYNFQFLIEIYNSIPFLQKVTKDECINLIRNSLNLNLGKNLIKVGQEFVAIYENELLPQWLETRSKMKLTNFKFNSPIEISMRDESFLAKLNLGEFFQLDDFHDSIMIFQNLNELSVLSGEFNKEYELRKTKLMYPLIWKKNKTAAYQMDSLLRGTGTTPGSTAHDVSTDDPFTQSLSLHFLQDYFLKILGFLLYDINLNKATEFILVDNNYNSTNEFWDGLMDRLSPYLSYFIDEKLKTEEDMIKLKDFLCIYVAILENFKLNIEPLYKILVSIFEKFCSVSLRAFDDEFQILLNDDDFMPLSINDKTLYEKVLKICWMKEGEHLSLPDPTNGEPFAVTLPFSPLYPMTCTLAKKTYSKITAFLSIFYRHELHTLNNILVKTMDDIFNDIVNKKIRSKLESTSREEIAQILVNLDYFIIAAKEFSNFMTRENILQNPDMEIRLSSIKYLAESRKLAETKLIELIDSKISDILETIEIDWQITEVRQDPDISIIDLAQFLEMMFASTLQNLPYSVQTLLIFREFDSLTRQFMGLLLHDTPSTITHESIMNFEVDVNYLESIIPRIFPSTPGTIDSNGYQSPMTPSTPTFPNANGVDAPTLFENNIKSLEATFMELKQCIELLKTQGKDYNEPEIRLRKYSRIRQEDAALLLSKIQHFVSSVEGANGDDTSVMDSSSIFNSESASVIDSNTSRIAKFFNRR

SEQ ID NO: 21902 - protein, 818 aa, Saccharomyces cerevisiae
MSLWPFGETLSHSGIDSILEEYYLIFRSLEGNETSSTDDKKNEPSMESESEFGTESRDRSDLNQSFIDRILLETALLDELNGAANDRLVDFICLGYFYDDRSQQVRHMDYLVDMLMAYLKDIDRTGYRTPFLLENSFHQTGEYEDQDDEDPMLYVNIISSIFCSKSAPIVEALVQNTPFLSSLFEVFQFENIEAENCPILAVFLKINETLLFEQTSSYLEFFKSQPNIVDKFLYHIEVSPLVEFLIKIMLTDQVESPTNIIDFLYHQDLIPKCLNLLENSKYSPGIQNSSGELLKALISISTNFKLDTLWIGPNRLTRQLASPQYVDQLINIILFQRGHAMGVAVSIIIELIRKNNSDYDEVDLLSTTIVDNPPSQRDPVYLGHLLYELTMHMEDFYALLIKLENDDDDDHDTASKALPSVKHHLLENQLHESFRPLGFERVKITELISEMLHCSNMGLMNSKRGEKIARTRDKCRDTLDQNSLEKAMKNLNINDNTITSNTLEDKCNNNDSNDSNDNQKQKKNIKKKFHDNELYSTFDTSDDNIDDDDDMSFEIPYVSETQNLKIRKNPTIGDLFKIKLHDLGFFPKFLQLFLRYPWNNFWHNIVFDIIQQIFNGRMDFSYNSFLVYSLFDFKKSTRFIPKPLYGSNQKLPVKDFHIISDFILQGHKDSFEFYEKEKTNLGYMGQLVLIAEEIAKYSKIYKTDLIAPDIYAFLQDEVWMSYSSDILNETRTMCSIILGGGQFCAESDENTNQDFLEKADMSKPAHPSTMDENEIVHEEDVKLHDKVAELIDELGQLTELDIHDKIKDVIVDHHSDLN

SEQ ID NO: 21903 - protein, 805 aa, Saccharomyces cerevisiae
MNVPETRQSSIVVAIRVRPFTSMEKTRLVNEASGAEANFPGLGDSSLILPMSNNSDSDIDIDAEEGSTRSKRNSLLRRKVIRPEGIRKIVDCVDDRMLIFDPADRNPLNKVSDQVLNSMRARATKATASSINNSNATNKFSSQRRRHGGEIKFVFDKLFDETSSQARVYKETTSPLLDSVLDGFNSTVFAYGATGCGKTYTVSGTPSQPGIIFLAMEELFNKITDLKDEKDFEISLSYLEIYNERIRDLLKPETPSKRLVIREDTQNHIKVANLSYHHPNTVEDVMDLVVQGNINRTTSPTEANEVSSRSHAVLQIHIMQTNKLVDLTSQHTFATLSIIDLAGSERAAATRNRGIRLHEGANINRSLLALGNCINALCLNDGSRSCHIPYRDSKLTRLLKFSLGGNCKTVMIVCISPSSSHYDETLNTLKYANRAKEIKTKIIRNQQSLSRHVGSYLKMITEQKRQIEELREREEKMISLKLTKYKLNKEKIQLAINECVNRVQQTYAGVETYQVAKTLKSLILCKRRFLQMVKLEVDNLILLFEREESTAAEMQPVISNCRMISGQLYNKIHELEMKFDETDTLSSVIHQVHSIDLNKLREMEDWDETYDLVYLESCLNQISELQRNEILVNSSIMTEKLMSDPGLNSRFKFLSKWLMNRTPNIESIIQDLVHIDEEFESFARTFIANPDSNFTNTNINIINTTAADLAVPAETLQRQNFSQKKVKWTSPDLSPSPMIEPQPELEPELHQDQDAIASEVDVSMQDTTFNEQGPSTPSAPTTAVPRRKMRSSLLTHQSLLATARK

SEQ ID NO: 21904 - protein, 452 aa, Saccharomyces cerevisiae
MANTFKYYPETMGNSSGYPISLPFPKGSATSAVNVARQLPKYLGHVPSQSVHTQLPSMASLGYFNQPSSTYYAPPAPLQQHQQPPILPPPGLMYTSNNNSNVIPPPVQMIRDGQQQPQQSNQVNGGVSENLDYDISIMSKFIMENAFVAFNANYSTDDQTTDLFFKGISSVLNATRLPSATIFLAIDYLFKYINKLSNGIHSIGGNSINIIYQNTMIAFILANKFNDDKTFTNNSWSQATGILINVINDFERQWLRIFNWELYDSAFLYFEFVKNFEIFKQNQLKPAVAVPTLLSPIVNVGDTRNVNFNLKPTSTNNLLSPVSNYETPMLMPHNMFSSPSYQSNSRSEFSSMNGYYNYYNYNQPRLNYYQQFPNIYSSPISETQFDYDFYNFSSQQQQQQQKQHSLLPAAPQLPPPHVHNQSYGHHLGWKSMDDTINHSRFERNYFPYSAVY

SEQ ID NO: 21905 - protein, 222 aa, Saccharomyces cerevisiae
MSNEDYGYDYDYLFKIVLIGDSGVGKSNLLSRFTTDEFNIESKSTIGVEFATRTIEVENKKIKAQIWDTAGQERYRAITSAYYRGAVGALIVYDISKSSSYENCNHWLTELRENADDNVAVGLIGNKSDLAHLRAVPTDEAKNFAMENQMLFTETSALNSDNVDKAFRELIVAIFQMVSKHQVDLSGSGTNNMGSNGAPKGPTISLTPAPKEDKKKKSSNCC

SEQ ID NO: 21906 - protein, 267 aa, Saccharomyces cerevisiae
MIHQPIPQVLPANMAINVQAVNGGNIIHAPNAVHPMVIPIMAQPAPIHASAASFQPATSPMPISTYTPVPSQSFTSFQSSIGSIQSNSDVSSIFSNMNVRVNTPRSVPNSPNDGYLHQQHIPQQYQHQTASPSVAKQQKTFAHSLASALSTLQKRTPVSAPSTTIESPSSPSDSSHTSASSSAISLPFSNAPSQLAVAKELESVYLDSNRYTTKTRRERAKFEIPEEQEEDTNNSSSGSNEEEHESLDHESSKSRKKLSGRKIAACT

SEQ ID NO: 21907 - protein, 1035 aa, Saccharomyces cerevisiae
MEELNIDFDVFKKRIELLYSKYNEFEGSPNSLLFVLGSSNAENPYQKTTILHNWLLSYEFPATLIALVPGKVIIITSSAKAKHLQKAIDLFKDPESKITLELWQRNNKEPELNKKLFDDVIALINSAGKTVGIPEKDSYQGKFMTEWNPVWEAAVKENEFNVIDISLGLSKVWEVKDVNEQAFLSVSSKGSDKFMDLLSNEMVRAVDEELKITNAKLSDKIENKIDDVKFLKQLSPDLSALCPPNYKFNFDLLDWTYSPIIQSGKKFDLRVSARSTNDQLYGNGCILASCGIRYNNYCSNITRTFLIDPSEEMANNYDFLLTLQKEIVTNILKPGRTPKEVYESVIEYIEKTKPELVPNFTKNIGSLIGLEFRDSNFILNVKNDYRKIQRGDCFNISFGFNNLKDSQSANNYALQLADTVQIPLDETEPPRFLTNYTKAKSQISFYFNNEEEDNNKKKSSPATKVPSKPDRNSKILRTKLRGEARGGAEDAQKEQIRKENQKKLHEKLEKNGLLRFSAADANGPDSEPRQYFKKYESYVRDSQLPTNIRDLRIHVDWKSQTIILPIYGRPVPFHINSYKNGSKNEEGEYTYLRLNFNSPGSSGGISKKVEELPYEESADNQFVRSITLRSKDGDRMSETFKQIADLKKEATKREQERKALADVVQQDKLIENKTGRTKRLDQIFVRPNPDTKRVPSTVFIHENGIRFQSPLRTDSRIDILFSNIKNLIFQSCKGELIVVIHIHLKNPILMGKKKIQDVQFYREASDMSVDETGGGRRGQSRFRRYGDEDELEQEQEERRKRAALDKEFKYFADAIAEASNGLLTVENTFRDLGFQGVPNRSAVFCMPTTDCLVQLIEPPFLVINLEEVEICILERVQFGLKNFDMVFVYKDFNKPVTHINTVPIESLDFLKQWLTDMDIPYTVSTINLNWATIMKSLQDDPYQFFLDGGWNFLATGSDDEASDESEEEVSEYEASEDDVSDESAFSEDEEGSEVDDDISGDESEDYTGDESEEGEDWDELEKKAARADRGANFRD

SEQ ID NO: 21908 - protein, 748 aa, Saccharomyces cerevisiae
MTRRTTINPDSVVLNPQKFIQKERADSKIKVDQVNTFLESSPERRTLTHALIDQIVNDPILKTDTDYYDAKKMQEREITAKKIARLASYMEHDIKTVRKHFRDTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFVIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSAYKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGEIKSGLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 21909 - protein, 729 aa, Saccharomyces cerevisiae
MFYNRWLGTWLAMSALIRISVSLPSSEEYKVAYELLPGLSEVPDPSNIPQMHAGHIPLRSEDADEQDSSDLEYFFWKFTNNDSNGNVDRPLIIWLNGGPGCSSMDGALVESGPFRVNSDGKLYLNEGSWISKGDLLFIDQPTGTGFSVEQNKDEGKIDKNKFDEDLEDVTKHFMDFLENYFKIFPEDLTRKIILSGESYAGQYIPFFANAILNHNKFSKIDGDTYDLKALLIGNGWIDPNTQSLSYLPFAMEKKLIDESNPNFKHLTNAHENCQNLINSASTDEAAHFSYQECENILNLLLSYTRESSQKGTADCLNMYNFNLKDSYPSCGMNWPKDISFVSKFFSTPGVIDSLHLDSDKIDHWKECTNSVGTKLSNPISKPSIHLLPGLLESGIEIVLFNGDKDLICNNKGVLDTIDNLKWGGIKGFSDDAVSFDWIHKSKSTDDSEEFSGYVKYDRNLTFVSVYNASHMVPFDKSLVSRGIVDIYSNDVMIIDNNGKNVMITTDDDSDQDATTESGDKPKENLEEEEQEAQNEEGKEKEGNKDKDGDDDNDNDDDDEDDHNSEGDDDDDDDDDEDDNNEKQSNQGLEDSRHKSSEYEQEEEEVEEFAEEISMYKHKAVVVTIVTFLIVVLGVYAYDRRVRRKARHTILVDPNNRQHDSPNKTVSWADDLESGLGAEDDLEQDEQLEGGAPISSTSNKAGSKLKTKKKKKYTSLPNTEIDESFEMTDF

SEQ ID NO: 21910 - protein, 1017 aa, Saccharomyces cerevisiae
MSSPFPADTPSSNRPSNSSPPPSSIGAGFGSSSGLDSQIGSRLHFPSSSQPHVSNSQTGPFVNDSTQFSSQRLQTDGSATNDMEGNEPARSFKSRALNHVKKVDDVTGEKVREAFEQFLEDFSVQSTDTGEVEKVYRAQIEFMKIYDLNTIYIDYQHLSMRENGALAMAISEQYYRFLAFLQKGLRRVVRKYAPELLNTSDSLKRSEGDEGQADEDEQQDDDMNGSSLPRDSGSSAAPGNGTSAMATRSITTSTSPEQTERVFQISFFNLPTVHRIRDIRSEKIGSLLSISGTVTRTSEVRPELYKASFTCDMCRAIVDNVEQSFKYTEPTFCPNPSCENRAFWTLNVTRSRFLDWQKVRIQENANEIPTGSMPRTLDVILRGDSVERAKPGDRCKFTGVEIVVPDVTQLGLPGVKPSSTLDTRGISKTTEGLNSGVTGLRSLGVRDLTYKISFLACHVISIGSNIGASSPDANSNNRETELQMAANLQANNVYQDNERDQEVFLNSLSSDEINELKEMVKDEHIYDKLVRSIAPAVFGHEAVKKGILLQMLGGVHKSTVEGIKLRGDINICVVGDPSTSKSQFLKYVVGFAPRSVYTSGKASSAAGLTAAVVRDEEGGDYTIEAGALMLADNGICCIDEFDKMDISDQVAIHEAMEQQTISIAKAGIHATLNARTSILAAANPVGGRYNRKLSLRGNLNMTAPIMSRFDLFFVILDDCNEKIDTELASHIVDLHMKRDEAIEPPFSAEQLRRYIKYARTFKPILTKEARSYLVEKYKELRKDDAQGFSRSSYRITVRQLESMIRLSEAIARANCVDEITPSFIAEAYDLLRQSIIRVDVDDVEMDEEFDNIESQSHAASGNNDDNDDGTGSGVITSEPPADIEEGQSEATARPGTSEKKKTTVTYDKYVSMMNMIVRKIAEVDREGAEELTAVDIVDWYLLQKENDLGSLAEYWEERRLAFKVIKRLVKDRILMEIHGTRHNLRDLENEENENNKTVYVIHPNCEVLDQLEPQDSS

SEQ ID NO: 21911 - protein, 452 aa, Saccharomyces cerevisiae
MSGTFSYDVKTKENEPLFEFNSAYSPRVSYHFNSKVSHYHYGVKHPMKPFRLMLTDHLVSSYGLHKIMDLYETRSATRDELLQFHSEDYVNFLSKVSPENANKLPRGTLENFNIGDDCPIFQNLYDYTTLYTGASLDATRKLINNQSDIAINWSGGLHHAKKNSPSGFCYVNDIVLSILNLLRYHPRILYIDIDLHHGDGVQEAFYTTDRVFTLSFHKYNGEFFPGTGDLTEIGCDKGKHFALNVPLEDGIDDDSYINLFKSIVDPLIMTFKPTLIVQQCGADSLGHDRLGCFNLNIKAHGECVKFVKSFGLPMLVVGGGGYTPRNVSRLWTYETGILNDVLLPEDIPEDIPFRDSFGPDYSLYPMLDDLYENKNSKKLLEDIRIRCLENIRYLQGAPSVRMDAECIPTQDISALTEEEDKIIQEMNEETEADSSNRLEEMEKENSGLIAFS

SEQ ID NO: 21912 - protein, 526 aa, Saccharomyces cerevisiae
MAQNNFDFKFSQCFGDKADIVVTEADLITAVEFDYTGNYLATGDKGGRVVLFERSNSRHCEYKFLTEFQSHDAEFDYLKSLEIEEKINEIKWLRPTQRSHFLLSTNDKTIKLWKVYEKNIKLVSQNNLTEGVTFAKKGKPDNHNSRGGSVRAVLSLQSLKLPQLSQHDKIIAATPKRIYSNAHTYHINSISLNSDQETFLSADDLRINLWNLDIPDQSFNIVDIKPTNMEELTEVITSAEFHPQECNLFMYSSSKGTIKLCDMRQNSLCDNKTKTFEEYLDPINHNFFTEITSSISDIKFSPNGRYIASRDYLTVKIWDVNMDNKPLKTINIHEQLKERLSDTYENDAIFDKFEVNFSGDSSSVMTGSYNNNFMIYPNVVTSGDNDNGIVKTFDEHNAPNSNSNKNIHNSIQNKDSSSSGNSHKRRSNGRNTGMVGSSNSSRSSIAGGEGANSEDSGTEMNEIVLQADKTAFRNKRYGSLAQRSARNKDWGDDIDFKKNILHFSWHPRENSIAVAATNNLFIFSAL

SEQ ID NO: 21913 - protein, 379 aa, Saccharomyces cerevisiae
MCDSPATTGKPTILFIADPCETSATLNSKAFKEKFRILRYQLDTKEAFLNFLERHEQDKICAIYAGFPAFKKIGGMTRSIIEHKSFPRKNLKCIVLCSRGYDGWDLDTLRKHEIRLYNYQDDENEKLIDDLKLHQVGNDVADCALWHILEGFRKFSYYQKLSRETGNTLTARAKAAEKSGFAFGHELGNMFAESPRGKKCLILGLGSIGKQVAYKLQYGLGMEIHYCKRSEDCTMSQNESWKFHLLDETIYAKLYQFHAIVVTLPGTPQTEHLINRKFLEHCNPGLILVNLGRGKILDLRAVSDALVTGRINHLGLDVFNKEPEIDEKIRSSDRLTSITPHLGSATKDVFEQSCELALTRILRVVSGEAASDEHFSRVV

SEQ ID NO: 21914 - protein, 465 aa, Saccharomyces cerevisiae
MPIKRLDTVVVNTGSQNDQHSASVPPVYLSTTFKVDLNNEDAQNYDYSRSGNPTRSVLQHQIGKLYRVPQENVLAVSSGMTALDVILRGLVLLNGTDNHTPTIIAGDDLYGGTQRLLNFFKQQSHAVSVHVDTSDFEKFKTVFQSLDKVDCVLLESPTNPLCKVVDIPRILRFVKCISPDTTVVVDNTMMSGLNCNPLQLNPGCDVVYESATKYLNGHHDLMGGVIISKTPEIASKLYFVINSTGAGLSPMDSWLLVRGLKTLGVRLYQQQRNAMILAHWLENSCGFKPTRTNKATKTRFVGLRSNPDFKLHKSFNNGPGAVLSFETGSFEHSKRLVSSKKLSIWAVTVSFGCVNSLLSMPCKMSHASIDPELRKERDFPEDLVRLCCGIENIVDLKKDLLAAMVDADIIEVRENGKYLFNKLNKNLAVNTTIDDLHKPLSIYEEFYNQDLIRKDSELNIKSSKL

SEQ ID NO: 21915 - protein, 396 aa, Saccharomyces cerevisiae
MRFRSSSHSLKHVDRELKELINSSENANKCGECGNFYPTWCSVNLGVFLCGRCASVHRKVFGSRDDDAFSNVKSLSMDRWTREDIDELVSLGGNKGNARFWNPKNVPFPFDGDDDKAIVEHYIRDKYILGKFRYDEIKPEDFGSRMDDFDGESDRFDERNRSRSRSRSHSFYKGGHNRSDYGGSRDSFQSSGSRYSRQLAELKDMGFGDTNKNLDALSSAHGNINRAIDYLEKSSSSRNSVSAAATTSTPPLPRRRATTSGPQPAIFDGTNVITPDFTSNSASFVQAKPAVFDGTLQQYYDPATGMIYVDQQQYAMAMQQQQQQQQQLAVAQAQAQAQAQAQAQVQAQAQAQAQAQAQAQQIQMQQLQMQQQQQAPLSFQQMSQGGNLPQGYFYTQ

SEQ ID NO: 21916 - protein, 560 aa, Saccharomyces cerevisiae
MVLLKEPVQPLPRSSLLYNNASNSSSRIKETRKVKLLYNPLTKRQILNNFEILATLGNGQYGKVKLARDLGTGALVAIKILNRFEKRSGYSLQLKVENPRVNQEIEVMKRCHHENVVELYEILNDPESTKVYLVLEYCSRGPVKWCPENKMEIKAVGPSILTFQQSRKVVLDVVSGLEYLHSQGITHRDIKPSNLLISSNGTVKISDFGVAMSTATGSTNIQSSHEQLLKSRALGTPAFFAPELCSTEKEYSCSSAIDIWSLGVTIYCLLFGKLPFNANSGLELFDSIINKPLEFPSYEEMLNGATSGITMEEYTDAKDLLKKLLQKDPDKRIKLADIKVHPFMCHYGKSDAASVLTNLETFHELKVSPPSSCKRVELVSLPVNSSFASLDSVYMENFDHNNLRTGADRNSTYSPSIYDANTLSPSAYHNIGSRESSYSSFSSFTSSTAFASQISIQDAPAIGDQQCLIGESGSSLRVNSCEFPQYTTMSPVGEYPFESTEASLSSTLTPVGNVPQRIKAHLVEGKSNSKDDLRIEADASLVFEASDAQRTRRRMSLYKL

SEQ ID NO: 21917 - protein, 564 aa, Saccharomyces cerevisiae
MDIFRVLTRGASVKKESGPKAKAADYSVINGNDENHKEDNNESQIVKELDFFRNKRIISKVEDDREKTTENDSPNKEEKSGNDDGLIKPVITNTVEASALRKSYKGNVSGIDIPLPIGSFEDLISRFSFDKRLLNNLIENGFTEPTPIQCECIPVALNNRDVLACGPTGSGKTLAFLIPLVQQIIDDKQTAGLKGLIISPTKELANQIFIECFKLSYKIFLEKKRPLQVALLSKSLGAKLKNKVVSDKKYDIIISTPLRLIDVVKNEALDLSKVKHLIFDEADKLFDKTFVEQSDDILSACREPSLRKAMFSATIPSNVEEIAQSIMMDPVRVIIGHKEAANTNIEQKLIFCGNEEGKLIAIRQLVQEGEFKPPIIIFLESITRAKALYHELMYDRINVDVIHAERTALQRDRIIERFKTGELWCLICTDVLARGIDFKGVNLVINYDVPGSSQAYVHRIGRTGRGGRSGKAITFYTKQDSVAIKPIINVMKQSGCEVSEWMDKMAKMTRKEKESIKNGKAHKERKQITTVPKMDKAKRRRQQEMIAASKRRKNEELSKKHFSK

SEQ ID NO: 21918 - protein, 950 aa, Saccharomyces cerevisiae
MSDNPFNASLLDEDSNREREILDATAEALSKPSPSLEYCTLSVDEALEKLDTDKNGGLRSSNEANNRRSLYGPNEITVEDDESLFKKFLSNFIEDRMILLLIGSAVVSLFMGNIDDAVSITLAIFIVVTVGFVQEYRSEKSLEALNKLVPAECHLMRCGQESHVLASTLVPGDLVHFRIGDRIPADIRIIEAIDLSIDESNLTGENEPVHKTSQTIEKSSFNDQPNSIVPISERSCIAYMGTLVKEGHGKGIVVGTGTNTSFGAVFEMMNNIEKPKTPLQLTMDKLGKDLSLVSFIVIGMICLVGIIQGRSWLEMFQISVSLAVAAIPEGLPIIVTVTLALGVLRMAKRKAIVRRLPSVETLGSVNVICSDKTGTLTSNHMTVSKLWCLDSMSNKLNVLSLDKNKKTKNSNGNLKNYLTEDVRETLTIGNLCNNASFSQEHAIFLGNPTDVALLEQLANFEMPDIRNTVQKVQELPFNSKRKLMATKILNPVDNKCTVYVKGAFERILEYSTSYLKSKGKKTEKLTEAQKATINECANSMASEGLRVFGFAKLTLSDSSTPLTEDLIKDLTFTGLIGMNDPPRPNVKFAIEQLLQGGVHIIMITGDSENTAVNIAKQIGIPVIDPKLSVLSGDKLDEMSDDQLANVIDHVNIFARATPEHKLNIVRALRKRGDVVAMTGDGVNDAPALKLSDIGVSMGRIGTDVAKEASDMVLTDDDFSTILTAIEEGKGIFNNIQNFLTFQLSTSVAALSLVALSTAFKLPNPLNAMQILWINILMDGPPAQSLGVEPVDHEVMKKPPRKRTDKILTHDVMKRLLTTAACIIVGTVYIFVKEMAEDGKVTARDTTMTFTCFVFFDMFNALACRHNTKSIFEIGFFTNKMFNYAVGLSLLGQMCAIYIPFFQSIFKTEKLGISDILLLLLISSSVFIVDELRKLWTRKKNEEDSTYFSNV

SEQ ID NO: 21919 - protein, 512 aa, Saccharomyces cerevisiae
MSVNPEFIADGIDFYPTTPDAAYFNAADGKNKVNRINGNSENLHHSFASGCRRSSLSVDFNVTSSDSEKSEQSCLENNSQEDEYFCDIFSTELKLDETSNKSTDYSSSNHQYPEQLELHNYKLLNKIGEGAFSRVFKAVGINTDDQAPVAIKAIIKKGISSDAILKGNDRIQGSSRKKVLNEVAIHKLVSKNNPHCTKFIAFQESANYYYLVTELVTGGEIFDRIVQLTCFSEDLARHVITQVAIAIKHMHYMGIVHRDVKPENLLFEPIPFYGLDGDMQKEDEFTLGVGGGGIGLVKLMDFGLAKKLRNNTAKTPCGTIEYVASEVFTSKRYSMKVDMWSIGCVLFTLLCGYPPFYEKNEKTLLKKISRGDYEFLAPWWDNISSGAKNAVTHLLEVDPNKRYDIDDFLNDPWLNSYDCLKDSNSNSYASVQSILNDSFDERAETLHCALSCQSEKQDDTEFSRSESSEYIFMTEEDRNLRGSWIGEPKECFTLDLATSSIYRRRKNKIFFW

SEQ ID NO: 21920 - protein, 1083 aa, Saccharomyces cerevisiae
MSSEDIIYDPQFKPVQGIYENRLRQFIDTGGDYHDLNLPKFYDKKRISLDHDHVKVWWYQVSFERGSSPVSPDKRPSWKSIIERDKKGELEFREANINQPFGPSWSTTWFKVKISLPEDWVKSNEQLLFQWDCSNEGIVIDPKTLIPVTAFSGGERTEYVLPKTSDGKHFFYIEAGNNGMFGCGAGSTINPPDDNRFFHLRKADIVWPDLDARALYIDFWMLGDAARELPGDSWQKHQARQLGNAVMNLFDPNDRSSVRKCRELLQREYFDSFLESSKVYEQGESQVLTNVYGIGNCHIDTAWLWPFAETRRKIVRSWSSQCTLMDRFPEYKFVASQAQQFKWLLEDHPEFFNKVLIPKIQQSQFFAVGGTWVENDTNIPSGESLARQFFFGQRFFLKHFGLKSKIFWLPDTFGYSSQMPQLCRLSGIDKFLTQKLSWNNINSFPHSTFNWAGIDGSQLLTHMPPGNTYTADSHFGDVLRTAKQNKTPEYYGSGLMLYGKGDGGGGPTEEMLQKMRRIRSMNNRNGNVIPKLQVGITVDEFYDDILKRTNQGHDLPTWSGELYFEFHRGTYTSQAQTKKLMRLSEIKLHDLEWIAAKTSVLYPDSYKYPSKQINELWENVLLCQFHDVLPGSCIEMVYKYEAVPMLHNVVKECTSLIDKTVQFLQSQSKADLVEMRTLTWSKPEKVSEECSLNGSYTSSVTGYDDYIVLANGKLKVIICKKTGVITSITDETLGVEYLDTEHGRNKLGANQFVIYDDKPLGWQAWDTELYSVNQYKYVTKPKKVQVSCNTKEKCAVEVIFQISEKCKIKSVISLNATAVTDAKLSKVDISTTVENWDARNKFLKVEFPVNIRNDFASYETQFGITKRPTHYNTSWDVAKFEVCHHKFADYSEYSKGVSILNDCKYGFSTHGNLMRLSLLRSPKAPDAHADMGTHEIKYAIYPHRGALSSDTVKLAHEFNYCFKYKLPKDIGMNFDDIISISGDENVILSNIKRGEDDSAVKSNYSLNPRDEQSIVVRVYESLGGESFASLNTTLNLKRIEKVDNLEMKVYKSLTATRDESNHAINRIPIKLRPFEIASFRLYF

SEQ ID NO: 21921 - protein, 376 aa, Saccharomyces cerevisiae
MCQATNGPSRVVTKKHRKFFERHLQLLPSSHQGHDVNRMAIIFYSISGLSIFDVNVSAKYGDHLGWMRKHYIKTVLDDTENTVISGFVGSLVMNIPHATTINLPNTLFALLSMIMLRDYEYFETILDKRSLARFVSKCQRPDRGSFVSCLDYKTNCGSSVDSDDLRFCYIAVAILYICGCRSKEDFDEYIDTEKLLGYIMSQQCYNGAFGAHNEPHSGYTSCALSTLALLSSLEKLSDKFKEDTITWLLHRQVSSHGCMKFESELNASYDQSDDGGFQGRENKFADTCYAFWCLNSLHLLTKDWKMLCQTELVTNYLLDRTQKTLTGGFSKNDEEDADLYHSCLGSAALALIEGKFNGELCIPQEIFNDFSKRCCF

SEQ ID NO: 21922 - protein, 376 aa, Saccharomyces cerevisiae
MSTFGKLFRVTTYGESHCKSVGCIVDGVPPGMSLTEADIQPQLTRRRPGQSKLSTPRDEKDRVEIQSGTEFGKTLGTPIAMMIKNEDQRPHDYSDMDKFPRPSHADFTYSEKYGIKASSGGGRASARETIGRVASGAIAEKFLAQNSNVEIVAFVTQIGEIKMNRDSFDPEFQHLLNTITREKVDSMGPIRCPDASVAGLMVKEIEKYRGNKDSIGGVVTCVVRNLPTGLGEPCFDKLEAMLAHAMLSIPASKGFEIGSGFQGVSVPGSKHNDPFYFEKETNRLRTKTNNSGGVQGGISNGENIYFSVPFKSVATISQEQKTATYDGEEGILAAKGRHDPAVTPRAIPIVEAMTALVLADALLIQKARDFSRSVVH

SEQ ID NO: 21923 - protein, 802 aa, Saccharomyces cerevisiae
MRFLQVYKSSALIGLIILLASKVNLAEAKRKLVATSLVTCMENSQLSANSFDVVFNPDDRSLHYDLDMSTQIDSYIFADIDVYAYGFKIITKNVDLCSINWKQFCPVHPGNIQIDSIEYISSEYVNEIPGIAYQVPDIDAYARVKITNNVSEYLACIQIYFSNGKTVSQIGVKWATAVVAGIGLLLSAILSTFGNSTAASHISANTMSLFLYFQSVVVVAMQHVHRVPPIAAAWAENLVWSMGLIRISFMQRIFRWYVQSTGGTPSLYLTSTSMSVLAQRSWQYLMELPLIKRATNVLYGNANTLIFRGIKRLGYKMGIENTSIVCTGFTFFVLCGYVLAGFIIVFKCCVELATRLGWIQKARFWEFRKQWRMILKGALLRYIYIGFVQLTILSFWEFTERDSPAVIVIACLFILLSCGLMLWAAWRTVFFARRSVALYNNPAALLYGDEYVLHKYGFFYTMFNANHYWWNIVLLSYIFVKSLLVGFAQASGQTQVLFMFILDLFYFVAIIYYKPYLDRPTNIMNILIATVTVVNSFLFMFFSDLFNQSYKVAAIMGWIFFIMNAAFSFILLMMILAFAGMMLFSKNPDLRFKPAKDDRTSFQRNTMKPEGTVNRSVANELLALGNVAKDHDDNSDYESNDTGVNDELKQAQDETTPTTVTSSDDNKPTFSEKILSKFSRPKNENASTDALRVEAPKQQTFPHNLTNLSRENLSTLGSKPYPGHTRSQSDAHNGLINSFEEEDTSSNTDPFHDSTEGDLLDTSSSDGGFRSQNYVRDDSINSLGNNKQPLRKPPGFFDEGFM

SEQ ID NO: 21924 - protein, 433 aa, Saccharomyces cerevisiae
MDMTKNHTTDTEEFDDGDIRPVSLGIVDDYNASFELPLKPKFLQSENFSDLTSEWDQSRSNTPGLAEGKTEKAQPCGTTDSSKNRIHVEQLLESANEMNNYLAQNIENINNFQVGLLNGGKGLYSSMGDDSSACINGTNFSSTSNFELSDDELEDTTGCTSSIFDKDLFHQQNGLSIPRRRSPLFKSPTASFEIGDATDVEEQDIDDSIFSECSSITSFDMGGLHISLPHDEEEDQEKTKSESENPLLHGIPVDVEVPHISVDEALANFKETIELLLKLSGNRKCTGFNTRVEKKEYSNFYMKSKPTLSSADFLKRIQDKCEYQPTVYLVATFLIDTLFLTRDGNNILQLKLNLQEKEVHRMIIAAVRLSTKLLEDFVHSHEYFSKVCGISKRLLTKLEVSLLICVCNTKLMVSNRKLAASKLLLNELRSFCV

SEQ ID NO: 21925 - protein, 599 aa, Saccharomyces cerevisiae
MKITEKLEQHRQTSGKPTYSFEYFVPKTTQGVQNLYDRMDRMYEASLPQFIDITWNAGGGRLSHLSTDLVATAQSVLGLETCMHLTCTNMPISMIDDALENAYHSGCQNILALRGDPPRDAENWTPVEGGFQYAKDLIKYIKSKYGDHFAIGVAGYPECHPELPNKDVKLDLEYLSRRSTGGDFIITQMFYDVDNLLNWCSQVRAAGMDVPIIPGIMPITTYAAFLRRIQWGQISIPQHFSSRLDPIKDDDELVRDIGTNLIVEMCQKLLDSGYVSHLHIYTMNLEKAPLMILERLNILPTESEFNAHPLAVLPWRKSLNPKRKNEEVRPIFWKRRPYSYVARTSQWAVDEFPNGRFGDSSSPAFGDLDLCGSDLIRQSANKCLELWSTPTSINDVAFLVINYLNGNLKCLPWSDIPINDEINPIKAHLIELNQHSIITINSQPQVNGIRSNDKIHGWGPKDGYVYQKQYLEFMLPKTKLPKLIDTLKNNEFLTYFAIDSQGDLLSNHPDNSKSNAVTWGIFPGREILQPTIVEKISFLAWKEEFYHILNEWKLNMNKYDKPHSAQFIQSLIDDYCLVNIVDNDYISPDDQIHSILLSL

SEQ ID NO: 21926 - protein, 767 aa, Saccharomyces cerevisiae
MGSKRRFSSEHPDPVETSIPEQAAEIAEELSKQHPLPSEEPLVHHDAGEFKGLQRHHTSAEEAQKLEDGKINPFTGREFTPKYVDILKIRRELPVHAQRDEFLKLYQNNQIMVFVGETGSGKTTQIPQFVLFDEMPHLENTQVACTQPRRVAAMSVAQRVAEEMDVKLGEEVGYSIRFENKTSNKTILKYMTDGMLLREAMEDHDLSRYSCIILDEAHERTLATDILMGLLKQVVKRRPDLKIIIMSATLDAEKFQRYFNDAPLLAVPGRTYPVELYYTPEFQRDYLDSAIRTVLQIHATEEAGDILLFLTGEDEIEDAVRKISLEGDQLVREEGCGPLSVYPLYGSLPPHQQQRIFEPAPESHNGRPGRKVVISTNIAETSLTIDGIVYVVDPGFSKQKVYNPRIRVESLLVSPISKASAQQRAGRAGRTRPGKCFRLYTEEAFQKELIEQSYPEILRSNLSSTVLELKKLGIDDLVHFDFMDPPAPETMMRALEELNYLACLDDEGNLTPLGRLASQFPLDPMLAVMLIGSFEFQCSQEILTIVAMLSVPNVFIRPTKDKKRADDAKNIFAHPDGDHITLLNVYHAFKSDEAYEYGIHKWCRDHYLNYRSLSAADNIRSQLERLMNRYNLELNTTDYESPKYFDNIRKALASGFFMQVAKKRSGAKGYITVKDNQDVLIHPSTVLGHDAEWVIYNEFVLTSKNYIRTVTSVRPEWLIEIAPAYYDLSNFQKGDVKLSLERIKEKVDRLNELKQGKNKKKSKHSKK

SEQ ID NO: 21927 - protein, 610 aa, Saccharomyces cerevisiae
MPESSRDKGNAAISGNRSVLSIASPTKLNILSSDWSRNQGKVSKNSLKRSSSLNIRNSKRPSLQASANSIYSRPKITIGAPPLIRRDSSFFKDEFDAKKDKATFSAYSSRSYPTIGSESVVSQTSLSQPTTSREVDEQFTVAADRYIPILQGASQNKVDPETLHEALPPPNASPISHLRAQTKIVFKQNVAEACGLDMNKRILQYMPEPPKCSSLRQKSYIMKKRTHYSYQQEQKIPDLIKLRKINTNPERILDAPGFQDDFYLNLLSWSKKNVLAIALDTALYLWNATTGDVSLLTDFENTTICSVTWSDDDCHISIGKEDGNTEIWDVETMSLIRTMRSGLGVRIGSLSWLDTLIATGSRSGEIQINDVRIKQHIVSTWAEHTGEVCGLSYKSDGLQLASGGNDNTVMIWDTRTSLPQFSKKTHTAAVKALSWCPYSPNILASGGGQTDKHIHFWNSITGARVGSINTGSQVSSLHWGQSHTSTNGGMMNKEIVATGGNPENAISVYNYETKFKVAEVVHAHEARICCSQLSPDGTTLATVGGDENLKFYKIFDPRCTGRSREDGLMDGMLGLIGKEGCRTNDKENRSKNSSEIHTRRPSSTSQYLIR

SEQ ID NO: 21928 - protein, 516 aa, Saccharomyces cerevisiae
MSTQQQSYTIWSPQDTVKDVAESLGLENINDDVLKALAMDVEYRILEIIEQAVKFKRHSKRDVLTTDDVSKALRVLNVEPLYGYYDGSEVNKAVSFSKVNTSGGQSVYYLDEEEVDFDRLINEPLPQVPRLPTFTTHWLAVEGVQPAIIQNPNLNDIRVSQPPFIRGAIVTALNDNSLQTPVTSTTASASVTDTGASQHLSNVKPGQNTEVKPLVKHVLSKELQIYFNKVISTLTAKSQADEAAQHMKQAALTSLRTDSGLHQLVPYFIQFIAEQITQNLSDLQLLTTILEMIYSLLSNTSIFLDPYIHSLMPSILTLLLAKKLGGSPKDDSPQEIHEFLERTNALRDFAASLLDYVLKKFPQAYKSLKPRVTRTLLKTFLDINRVFGTYYGCLKGVSVLEGESIRFFLGNLNNWARLVFNESGITLDNIEEHLNDDSNPTRTKFTKEETQILVDTVISALLVLKKDLPDLYEGKGEKVTDEDKEKLLERCGVTIGFHILKRDDAKELISAIFFGE

SEQ ID NO: 21929 - protein, 149 aa, Saccharomyces cerevisiae
MSATRANKDIFTLFDKKGQGAIAKDSLGDYLRAIGYNPTNQLVQDIINADSSLRDASSLTLDQITGLIEVNEKELDATTKAKTEDFVKAFQVFDKESTGKVSVGDLRYMLTGLGEKLTDAEVDELLKGVEVDSNGEIDYKKFIEDVLRQ

SEQ ID NO: 21930 - protein, 486 aa, Saccharomyces cerevisiae
MNRILSSASLLSNVSMPRQNKHKITKALCYAIIVASIGSIQFGYHLSELNAPQQVLSCSEFDIPMEGYPYDRTWLGKRGYKQCIPLNDEQIGIVTSVFCIGGILGSYFATSLANIYGRKFSSLINCTLNIVGSLIIFNSNSYRGLIIGRILVGISCGSLIVIIPLFIKEVAPSGWEGLLGSMTQICIRLGVLLTQGIALPLTDSYRWRWILFGSFLIAVLNFFMWFIVDESPKWLLAHGRVTDAKLSLCKLRGVTFDEAAQEIQDWQLQIESGDPLIEPTTTNSISGSNSLWKYLRDRTNVKSRHVITVLLFGQQFCGINSIVLYGTKIISQLYPQHAIRINFFISMVNVLVTILVSLLIHSLPRKPLLMTSTVLVSVTAFIMGIAMNHNKMNLLIVFSFIYMGVFTMGLNPLPFIIMREVSKPQDMVLAQRYGTICNWVGTFIIAYTFPIIHDVLSGYVFIIFAIIACSISAFIWKKVPETKRSG

SEQ ID NO: 21931 - protein, 482 aa, Saccharomyces cerevisiae
MVKRTVATNGDASGAHRAKKMSKTHASHIINAQEDYKHMYLSVQPLDIFCWGTGSMCELGLGPLAKNKEVKRPRLNPFLPRDEAKIISFAVGGMHTLALDEESNVWSWGCNDVGALGRDTSNAKEQLKDMDADDSSDDEDGDLNELESTPAKIPRESFPPLAEGHKVVQLAATDNMSCALFSNGEVYAWGTFRCNEGILGFYQDKIKIQKTPWKVPTFSKYNIVQLAPGKDHILFLDEEGMVFAWGNGQQNQLGRKVMERFRLKTLDPRPFGLRHVKYIASGENHCFALTKDNKLVSWGLNQFGQCGVSEDVEDGALVTKPKRLALPDNVVIRSIAAGEHHSLILSQDGDLYSCGRLDMFEVGIPKDNLPEYTYKDVHGKARAVPLPTKLNNVPKFKSVAAGSHHSVAVAQNGIAYSWGFGETYAVGLGPFEDDTEVPTRIKNTATQDHNIILVGCGGQFSVSGGVKLSDEDAEKRADEMDD

SEQ ID NO: 21932 - protein, 137 aa, Saccharomyces cerevisiae
MSKVPRNFRLLEELEKGEKGFGPESCSYGLADSDDITMTKWNGTILGPPHSNHENRIYSLSIDCGPNYPDSPPKVTFISKINLPCVNPTTGEVQTDFHTLRDWKRAYTMETLLLDLRKEMATPANKKLRQPKEGETF

SEQ ID NO: 21933 - protein, 749 aa, Saccharomyces cerevisiae
MDVRAALQCFFSALSGRFTGKKLGLEIYSIQYKMSNSGGSSPFLESPGGSPDVGSTNGQSNRQIQALQFKLNTLQNEYEIEKLQLQKQTNILEKKYKATIDELEKALNDTKYLYESNDKLEQELKSLKERSANSMNDKDKCIEELRTTLQNKDLEMETLRQQYDSKLSKVTNQCDHFKLEAESSHSLLMKYEKEIKRQSVDIKDLQHQVMEKDDELSSVKASKMINSHPNYSTEEFNELTEMNKMIQDQVQYTKELELANMQQANELKKLKQSQDTSTFWKLENEKLQNKLSQLHVLESQYENLQLENIDLKSKLTKWEIYNDSDDDDDNNVNNNDNNNNNKNDNNNDNNNDTSNNNNINNNNRTKNNIRNNPEEIIRDWKLTKKECLILTDMNDKLRLDNNNLKLLNDEMALERNQILDLNKNYENNIVNLKRLNHELEQQKSLSFEECRLLREQLDGLYSAQNNALLEVENSETHASNKNVNEDMNNLIDTYKNKTEDLTNELKKLNDQLLSNSNDVETQRKKRKLTSDQIGLNYSQRLNELQLENVSVSRELSKAQTTIQLLQEKLEKLTKLKEKKIRILQLRDGPFIKDQFIKKNKLLLLEKENADLLNELKKNNPAVETVPISVYDSLNFELKQFEQEVFKSNKRFSRLKQVFNNKSLEFIDVVNSLLGFKLEFQQDSRVKIFSCFKPEKYLIADLNENTLKSNLDADIEGWDDLMNLWVEDRGQLPCFLATITLRLWEQRQAK

SEQ ID NO: 21934 - protein, 523 aa, Saccharomyces cerevisiae
MTKEEIADKKRKVVDEEVIEKKKSKKHKKDKKDKKEKKDKKHKKHKKEKKGEKEVEVPEKESEKKPEPTSAVASEFYVQSEALTSLPQSDIDEYFKENEIAVEDSLDLALRPLLSFDYLSLDSSIQAEISKFPKPTPIQAVAWPYLLSGKDVVGVAETGSGKTFAFGVPAISHLMNDQKKRGIQVLVISPTRELASQIYDNLIVLTDKVGMQCCCVYGGVPKDEQRIQLKKSQVVVATPGRLLDLLQEGSVDLSQVNYLVLDEADRMLEKGFEEDIKNIIRETDASKRQTLMFTATWPKEVRELASTFMNNPIKVSIGNTDQLTANKRITQIVEVVDPRGKERKLLELLKKYHSGPKKNEKVLIFALYKKEAARVERNLKYNGYNVAAIHGDLSQQQRTQALNEFKSGKSNLLLATDVAARGLDIPNVKTVINLTFPLTVEDYVHRIGRTGRAGQTGTAHTLFTEQEKHLAGGLVNVLNGANQPVPEDLIKFGTHTKKKEHSAYGSFFKDVDLTKKPKKITFD

SEQ ID NO: 21935 - protein, 387 aa, Saccharomyces cerevisiae
MSNGAFDAIFEYAWGQIDKPISGDFIYGKDLPKLIEIIENIFQKAQKSGSYELRLPLFSEINKDLFRTFSNTKTFFKIHKEEFDDIFFNLVNHPLREILENAFIGVDSIPSDFIVSMNLNSPSKFLVENKNKNTEGAGISTPRKKLTESPIKLLSRNNIGKALEVQVEELKRELTAKQSLLQENERQVSELKIRLETYQEKYASIQQRFSDLQKARQVEDNQNSSRTSDPGSPLVTGIDQKAILEEFRRRLQRQTDTISFLKDQIRRERGLNCSNDKVSHSKRKHATTDGDGTFKNFISAVPSNIWVKATIRIIVCFALLAGVLPYIRKYVYAHDTPSQNSRLQLSWWENSGILSKIVWFFEDQTDLETEYRSNANVDDAYSRVFGI

SEQ ID NO: 21936 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDEEEEETDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 21937 - protein, 122 aa, Saccharomyces cerevisiae
MTTFRFCRDCNNMLYPREDKENNRLLFECRTCSYVEEAGSPLVYRHELITNIGETAGVVQDIGSDPTLPRSDRECPKCHSRENVFFQSQQRRKDTSMVLFFVCLSCSHIFTSDQKNKRTQFS

SEQ ID NO: 21938 - protein, 561 aa, Saccharomyces cerevisiae
MSLFFKPVISPQWSFPVLLKIGVRSYAGGPRTKHKGNSPLASVPTGSSNKNRKQKAKGKKGNKKNDPDQAFNFGEYGGLKKDVEMNMDSTNKLIQKISNFDQLLILPPVRDAVKEIISKESLKLQDSRKKTSENIIPSPIQTVAIKRISKNLMDPKLQIHAIAAETGSGKTMAYLIPLIDYLKRQELETPELWETLRKNVLIRSIILVPTHELVDQVYETVSKTKTLLGLNSFKWDKATSYRDLLENIKNRIDILVTTPGKLLNLFSIRMITRPDKVLSKVGFVVLDEADTLLDRSWLEETHSAIKRIPNINHLIFCSATIPQEFNKTMQRLFPTVVPIMTPRLHKLPFALDFKVINSALSPFKGSKIKALAQTLYAISNDDTEPGFEKRCIIFVNEKKNVPEIVNLLNKKFGHNAIGLTGEDTFEERSEKIMPFLSPPRPLSEVVAQSTSPPTSLKKFEIPDSNIVIGKLKNTNSNGTAPSNKSLHVLVTTDLMARGLNFKGVRNVVLYDVPKTSIDLIHRVGRTARMKQGGRVFMLTDSKTKSWAKALPKIIKKHQRLS

SEQ ID NO: 21939 - protein, 1178 aa, Saccharomyces cerevisiae
MSQRKFAGLRDNFNLLGEKNKILVANRGEIPIRIFRTAHELSMQTVAIYSHEDRLSTHKQKADEAYVIGEVGQYTPVGAYLAIDEIISIAQKHQVDFIHPGYGFLSENSEFADKVVKAGITWIGPPAEVIDSVGDKVSARNLAAKANVPTVPGTPGPIETVEEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKECGYRNAGTAEFLVDNQNRHYFIEINPRIQVEHTITEEITGIDIVAAQIQIAAGASLPQLGLFQDKITTRGFAIQCRITTEDPAKNFQPDTGRIEVYRSAGGNGVRLDGGNAYAGTIISPHYDSMLVKCSCSGSTYEIVRRKMIRALIEFRIRGVKTNIPFLLTLLTNPVFIEGTYWTTFIDDTPQLFQMVSSQNRAQKLLHYLADVAVNGSSIKGQIGLPKLKSNPSVPHLHDAQGNVINVTKSAPPSGWRQVLLEKGPAEFARQVRQFNGTLLMDTTWRDAHQSLLATRVRTHDLATIAPTTAHALAGRFALECWGGATFDVAMRFLHEDPWERLRKLRSLVPNIPFQMLLRGANGVAYSSLPDNAIDHFVKQAKDNGVDIFRVFDALNDLEQLKVGVDAVKKAGGVVEATVCFSGDMLQPGKKYNLDYYLEIAEKIVQMGTHILGIKDMAGTMKPAAAKLLIGSLRAKYPDLPIHVHTHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDVRRLANSLDFPDSVMDFFEGLIGQPYGGFPEPFRSDVLRNKRRKLTCRPGLELEPFDLEKIREDLQNRFGDVDECDVASYNMYPRVYEDFQKMRETYGDLSVLPTRSFLSPLETDEEIEVVIEQGKTLIIKLQAVGDLNKKTGEREVYFDLNGEMRKIRVADRSQKVETVTKSKADMHDPLHIGAPMAGVIVEVKVHKGSLIKKGQPVAVLSAMKMEMIISSPSDGQVKEVFVSDGENVDSSDLLVLLEDQVPVETKA

SEQ ID NO: 21940 - protein, 172 aa, Saccharomyces cerevisiae
MSTPARRRLMRDFKRMKEDAPPGVSASPLPDNVMVWNAMIIGPADTPYEDGTFRLLLEFDEEYPNKPPHVKFLSEMFHPNVYANGEICLDILQNRWTPTYDVASILTSIQSLFNDPNPASPANVEAATLFKDHKSQYVKRVKETVEKSWEDDMDDMDDDDDDDDDDDDDEAD

SEQ ID NO: 21941 - protein, 510 aa, Saccharomyces cerevisiae
MPTSGTTIELIDDQFPKDDSASSGIVDEVDLTEANILATGLNKKAPRIVNGFGSLMGSKEMVSVEFDKKGNEKKSNLDRLLEKDNQEKEEAKTKIHISEQPWTLNNWHQHLNWLNMVLVCGMPMIGWYFALSGKVPLHLNVFLFSVFYYAVGGVSITAGYHRLWSHRSYSAHWPLRLFYAIFGCASVEGSAKWWGHSHRIHHRYTDTLRDPYDARRGLWYSHMGWMLLKPNPKYKARADITDMTDDWTIRFQHRHYILLMLLTAFVIPTLICGYFFNDYMGGLIYAGFIRVFVIQQATFCINSLAHYIGTQPFDDRRTPRDNWITAIVTFGEGYHNFHHEFPTDYRNAIKWYQYDPTKVIIYLTSLVGLAYDLKKFSQNAIEEALIQQEQKKINKKKAKINWGPVLTDLPMWDKQTFLAKSKENKGLVIISGIVHDVSGYISEHPGGETLIKTALGKDATKAFSGGVYRHSNAAQNVLADMRVAVIKESKNSAIRMASKRGEIYETGKFF

SEQ ID NO: 21942 - protein, 138 aa, Saccharomyces cerevisiae
MGAWLFILAVVVNCINLFGQVHFTILYADLEADYINPIELCSKVNKLITPEAALHGALSLLFLLNGYWFVFLLNLPVLAYNLNKIYNKVQLLDATEIFRTLGKHKRESFLKLGFHLLMFFFYLYRMIMALIAESGDDF

SEQ ID NO: 21943 - protein, 405 aa, Saccharomyces cerevisiae
MTAAVTSSNIVLETHESGIKPYFEQKIQETELKIRSKTENVRRLEAQRNALNDKVRFIKDELRLLQEPGSYVGEVIKIVSDKKVLVKVQPEGKYIVDVAKDINVKDLKASQRVCLRSDSYMLHKVLENKADPLVSLMMVEKVPDSTYDMVGGLTKQIKEIKEVIELPVKHPELFESLGIAQPKGVILYGPPGTGKTLLARAVAHHTDCKFIRVSGAELVQKYIGEGSRMVRELFVMAREHAPSIIFMDEIDSIGSTRVEGSGGGDSEVQRTMLELLNQLDGFETSKNIKIIMATNRLDILDPALLRPGRIDRKIEFPPPSVAARAEILRIHSRKMNLTRGINLRKVAEKMNGCSGADVKGVCTEAGMYALRERRIHVTQEDFELAVGKVMNKNQETAISVAKLFK

SEQ ID NO: 21944 - protein, 309 aa, Saccharomyces cerevisiae
MDSKEVLVHVKNLEKNKSNDAAVLEILHVLDKEFVPTEKLLRETKVGVEVNKFKKSTNVEISKLVKKMISSWKDAINKNKRSRQAQQHHQDHAPGNAEDKTTVGESVNGVQQPASSQSDAMKQDKYVSTKPRNSKNDGVDTAIYHHKLRDQVLKALYDVLAKESEHPPQSILHTAKAIESEMNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 21945 - protein, 342 aa, Saccharomyces cerevisiae
MHTAEFLETEPTEISSVLAGGYNHPLLRQWQSERQLTKNMLIFPLFISDNPDDFTEIDSLPNINRIGVNRLKDYLKPLVAKGLRSVILFGVPLIPGTKDPVGTAADDPAGPVIQGIKFIREYFPELYIICDVCLCEYTSHGHCGVLYDDGTINRERSVSRLAAVAVNYAKAGAHCVAPSDMIDGRIRDIKRGLINANLAHKTFVLSYAAKFSGNLYGPFRDAACSAPSNGDRKCYQLPPAGRGLARRALERDMSEGADGIIVKPSTFYLDIMRDASEICKDLPICAYHVSGEYAMLHAAAEKGVVDLKTIAFESHQGFLRAGARLIITYLAPEFLDWLDEEN

SEQ ID NO: 21946 - protein, 480 aa, Saccharomyces cerevisiae
MSRKLSHLIATRKSKTIVVTVLLIYSLLTFHLSNKRLLSQFYPSKDDFKQTLLPTTSHSQDINLKKQITVNKKKNQLHNLRDQLSFAFPYDSQAPIPQRVWQTWKVGADDKNFPSSFRTYQKTWSGSYSPDYQYSLISDDSIIPFLENLYAPVPIVIQAFKLMPGNILKADFLRYLLLFARGGIYSDMDTMLLKPIDSWPSQNKSWLNNIIDLNKPIPYKNSKPSLLSSDEISHQPGLVIGIEADPDRDDWSEWYARRIQFCQWTIQAKPGHPILRELILNITATTLASVQNPGVPVSEMIDPRFEEDYNVNYRHKRRHDETYKHSELKNNKNVDGSDIMNWTGPGIFSDIIFEYMNNVLRYNSDILLINPNLNKNDEEGSESATTPAKDVDNDTLSKSTRKFYKKISESLQSSNSMPWEFFSFLKEPVIVDDVMVLPITSFSPDVGQMGAQSSDDKMAFVKHMFSGSWKEDADKNAGHK

SEQ ID NO: 21947 - protein, 504 aa, Saccharomyces cerevisiae
MQSPYPMTQVSNVDDGSLLKESKSKSKVAAKSEAPRPHACPICHRAFHRLEHQTRHMRIHTGEKPHACDFPGCVKRFSRSDELTRHRRIHTNSHPRGKRGRKKKVVGSPINSASSSATSIPDLNTANFSPPLPQQHLSPLIPIAIAPKENSSRSSTRKGRKTKFEIGESGGNDPYMVSSPKTMAKIPVSVKPPPSLALNNMNYQTSSASTALSSLSNSHSGSRLKLNALSSLQMMTPIASSAPRTVFIDGPEQKQLQQQQNSLSPRYSNTVILPRPRSLTDFQGLNNANPNNNGSLRAQTQSSVQLKRPSSVLSLNDLLVGQRNTNESDSDFTTGGEDEEDGLKDPSNSSIDNLEQDYLQEQSRKKSKTSTPTTMLSRSTSGTNLHTLGYVMNQNHLHFSSSSPDFQKELNNRLLNVQQQQQEQHTLLQSQNTSNQSQNQNQNQMMASSSSLSTTPLLLSPRVNMINTAISTQQTPISQSDSQVQELETLPPIRSLPLPFPHMD

SEQ ID NO: 21948 - protein, 87 aa, Saccharomyces cerevisiae
MQLLRCFSIFSVIASVLAQELTTICEQIPSPTLESTPYSLSTTTILANGKAMQGVFEYYKSVTFVSNCGSHPSTTSKGSPINTQYVF

SEQ ID NO: 21949 - protein, 278 aa, Saccharomyces cerevisiae
MSQEFVEDYSRTGSSDDEDSGAYDEWIPSFCSRFGHEYFCQVPTEFIEDDFNMTSLSQEVPHYRKALDLILDLEAMSDEEEDEDDVVEEDEVDQEMQSNDGHDEGKRRNKSPVVNKSIIEHAAEQLYGLIHARFILTKPGLQAMAEKFDHKEFGTCPRYYCNGMQLLPCGLSDTVGKHTVRLYCPSCQDLYLPQSSRFLCLEGAFWGTSFPGVFLKHFKELEEYVERKSKESYELKVFGFRINDEAVSGPRMKWLRQYPSTEEDWEEFAKCEFETPAV

SEQ ID NO: 21950 - protein, 473 aa, Saccharomyces cerevisiae
MAKDNSEKLQVQGEEKKSKQPVNFLPQGKWLKPNEIEYEFGGTTGVIGMLIGFPLLMYYMWICAEFYHGKVALPKAGESWMHFIKHLYQLVLENGIPEKYDWTIFLTFWVFQIIFYYTLPGIWTKGQPLSHLKGKQLPYFCNAMWTLYVTTTLVLVLHFTNLFRLYVIIDRFGRIMTCAIISGFAFSIILYLWTLFISHDYHRMTGNHLYDFFMGAPLNPRWGILDLKMFFEVRLPWFTLYFITLGACLKQWETYGYVTPQLGVVMLAHWLYANACAKGEELIVPTWDMAYEKFGFMLIFWNIAGVPYTYCHCTLYLYYHDPSEYHWSTLYNVSLYVVLLCAYYFFDTANAQKNAFRKQMSGDKTGRKTFPFLPYQILKNPKYMVTSNGSYLLIDGWYTLARKIHYTADWTQSLVWALSCGFNSVFPWFFPVFFLVVLIHRAFRDQAKCKRKYGKDWDEYCKHCPYVFIPYVF

SEQ ID NO: 21951 - protein, 252 aa, Saccharomyces cerevisiae
MSGAAAASAAGYDRHITIFSPEGRLYQVEYAFKATNQTNINSLAVRGKDCTVVISQKKVPDKLLDPTTVSYIFCISRTIGMVVNGPIPDARNAALRAKAEAAEFRYKYGYDMPCDVLAKRMANLSQIYTQRAYMRPLGVILTFVSVDEELGPSIYKTDPAGYYVGYKATATGPKQQEITTNLENHFKKSKIDHINEESWEKVVEFAITHMIDALGTEFSKNDLEVGVATKDKFFTLSAENIEERLVAIAEQD

SEQ ID NO: 21952 - protein, 779 aa, Saccharomyces cerevisiae
MVYTPSKGPRTLYDKVFDAHVVHQDENGSFLLYIDRHLVHEVTSPQAFEGLENAGRKVRRVDCTLATVDHNIPTESRKNFKSLDTFIKQTDSRLQVKTLENNVKQFGVPYFGMSDARQGIVHTIGPEEGFTLPGTTVVCGDSHTSTHGAFGSLAFGIGTSEVEHVLATQTIIQAKSKNMRITVNGKLSPGITSKDLILYIIGLIGTAGGTGCVIEFAGEAIEALSMEARMSMCNMAIEAGARAGMIKPDETTFQYTKGRPLAPKGAEWEKAVAYWKTLKTDEGAKFDHEINIEAVDVIPTITWGTSPQDALPITGSVPDPKNVTDPIKKSGMERALAYMGLEPNTPLKSIKVDKVFIGSCTNGRIEDLRSAAAVVRGQKLASNIKLAMVVPGSGLVKKQAEAEGLDKIFQEAGFEWREAGCSICLGMNPDILDAYERCASTSNRNFEGRQGALSRTHLMSPAMAAAAGIAGHFVDIREFEYKDQDQSSPKVEVTSEDEKELESAAYDHAEPVQPEDAPQDIANDELKDIPVKSDDTPAKPSSSGMKPFLTLEGISAPLDKANVDTDAIIPKQFLKTIKRTGLKKGLFYEWRFRKDDQGKDQETDFVLNVEPWREAEILVVTGDNFGCGSSREHAPWALKDFGIKSIIAPSYGDIFYNNSFKNGLLPIRLDQQIIIDKLIPIANKGGKLCVDLPNQKILDSDGNVLVDHFEIEPFRKHCLVNGLDDIGITLQKEEYISRYEALRREKYSFLEGGSKLLKFDNVPKRKAVTTTFDKVHQDW

SEQ ID NO: 21953 - protein, 918 aa, Saccharomyces cerevisiae [sequence omitted]

SEQ ID NO: 21954 - protein, 1173 aa, Saccharomyces cerevisiae
MSRQDENSALLANNENNKPSYTGNENGVYDNFKLSKSQLSDLHNPKSIRSFVRLFGYESNSLFKYLKTDKNAGISLPEISNYRKTNRYKNYGDNSLPERIPKSFLQLVWAAFNDKTMQLLTVAAVVSFVLGLYELWMQPPQYDPEGNKIKQVDWIEGVAIMIAVFVVVLVSAANDYQKELQFAKLNKKKENRKIIVIRNDQEILISIHHVLVGDVISLQTGDVVPADCVMISGKCEADESSITGESNTIQKFPVDNSLRDFKKFNSIDSHNHSKPLDIGDVNEDGNKIADCMLISGSRILSGLGRGVITSVGINSVYGQTMTSLNAEPESTPLQLHLSQLADNISVYGCVSAIILFLVLFTRYLFYIIPEDGRFHDLDPAQKGSKFMNIFITSITVIVVAVPEGLPLAVTLALAFATTRMTKDGNLVRVLRSCETMGSATAVCSDKTGTLTENVMTVVRGFPGNSKFDDSKSLPVSEQRKLNSKKVFEENCSSSLRNDLLANIVLNSTAFENRDYKKNDKNTNGSKNMSKNLSFLDKCKSRLSFFKKGNREDDEDQLFKNVNKGRQEPFIGSKTETALLSLARLSLGLQPGELQYLRDQPMEKFNIEKVVQTIPFESSRKWAGLVVKYKEGKNKKPFYRFFIKGAAEIVSKNCSYKRNSDDTLEEINEDNKKETDDEIKNLASDALRAISVAHKDFCECDSWPPEQLRDKDSPNIAALDLLFNSQKGLILDGLLGIQDPLRAGVRESVQQCQRAGVTVRMVTGDNILTAKAIARNCAILSTDISSEAYSAMEGTEFRKLTKNERIRILPNLRVLARSSPEDKRLLVETLKGMGDVVAVTGDGTNDAPALKLADVGFSMGISGTEVAREASDIILMTDDFSAIVNAIKWGRCVSVSIKKFIQFQLIVNITAVILTFVSSVASSDETSVLTAVQLLWINLIMDTLAALALATDKPDPNIMDRKPRGRSTSLISVSTWKMILSQATLQLIVTFILHFYGPELFFKKHEDEITSHQQQQLNAMTFNTFVWLQFFTMLVSRKLDEGDGISNWRGRISAANLNFFQDLGRNYYFLTIMAIIGSCQVLIMFFGGAPFSIARQTKSMWITAVLCGMLSLIMGVLVRICPDEVAVKVFPAAFVQRFKYVFGLEFLRKNHTGKHDDEEALLEESDSPESTAFY

SEQ ID NO: 21955 - protein, 566 aa, Saccharomyces cerevisiae
MSTNLNPFMNNTPSSSPLKGSESKRVSKRPISSSSSASLLSSPSRRSRPSTVYGDRYIPSRTDIDFNSIVSISSMASVPALNPSSTEDQVEYQKERQAHETYNTLLKNELFGEMLSKDTVGSESSIDRIKNTRPSTRGNVHAENTTRHGYELERVSTPPPEAAGLEEFSPHSTPVTPRRLFTSQQDEITRPSSNSVRGASLLTYQQRKGRRLSAASLLQSQFFDSMSPVRPDSKQLLLSPGKQFRQIAKVPYRVLDAPSLADDFYYSLIDWSSTDVLAVALGKSIFLTDNNTGDVVHLCDTENEYTSLSWIGAGSHLAVGQANGLVEIYDVMKRKCIRTLSGHIDRVACLSWNNHVLTSGSRDHRILHRDVRMPDPFFETIESHTQEVCGLKWNVADNKLASGGNDNVVHVYEGTSKSPILTFDEHKAAVKAMAWSPHKRGVLATGGGTADRRLKIWNVNTSIKMSDIDSGSQICNMVWSKNTNELVTSHGYSKYNLTLWDCNSMDPIAILKGHSFRVLHLTLSNDGTTVVSGAGDETLRYWKLFDKPKAKVQPNSLIFDAFNQIR

SEQ ID NO: 21956 - protein, 349 aa, Saccharomyces cerevisiae
MSKIDSVLIIGGSGFLGLHLIQQFFDINPKPDIHIFDVRDLPEKLSKQFTFNVDDIKFHKGDLTSPDDMENAINESKANVVVHCASPMHGQNPDIYDIVNVKGTRNVIDMCKKCGVNILVYTSSAGVIFNGQDVHNADETWPIPEVPMDAYNETKAIAEDMVLKANDPSSDFYTVALRPAGIFGPGDRQLVPGLRQVAKLGQSKFQIGDNNNLFDWTYAGNVADAHVLAAQKLLDPKTRTAVSGETFFITNDTPTYFWALARTVWKADGHIDKHVIVLKRPVAICAGYLSEWVSKMLGKEPGLTPFRVKIVCAYRYHNIAKAKKLLGYTPRVGIEEGINKTLAWMDEGL

SEQ ID NO: 21957 - protein, 744 aa, Saccharomyces cerevisiae
MITNKKIKISVPEKLGLSEESFEESWETVKYAIDHIYSDDMADLSFEQVYKTIYTIVLNKKGPILYNRLKDYLIQKLALLRETIVKDNTHDYEFLGTMARLWEVQCHCFKITGDLMMYMDKVYCKPNRCMEVYDMCLDLFRIEILQKCSSSLISALISDIERIRNLGSVDSEHTSLWKVLIGMMETLHDNRDSFFLTDFEPVLISATEEYYNKAIDIELLTPIESLEKIRKLRQFESMLDSSFLNVDSHNKLKTVLENVLIWGKLSDIIEDLTHEAMVISNGKLLQEIYDLSSEEKYRVTVIESIKSYINKNAINIPFNEGNRKKGQNAITWSSEIVELYRSQHSFLESIDFGSVRLNNLTGDVSNAILGDVFSMYFSKEGALPSEYLSTYVDHCMKRTKEKDAEIVKIKQDLLDSTKLIGLLTEKDIFEKIYKKQLSRRLLQQRSLVEIEKWMVQMIKKVLGTFFTSKLEIMLRDISLSSEMYQAFQHSTINSIEYLSFAPQVLTRTSWPFQSTNPIDEGISLPPRMSQILAGFEGYYSLKYKERVLKWAHHLSVIEIGCQFNSGYYEISFSVYAGVIFLLFEDYEELTLGEIYELTHIPIDDVKSLVMSMSTIPRCKILKKSSSSGNMKFSVNYFFSSPNRKVKVPVIACPLPSQKSDNLATASSVDTYDNEIVMELSAIIVRIMKTEGKLSHQQLLERTTKRTQSRLSLTPSILKRSIQLLIEKEYIQRNADDPSYYHYLS

SEQ ID NO: 21958 - protein, 323 aa, Saccharomyces cerevisiae
MTVNLDPDKVWIDGCFDFTHHGHAGAILQARRTVSKENGKLFCGVHTDEDIQHNKGTPVMNSSERYEHTRSNRWCSEVVEAAPYVTDPNWMDKYQCQYVVHGDDITIDANGEDCYKLVKEMGRFKVVKRTYGVSTTEIIHRILTKKSLPPTHPDYYPTTQELSFYSVAQDAVSKHCYVFQRDLDNVLVNGGYKFDAEDCVYVDGDFDLFHMGDIDQLRKLKMDLHPDKKLIVGITTSDYSSTIMTMKERVLSVLSCKYVDAVIIDADATSMSQYNCEKYHIGTAVLTAAGKFSEYLTKELIVKRVESQREVYIARNQKKGMSI

SEQ ID NO: 21959 - protein, 471 aa, Saccharomyces cerevisiae
MSICEQYYPEEPTKPTVKTESIPGPESQKQLKELGEVFDTRPAYFLADYEKSLGNYITDVDGNTYLDLYAQISSIALGYNNPALIKAAQSPEMIRALVDRPALGNFPSKDLDKILKQILKSAPKGQDHVWSGLSGADANELAFKAAFIYYRAKQRGYDADFSEKENLSVMDNDAPGAPHLAVLSFKRAFHGRLFASGSTTCSKPIHKLDFPAFHWPHAEYPSYQYPLDENSDANRKEDDHCLAIVEELIKTWSIPVAALIIEPIQSEGGDNHASKYFLQKLRDITLKYNVVYIIDEVQTGVGATGKLWCHEYADIQPPVDLVTFSKKFQSAGYFFHDPKFIPNKPYRQFNTWCGEPARMIIAGAIGQEISDKKLTEQCSRVGDYLFKKLEGLQKKYPENFQNLRGKGRGTFIAWDLPTGEKRDLLLKKLKLNGCNVGGCAVHAVRLRPSLTFEEKHADIFIEALAKSVNEL

SEQ ID NO: 21960 - protein, 118 aa, Saccharomyces cerevisiae
MAEKRTLIAVIADEDTTTGLLLAGIGQITPETQEKNFFVYQEGKTTKEEITDKFNHFTEERDDIAILLINQHIAENIRARVDSFTNAFPAILEIPSKDHPYDPEKDSVLKRVRKLFGE

SEQ ID NO: 21961 - protein, 362 aa, Saccharomyces cerevisiae
MSRKFDLKTITDLSVLVGTGISLYYLVSRLLNDVESGPLSGKSRESKAKQSLQWEKLVKRSPALAEVTLDAYERTILSSIVTPDEINITFQDIGGLDPLISDLHESVIYPLMMPEVYSNSPLLQAPSGVLLYGPPGCGKTMLAKALAKESGANFISIRMSSIMDKWYGESNKIVDAMFSLANKLQPCIIFIDEIDSFLRERSSTDHEVTATLKAEFMTLWDGLLNNGRVMIIGATNRINDIDDAFLRRLPKRFLVSLPGSDQRYKILSVLLKDTKLDEDEFDLQLIADNTKGFSGSDLKELCREAALDAAKEYIKQKRQLIDSGTIDVNDTSSLKIRPLKTKDFTKKLRMDATSTLSSQPLD

SEQ ID NO: 21962 - protein, 1895 aa, Saccharomyces cerevisiae
MSYNDPNLNGQYYSNGDGTGDGNYPTYQVTQDQSAYDEYGQPIYTQNQLDDGYYDPNEQYVDGTQFPQGQDPSQDQGPYNNDASYYNQPPNMMNPSSQDGENFSDFSSYGPPSGTYPNDQYTPSQMSYPDQDGSSGASTPYGNGVVNGNGQYYDPNAIEMALPNDPYPAWTADPQSPLPIEQIEDIFIDLTNKFGFQRDSMRNMFDHFMTLLDSRSSRMSPEQALLSLHADYIGGDTANYKKWYFAAQLDMDDEIGFRNMKLGKLSRKARKAKKKNKKAMQEASPEDTEETLNQIEGDNSLEAADFRWKSKMNQLSPFEMVRQIALFLLCWGEANQVRFTPECLCFIYKCASDYLDSAQCQQRPDPLPEGDFLNRVITPLYRFIRSQVYEIVDGRYVKSEKDHNKVIGYDDVNQLFWYPEGIAKIVMEDGTRLIDLPAEERYLKLGEIPWDDVFFKTYKETRSWLHLVTNFNRIWIMHISVYWMYCAYNAPTFYTHNYQQLVDNQPLAAYKWATAALGGTVASLIQVAATLCEWSFVPRKWAGAQHLSRRFWFLCVIMGINLGPVIFVFAYDKDTVYSTAAHVVGAVMFFVAVATLVFFSVMPLGGLFTSYMKKSTRSYVASQTFTASFAPLHGLDRWMSYLVWVTVFAAKYAESYFFLILSLRDPIRILSTTSMRCTGEYWWGNKICKVQPKIVLGLMIATDFILFFLDTYLWYIVVNTVFSVGKSFYLGISILTPWRNIFTRLPKRIYSKILATTDMEIKYKPKVLISQIWNAIIISMYREHLLAIDHVQKLLYHQVPSEIEGKRTLRAPTFFVSQDDNNFETEFFPRDSEAERRISFFAQSLSTPIPEPLPVDNMPTFTVLTPHYAERILLSLREIIREDDQFSRVTLLEYLKQLHPVEWDCFVKDTKILAEETAAYENNEDEPEKEDALKSQIDDLPFYCIGFKSAAPEYTLRTRIWASLRSQTLYRTISGFMNYSRAIKLLYRVENPEIVQMFGGNADGLERELEKMARRKFKFLVSMQRLAKFKPHELENAEFLLRAYPDLQIAYLDEEPPLNEGEEPRIYSALIDGHCEILENGRRRPKFRVQLSGNPILGDGKSDNQNHALIFYRGEYIQLIDANQDNYLEECLKIRSVLAEFEELGIEQIHPYTPGLKYEDQSTNHPVAIVGAREYIFSENSGVLGDVAAGKEQTFGTLFARTLAQIGGKLHYGHPDFINATFMTTRGGVSKAQKGLHLNEDIYAGMNAVLRGGRIKHCEYYQCGKGRDLGFGTILNFTTKIGAGMGEQMLSREYYYLGTQLPIDRFLTFYYAHPGFHLNNLFIQLSLQMFMLTLVNLHALAHESILCVYDRDKPITDVLYPIGCYNFHPAIDWVRRYTLSIFIVFWIAFVPIVVQELIERGLWKATQRFFRHILSLSPMFEVFAGQIYSSALLSDIAVGGARYISTGRGFATSRIPFSILYSRFAGSAIYMGSRSMLMLLFGTVAHWQAPLLWFWASLSALIFAPFIFNPHQFAWEDFFLDYRDYIRWLSRGNNKYHRNSWIGYVRMSRSRVTGFKRKLVGDESEKSAGDASRAHRTNLIMAEIIPCAIYAAGCFIAFTFINAQTGVKTTDEDRVNSTLRIIICTLAPIVIDIGVLFFCMGLSCCSGPLLGMCCKKTGSVMAGIAHGIAVVVHIVFFIVMWVLEGFSFVRMLIGVVTCIQCQRLIFHCMTVLLLTREFKNDHANTAFWTGKWYSTGLGYMAWTQPTRELTAKVIELSEFAADFVLGHVILIFQLPVICIPKIDKFHSIMLFWLKPSRQIRPPIYSLKQARLRKRMVRRYCSLYFLVLIIFAGCIVGPAVASAHVPKDLGSGLTGTFHNLVQPRNVSNNDTGSQMSTYKSHYYTHTPSLKTWSTIK

SEQ ID NO: 21963 - protein, 87 aa, Saccharomyces cerevisiae
MVSQLFEEKAKAVNELPTKPSTDELLELYALYKQATVGDNDKEKPGIFNMKDRYKWEAWENLKGKSQEDAEKEYIALVDQLIAKYSS

SEQ ID NO: 21964 - protein, 368 aa, Saccharomyces cerevisiae
MARTITFDIPSQYKLVDLIGEGAYGTVCSAIHKPSGIKVAIKKIQPFSKKLFVTRTIREIKLLRYFHEHENIISILDKVRPVSIDKLNAVYLVEELMETDLQKVINNQNSGFSTLSDDHVQYFTYQILRALKSIHSAQVIHRDIKPSNLLLNSNCDLKVCDFGLARCLASSSDSRETLVGFMTEYVATRWYRAPEIMLTFQEYTTAMDIWSCGCILAEMVSGKPLFPGRDYHHQLWLILEVLGTPSFEDFNQIKSKRAKEYIANLPMRPPLPWETVWSKTDLNPDMIDLLDKMLQFNPDKRISAAEALRHPYLAMYHDPSDEPEYPPLNLDDEFWKLDNKIMRPEEEEEVPIEMLKDMLYDELMKTME

SEQ ID NO: 21965 - protein, 547 aa, Saccharomyces cerevisiae
MTKITRDVSITTENSKSTSGSATASSASLPENDHPIFHQPRARIRSGSLFIEGSDSFPSSEVKSYNVYIDDSKYSEILKGDTNSSSTDGKQVFEDARDDNFHQESHRDLEDSILDLVRRDPEVAAFPLPPPNSNERNRNSSNGSSAETNLNGHSSSGTISTSVLLNMGSAEKHAGTTRGDHMESSSMKSFEKLGTRPSSLFYPPPEGTAPYQGPRATVSGNKSTRQTQGTYSFPSMRYGVDLVSPVEGAVDVAKSRVPNSTLNGTFPDKAFIPHEFQIPKKAWNRIPANKSTSLKTPRNHSLLIDILKPFEAADLANDQRSSSAVLKNTVHSNGQYNPTNETSGTRMQDQRQKNTNEIDLEKIPNPQVPLGIAMDTMRSPNQLHEKEYESNIEAGLASGVGKGDNSIKQHQYKKIPQEIDRDQQLSFQMETMPIQRIDSSSIRSFDSRIYGFSEIYSIPRVITTLCICLFVPPLFFFFSINGNNGVSNYRLMRMIMNYEHRIGLLKGFEWDIDVQWFRTLCFVLGCIEMLAIFASIGIGFGVGIIRE

SEQ ID NO: 21966 - protein, 333 aa, Saccharomyces cerevisiae
MSEPSEKKQKVATSSLEQLKKAGTHVVADSGDFEAISKYEPQDSTTNPSLILAASKLEKYARFIDAAVEYGRKHGKTDHEKIENAMDKILVEFGTQILKVVPGRVSTEVDARLSFDKKATVKKALHIIKLYKDAGVPKERVLIKIASTWEGIQAARELEVKHGIHCNMTLLFSFTQAVACAEANVTLISPFVGRIMDFYKALSGKDYTAETDPGVLSVKKIYSYYKRHGYATEVMAASFRNLDELKALAGIDNMTLPLNLLEQLYESTDPIENKLNSESAKEEGVEKVSFINDEPHFRYVLNEDQMATEKLSDGIRKFSADIEALYKLVEEKM

SEQ ID NO: 21967 - protein, 300 aa, Saccharomyces cerevisiae
MSPCYGQNSAIAKGSWNREVLQEVQPIYHWHDFGQNMKEYSASPLEGDSSLPSSLPSSTEDCLLLSLENTITVIAGNQRQAYDSTSSTEEGTAPQLRPDEIADSTHCITSLVDPEFRDLINYGRQKGANPVFIESNTTEQSHSQCILGYPQKSHVAQLYHDPKVLSTISEGQTKRGSYHCSHCSEKFATLVEFAAHLDEFNLERPCKCPIEQCPWKILGFQQATGLRRHCASQHIGELDIEMEKSLNLKVEKYPGLNCPFPICQKTFRRKDAYKRHVAMVHNNADSRFNKRLKKILNNTK

SEQ ID NO: 21968 - protein, 574 aa, Saccharomyces cerevisiae
MSEGRTFLSQLNVFNKENYQFSSSTTKKEVSNSTVDADNGASDFEAGQQFATELDQGEKQLGILSCIGLICNRMLGTGVFAVSSTIYTLCGSVGLALIMWAVGAIIAISGLYVYMEFGTAIPKNGGEKNYLEAIFRKPKFFITCMYAAYIFFLGWAAGNSINTAIMFLTAADTEVTKWNQRGIGVAVVFFAFLINSLNVKIGLYLQNILGIFKIGIVLFISITGWVALGGGLKDGYQSHNFRNAFEGTETATAYGIVNALYSVIWSFVGYSNVNYALGEVKNPVRTLKIAGPTSMVFLAIIYIFVNIAYFAVVPKDKLISSKLILAADFFDIVFGGQAKRAAAALVGLSALGNVLSVIFSQGRIIQQLGREGVLPFSNFFASSKPFNSPMVGLFQHFIVCTVTILAPPPGDAYLLVQNLISYPMNIINFAISAGLLWIYWQRRQGKIEWNPPIKAGVFVTGFFTLSNLYLIIAPYVPPSNGESVYSSMPYWIHCVIAWGIFFFGGVYYVVWAQLLPRWGHYKLVSKDVLGEDGFWRVKIAKVYDDTIGDVDTQEDGVIETNIIEHYKSEQEKSL

SEQ ID NO: 21969 - protein, 512 aa, Saccharomyces cerevisiae
MKSKGSRLSTDCPVEFPKIVSGFAEEVKIRRQSSQGQYAVDSHPPKSPELKHRRQRSSSFVNGKCRNRDLPLLDNKKAQEINTNSHGQDIGIKNLPRQRELLNAKNGIDFTLMVAGQSGLGKTTFINSLFSTSLIDDDIKENKPIIRYKSIVEGDGTHLNFNVIDTPGFGNNMDNAFTWRTMVNYIDEEIRSYIFQEEQPDRTKMVDNRVHCCLYFLRPSNKGIDTLDVVTMKKLAKRVNLIPVIAKSDLLTKEELKNFKTQVREIIRVQDIPVCFFFGDEVLNATQDIFQKYPFSIIASNEYIFNEKGEKVKGRQYKWGAVDIENEKYCDFKILQKTIFDWNLIDLVESTEDYYEKCRSEMLRTRLLKARDCLTTKSVDITEEQRKFLEEEMNFDEIEENKLKNYKCYEIINKTVMDKVATEWDPEFITRQLEAKKKFNELSNREISKFRDWKKSLFMEQENFNQEIEQLNHKLENLQLECQDLEYKLLIGKSSNSHSTDSATLVNVHIKR

SEQ ID NO: 21970 - protein, 593 aa, Saccharomyces cerevisiae
MTISNKSWRSYFPHLRKLPEDDQYLYSDDTNSSIIAEEELHHSVDKSSKTDVTAETTAVEPHPHNLRHDLPYEVRDEAGRKWWKYFDEFEYRVNKEYKKSRKWYEFLYPNHTTQTKAERRLLYKLDIIIALYFFMLCWSKSVDLNNYTNAYVSNMKEDLNMKGNDYVYTSTIANVGAIVFQLPFMYLLPRFPSHIILPVMDLGWTWFTFACYRANSLAELRAYRFILSAFGAAYYPVSQYILGCWYAPDEINSRVCLFFCGQQLGSVTSGLLQSRIFKSLNGVHGLAGWRWMFLIDAIAISLPTAIIGFFVIPGVPSKCYSLFLTDEEIRIARARNKRNQIKDGVDKSKLAPLWSRKLWKKVFCTPAFWVLVVFDTCSWNNMTAYSGSYTLWLKSNTKYSIAQVNNLSVIPACLGFAYVIFCAFGADLFRCKWIFMVFAAIMNTVSCALLIKWDIPSKAKWYAFFTTYFSVAASPCLWSFINDFLRFDPQVKAITWIAIYSFSQSTYAWIPTLAWPTVESPRFKTGYTVSLIFGAIYGLWTFVVLFFYKRNEKKHALGNGIILYDSNKGEELPEFVKKNMEERDGYYYLKRSS

SEQ ID NO: 21971 - protein, 1155 aa, Saccharomyces cerevisiae
MNSNELDLRNKYFYEIFGKKRKSDTSTPTQLFSGSKVQTNINEISITNDEDEDSTEDENKASLKDYTLGHDTGARYRIAPDCSSHQLKASPVLHISTNLNSSPQSFTGDQISPTNKKISINDSTRQDKGNSCTTTSSPSQKRSNVLLPHVRKHSSPSLLSFSKNSGSHMGDPNQLSTPPTPKSAGHTMELHSSFNGKHSSSSTSSLFALESLKTQNRRSSNSSNHSSQYRRHTNQHQRHHSRSKSSPVSLTEISMIKGTPLVYPALLSLIAIKFKQTIKLSTHKKMGLLYRDSFTGKQAIDTLCLIIGSLDRNLGMLIGKSLEAQKLFHDVLYDHGVRDSVLEIYELSSESIFMAHQSQSSTSIANTFSSSSSSVNSLRTKTEIYGVFVPLTHCYSSTCSLEKLCYSISCPNRLQQQANLHLKLGGGLKRNISLALDKEDDERISWTNSVPKSVWESLSKQQIKRQEAIYELFTTEKKFVKSLEIIRDTFMKKLLETNIIPSDVRINFVKHVFAHINEIYSVNREFLKALAQRQSLSPICPGIADIFLQYLPFFDPFLSYIASRPYAKYLIETQRSVNPNFARFDDEVSNSSLRHGIDSFLSQGVSRPGRYSLLVREIIHFSDPVTDKDDLQMLMKVQDLLKDLMKRIDRASGAAQDRYDVKVLKQKILFKNEYVNLGLNNEKRKIKHEGLLSRKDVNKTDASFSGDIQFYLLDNMLLFLKSKAVNKWHQHTVFQRPIPLPLLFICPAEDMPPIKRYVTENPNCSAGVLLPQYQTSNPKNAIVFAYYGTKQQYQVTLYAPQPAGLQTLIEKVKQEQKRLLDETKHITFKQMVGQFFHSYINTNRVNDVLICHAGKILLVATNMGLFVLNYATSINQKPVHLLHKISISQISVLEEYKVMILLIDKKLYGCPLDVIDDAENADFLFRKNSKVLFKYVAMFKDGFCNGKRIIMIAHHFLHAAQLLIVNPLIFDFNSGNFKKNLKAGLVDFSVDSEPLSFSFLENKICIGCKKNIKILNVPEVCDKNGFKMRELLNLHDNKVLANMYKETFKVVSMFPIKNSTFACFPELCFFLNKQGKREETKGCFHWEGEPEQFACSYPYIVAINSNFIEIRHIENGELVRCVLGNKIRMLKSYAKKILYCYEDPQGFEIIELLNF

SEQ ID NO: 21972 - protein, 563 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVIRLIELKLPVFDAPESLIKQAQLTAATNAKQ

SEQ ID NO: 21973 - protein, 573 aa, Saccharomyces cerevisiae
MPIRSISSASQMNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEDNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAECLGVPWEPVDLEGYAKTWSIASAN

SEQ ID NO: 21974 - protein, 572 aa, Saccharomyces cerevisiae
MLSKSEKNVDLLAGNMSNLSFDGHGTPGGTGLFPNQNITKRRTRPAGINDSPSPVKPSFFPYEDTSNMDIDEVSQPDMDVSNSPKKLPPKFYERATSNKTQRVVSVCKMYFLEHYCDMFDYVISRRQRTKQVLEYLQQQSQLPNSDQIKLNEEWSSYLQREHQVLRKRRLKPKNRDFEMITQVGQGGYGQVYLARKKDTKEVCALKILNKKLLFKLNETKHVLTERDILTTTRSEWLVKLLYAFQDLQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEINYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGLEHSDPFSTFY

SEQ ID NO: 21975 - protein, 314 aa, Saccharomyces cerevisiae
MFKEEDSLRKGQNVAAWKTLLAGAVSGLLARSITAPMDTIKIRLQLTPANGLKPFGSQVMEVARSMIKNEGIRSFWKGNIPGSLLYVTYGSAQFSSYSLFNRYLTPFGLEARLHSLVVGAFAGITSSIVSYPFDVLRTRLVANNQMHSMSITREVRDIWKLEGLPGFFKGSIASMTTITLTASIMFGTYETIRIYCDENEKTTAAHKKWELATLNHSAGTIGGVIAKIITFPLETIRRRMQFMNSKHLEKFSRHSSVYGSYKGYGFARIGLQILKQEGVSSLYRGILVALSKTIPTTFVSFWGYETAIHYLRMY

SEQ ID NO: 21976 - protein, 149 aa, Saccharomyces cerevisiae
MVLSNYLVSFACTQSFFFFASNFIESPPALLKKAFLPNLNRTRSRFPPINYVLLAPLSSYCKWTFQRGYACPVSFLKQAHTDALQLVFFTRCIIWAVFHYRFRVGALTKRARPFVYNRPKRKNINNQEADTKYRSTIKLTSTVTLNLLY

SEQ ID NO: 21977 - protein, 471 aa, Saccharomyces cerevisiae
MSRSLLVENSRTINSNEEKGVNESQYILQKRNVPRTILGNVTNNANILQEISMNRKIGMKNFSKLNNFFPLKDDVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLAINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 21978 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 21979 - protein, 1547 aa, Saccharomyces cerevisiae
MSFMDQIPGGGNYPKLPVECLPNFPIQPSLTFRGRNDSHKLKNFISEIMLNMSMISWPNDASRIVYCRRHLLNPAAQWANDFVQEQGILEITFDTFIQGLYQHFYKPPDINKIFNAITQLSEAKLGIERLNQRFRKIWDRMPPDFMTEKAAIMTYTRLLTKETYNIVRMHKPETLKDAMEEAYQTTALTERFFPGFELDADGDTIIGATTHLQEEYDSDYDSEDNLTQNGYVHTVRTRRSYNKPMSNHRNRRNNNPSREECIKNRLCFYCKKEGHRLNECRARKAVLTDLELESKDQQTPFIKTLPIVHYIAIPEMDNTAEKTIKIQNTKVKTLFDSGSPTSFIRRDIVELLKYEIYETPPLRFRGFVATKSAVTSEAVTIDLKINDLHITLAAYILDNMDYQLLIGNPILRRYPKILHTVLNTRESPDSLKPKTYRSETVNNVRTYSAGNRGNPRNIKLSFAPTILEATDPKSAGNRGDSRTKTLSLATTTPAAIDPLTTLDNPGSTQSTFAQFPIPEEASILEEDGKYSNVVSTIQSVEPNATDHSNKDTFCTLPVWLQQKYREIIRNDLPPRPADINNIPVKHDIEIKPGARLPRLQPYHVTEKNEQEINKIVQKLLDNKFIVPSKSPCSSPVVLVPKKDGTFRLCVDYRTLNKATISDPFPLPRIDNLLSRIGNAQIFTTLDLHSGYHQIPMEPKDRYKTAFVTPSGKYEYTVMPFGLVNAPSTFARYMADTFRDLRFVNVYLDDILIFSESPEEHWKHLDTVLERLKNENLIVKKKKCKFASEETEFLGYSIGIQKIAPLQHKCAAIRDFPTPKTVKQAQRFLGMINYYRRFIPNCSKIAQPIQLFICDKSQWTEKQDKAIDKLKDALCNSPVLVPFNNKANYRLTTDASKDGIGAVLEEVDNKNKLVGVVGYFSKSLESAQKNYPAGELELLGIIKALHHFRYMLHGKHFTLRTDHISLLSLQNKNEPARRVQRWLDDLATYDFTLEYLAGPKNVVADAISRAVYTITPETSRPIDTESWKSYYKSDPLCSAVLIHMKELTQHNVTPEDMSAFRSYQKKLELSETFRKNYSLEDEMIYYQDRLVVPIKQQNAVMRLYHDHTLFGGHFGVTVTLAKISPIYYWPKLQHSIIQYIRTCVQCQLIKSHRPRLHGLLQPLPIAEGRWLDISMDFVTGLPPTSNNLNMILVVVDRFSKRAHFIATRKTLDATQLIDLLFRYIFSYHGFPRTITSDRDVRMTADKYQELTKRLGIKSTMSSANHPQTDGQSERTIQTLNRLLRAYASTNIQNWHVYLPQIEFVYNSTPTRTLGKSPFEIDLGYLPNTPAIKSDDEVNARSFTAVELAKHLKALTIQTKEQLEHAQIEMETNNNQRRKPLLLNIGDHVLVHRDAYFKKGAYMKVQQIYVGPFRVVKKINDNAYELDLNSHKKKHRVINVQFLKKFVYRPDAYPKNKPISSTERIKRAHEVTALIGIDTTHKTYLCHMQDVDPTLSVEYSEAEFCQIPERTRRSILANFRQLYETQDNPEREEDVVSQNEICQYDNTSP

SEQ ID NO: 21980 - protein, 513 aa, Saccharomyces cerevisiae
MSTPTAADRAKALERKNEGNVFVKEKHFLKAIEKYTEAIDLDSTQSIYFSNRAFAHFKVDNFQSALNDCDEAIKLDPKNIKAYHRRALSCMALLEFKKARKDLNVLLKAKPNDPAATKALLTCDRFIREERFRKAIGGAENEAKISLCQTLNLSSFDANADLANYEGPKLEFEQLYDDKNAFKGAKIKNMSQEFISKMVNDLFLKGKYLPKKYVAAIISHADTLFRQEPSMVELENNSTPDVKISVCGDTHGQFYDVLNLFRKFGKVGPKHTYLFNGDFVDRGSWSCEVALLFYCLKILHPNNFFLNRGNHESDNMNKIYGFEDECKYKYSQRIFNMFAQSFESLPLATLINNDYLVMHGGLPSDPSATLSDFKNIDRFAQPPRDGAFMELLWADPQEANGMGPSQRGLGHAFGPDITDRFLRNNKLRKIFRSHELRMGGVQFEQKGKLMTVFSAPNYCDSQGNLGGVIHVVPGHGILQAGRNDDQNLIIETFEAVEHPDIKPMAYSNGGFGL

SEQ ID NO: 21981 - protein, 183 aa, Saccharomyces cerevisiae
MPNFWILENRRSYTSDTCMSRIVKEYKVILKTLASDDPIANPYRGIIESLNPIDETDLSKWEAIISGPSDTPYENHQFRILIEVPSSYPMNPPKISFMQNNILHCNVKSATGEICLNILKPEEWTPVWDLLHCVHAVWRLLREPVCDSPLDVDIGNIIRCGDMSAYQGIVKYFLAERERINNH

SEQ ID NO: 21982 - protein, 258 aa, Saccharomyces cerevisiae
MGSRRYDSRTTIFSPEGRLYQVEYALESISHAGTAIGIMASDGIVLAAERKVTSTLLEQDTSTEKLYKLNDKIAVAVAGLTADAEILINTARIHAQNYLKTYNEDIPVEILVRRLSDIKQGYTQHGGLRPFGVSFIYAGYDDRYGYQLYTSNPSGNYTGWKAISVGANTSAAQTLLQMDYKDDMKVDDAIELALKTLSKTTDSSALTYDRLEFATIRKGANDGEVYQKIFKPQEIKDILVKTGITKKDEDEEADEDMK

SEQ ID NO: 21983 - protein, 272 aa, Saccharomyces cerevisiae
MRDYKLVVLGAGGVGKSCLTVQFVQGVYLDTYDPTIEDSYRKTIEIDNKVFDLEILDTAGIAQFTAMRELYIKSGMGFLLVYSVTDRQSLEELMELREQVLRIKDSDRVPMVLIGNKADLINERVISVEEGIEVSSKWGRVPFYETSALLRSNVDEVFVDLVRQIIRNEMESVAVKDARNQSQQFSKIESPSTRLPSSAKQDTKQSNNKQSSKGLYNKSSQGQAKVKQSTPVNEKHKPSHAVPKSGSSNRTGISATSQQKKKKKNASTCTIL

SEQ ID NO: 21984 - protein, 869 aa, Saccharomyces cerevisiae
MSSCKTTLSEMVGSVTKDRGTINVEARTRSSNVTFKPPVTHDMVRSLFDPTLKKSLLEKCIALAIISNFFICYWVFQRFGLQFTKYFFLVQYLFWRIAYNLGIGLVLHYQSHYETLTNCAKTHAIFSKIPQNKDANSNFSTNSNSFSEKFWNFIRKFCQYEIRSKMPKEYDLFAYPEEINVWLIFRQFVDLILMQDFVTYIIYVYLSIPYSWVQIFNWRSLLGVILILFNIWVKLDAHRVVKDYAWYWGDFFFLEESELIFDGVFNISPHPMYSIGYLGYYGLSLICNDYKVLLVSVFGHYSQFLFLKYVENPHIERTYGDGTDSDSQMNSRIDDLISKENYDYSRPLINMGLSFNNFNKLRFTDYFTIGTVAALMLGTIMNARFINLNYLFITVFVTKLVSWLFISTILYKQSQSKWFTRLFLENGYTQVYSYEQWQFIYNYYLVLTYTLMIIHTGLQIWSNFSNINNSQLIFGLILVALQTWCDKETRLAISDFGWFYGDFFLSNYISTRKLTSQGIYRYLNHPEAVLGVVGVWGTVLMTNFAVTNIILAVLWTLTNFILVKFIETPHVNKIYGKTKRVSGVGKTLLGLKPLRQVSDIVNRIENIIIKSLVDESKNSNGGAELLPKNYQDNKEWNILIQEAMDSVATRLSPYCELKIENEQVETNFVLPTPVTLNWKMPIELYNGDDWIGLYKVIDTRADREKTRVGSGGHWSATSKDSYMNHGLRHKESVTEIKATEKYVQGKVTFDTSLLYFENGIYEFRYHSGNSHKVLLISTPFEISLPVLNTTTPELFEKDLTEFLTKVNVLKDGKFRPLGNKFFGMDSLKQLIKNSIGVELSSEYMRRVNGDAHVISHRAWDIKQTLDSLA

SEQ ID NO: 21985 - protein, 368 aa, Saccharomyces cerevisiae
MGIIDKIKAIEEEMARTQKNKATEHHLGLLKGKLARYRQQLLADEAGSGGGGGSGFEVAKSGDARVVLIGYPSVGKSSLLGKITTTKSEIAHYAFTTLTSVPGVLKYQGAEIQIVDLPGIIYGASQGKGRGRQVVATARTADLVLMVLDATKSEHQRASLEKELENVGIRLNKEKPNIYYKKKETGGVKVTFTSPPKTNLTEQAIKMILRDYRIHNAEVLVRDDQCTIDDFIDVINEQHRNYVKCLYVYNKIDAVSLEEVDKLAREPNTVVMSCEMDLGLQDVVEEIWYQLNLSRVYTKKRGVRPVFDDPLVVRNNSTIGDLCHGIHRDFKDKFKYALVWGSSAKHSPQKCGLNHRIDDEDVVSLFAK

SEQ ID NO: 21986 - protein, 496 aa, Saccharomyces cerevisiae
MSAVNVAPELINADNTITYDAIVIGAGVIGPCVATGLARKGKKVLIVERDWAMPDRIVGELMQPGGVRALRSLGMIQSINNIEAYPVTGYTVFFNGEQVDIPYPYKADIPKVEKLKDLVKDGNDKVLEDSTIHIKDYEDDERERGVAFVHGRFLNNLRNITAQEPNVTRVQGNCIEILKDEKNEVVGAKVDIDGRGKVEFKAHLTFICDGIFSRFRKELHPDHVPTVGSSFVGMSLFNAKNPAPMHGHVILGSDHMPILVYQISPEETRILCAYNSPKVPADIKSWMIKDVQPFIPKSLRPSFDEAVSQGKFRAMPNSYLPARQNDVTGMCVIGDALNMRHPLTGGGMTVGLHDVVLLIKKIGDLDFSDREKVLDELLDYHFERKSYDSVINVLSVALYSLFAADSDNLKALQKGCFKYFQRGGDCVNKPVEFLSGVLPKPLQLTRVFFAVAFYTIYLNMEERGFLGLPMALLEGIMILITAIRVFTPFLFGELIG

SEQ ID NO: 21987 - protein, 345 aa, Saccharomyces cerevisiae
MEAHNQFLKTFQKERHDMKEAEKDEILLMENSRRFVMFPIKYHEIWAAYKKVEASFWTAEEIELAKDTEDFQKLTDDQKTYIGNLLALSISSDNLVNKYLIENFSAQLQNPEGKSFYGFQIMMENIYSEVYSMMVDAFFKDPKNIPLFKEIANLPEVKHKAAFIERWISNDDSLYAERLVAFAAKEGIFQAGNYASMFWLTDKKIMPGLAMANRNICRDRGAYTDFSCLLFAHLRTKPNPKIIEKIITEAVEIEKEYYSNSLPVEKFGMDLKSIHTYIEFVADGLLQGFGNEKYYNAVNPFEFMEDVATAGKTTFFEKKVSDYQKASDMSKSATPSKEINFDDDF

SEQ ID NO: 21988 - protein, 66 aa, Saccharomyces cerevisiae
MSFSSLYKTFFKRNAVFVGTIFAGAFVFQTVFDTAITSWYENHNKGKLWKDVKARIAAGDGDDDDE

SEQ ID NO: 21989 - protein, 1021 aa, Saccharomyces cerevisiae
MNLDLGSTVRGYESDKDTFPQSKGVSSSQKEQHSQLNQTKIAYEQRLLNDLEDMDDPLDLFLDYMIWISTSYIEVDSESGQEVLRSTMERCLIYIQDMETYRNDPRFLKIWIWYINLFLSNNFHESENTFKYMFNKGIGTKLSLFYEEFSKLLENAQFFLEAKVLLELGAENNCRPYNRLLRSLSNYEDRLREMNIVENQNSVPDSRERLKGRLIYRTAPFFIRKFLTSSLMTDDKENRANLNSNVGVGKSAPNVYQDSIVVADFKSETERLNLNSSKQPSNQRLKNGNKKTSIYADQKQSNNPVYKLINTPGRKPERIVFNFNLIYPENDEEFNTEEILAMIKGLYKVQRRGKKHTEDYTSDKNRKKRKLDVLVERRQDLPSSQPPVVPKSTRIEVFKDDDNPSQSTHHKNTQVQVQTTTSILPLKPVVDGNLAHETPVKPSLTSNASRSPTVTAFSKDAINEVFSMFNQHYSTPGALLDGDDTTTSKFNVFENFTQEFTAKNIEDLTEVKDPKQETVSQQTTSTNETNDRYERLSNSSTRPEKADYMTPIKETTETDVVPIIQTPKEQIRTEDKKSGDNTETQTQLTSTTIQSSPFLTQPEPQAEKLLQTAEHSEKSKEHYPTIIPPFTKIKNQPPVIIENPLSNNLRAKFLSEISPPLFQYNTFYNYNQELKMSSLLKKIHRVSRNENKNPIVDFKKTGDLYCIRGELGEGGYATVYLAESSQGHLRALKVEKPASVWEYYIMSQVEFRLRKSTILKSIINASALHLFLDESYLVLNYASQGTVLDLINLQREKAIDGNGIMDEYLCMFITVELMKVLEKIHEVGIIHGDLKPDNCMIRLEKPGEPLGAHYMRNGEDGWENKGIYLIDFGRSFDMTLLPPGTKFKSNWKADQQDCWEMRAGKPWSYEADYYGLAGVIHSMLFGKFIETIQLQNGRCKLKNPFKRYWKKEIWGVIFDLLLNSGQASNQALPMTEKIVEIRNLIESHLEQHAENHLRNVILSIEEELSHFQYKGKPSRRF

SEQ ID NO: 21990 - protein, 507 aa, Saccharomyces cerevisiae
MKVLDLLTVLSASSLLSTFAAAESTATADSTTAASSTASCNPLKTTGCTPDTALATSFSEDFSSSSKWFTDLKHAGEIKYGSDGLSMTLAKRYDNPSLKSNFYIMYGKLEVILKAANGTGIVSSFYLQSDDLDEIDIEWVGGDNTQFQSNFFSKGDTTTYDRGEFHGVDTPTDKFHNYTLDWAMDKTTWYLDGESVRVLSNTSSEGYPQSPMYLMMGIWAGGDPDNAAGTIEWAGGETNYNDAPFTMYIEKVIVTDYSTGKKYTYGDQSGSWESIEADGGSIYGRYDQAQEDFAVLANGGSISSSSTSSSTVSSSASSTVSSSVSSTVSSSASSTVSSSVSSTVSSSSSVSSSSSTSPSSSTATSSKTLASSSVTTSSSISSFEKQSSSSSKKTVASSSTSESIISSTKTPATVSSTTRSTVAPTTQQSSVSSDSPVQDKGGVATSSNDVTSSTTQISSKYTSTIQSSSSEASSTNSVQISNGADLAQSLPREGKLFSVLVALLALL

SEQ ID NO: 21991 - protein, 603 aa, Saccharomyces cerevisiae
MPRNPLKKEYWADVVDGFKPATSPAFENEKESTTFVTELTSKTDSAFPLSSKDSPGINQTTNDITSSDRFRRNEDTEQEDINNTNLSKDLSVRHLLTLAVGGAIGTGLYVNTGAALSTGGPASLVIDWVIISTCLFTVINSLGELSAAFPVVGGFNVYSMRFIEPSFAFAVNLNYLAQWLVLLPLELVAASITIKYWNDKINSDAWVAIFYATIALANMLDVKSFGETEFVLSMIKILSIIGFTILGIVLSCGGGPHGGYIGGKYWHDPGAFVGHSSGTQFKGLCSVFVTAAFSYSGIEMTAVSAAESKNPRETIPKAAKRTFWLITASYVTILTLIGCLVPSNDPRLLNGSSSVDAASSPLVIAIENGGIKGLPSLMNAIILIAVVSVANSAVYACSRCMVAMAHIGNLPKFLNRVDKRGRPMNAILLTLFFGLLSFVAASDKQAEVFTWLSALSGLSTIFCWMAINLSHIRFRQAMKVQERSLDELPFISQTGVKGSWYGFIVLFLVLIASFWTSLFPLGGSGASAESFFEGYLSFPILIVCYVGHKLYTRNWTLMVKLEDMDLDTGRKQVDLTLRREEMRIERETLAKRSFVTRFLHFWC

SEQ ID NO: 21992 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 21993 - protein, 424 aa, Saccharomyces cerevisiae
MANPTTGKSSIRAKLSNSSLSNLFKKNKNKRQREETEEQDNEDKDESKNQDENKDTQLTPRKRRRLTKEFEEKEARYTNELPKELRKYRPKGFRFNLPPTDRPIRIYADGVFDLFHLGHMKQLEQCKKAFPNVTLIVGVPSDKITHKLKGLTVLTDKQRCETLTHCRWVDEVVPNAPWCVTPEFLLEHKIDYVAHDDIPYVSADSDDIYKPIKEMGKFLTTQRTNGVSTSDIITKIIRDYDKYLMRNFARGATRQELNVSWLKKNELEFKKHINEFRSYFKKNQTNLNNASRDLYFEVREILLKKTLGKKLYSKLIGNELKKQNQRQRKQNFLDDPFTRKLIREASPATEFANEFTGENSTAKSPDDNGNLFSQEDDEDTNSNNTNTNSDSDSNTNSTPPSEDDDDNDRLTLENLTQKKKQSAN

SEQ ID NO: 21994 - protein, 2039 aa, Saccharomyces cerevisiae
MQGRKRTLTEPFEPNTNPFGDNAAVMTENVEDNSETDGNRLESKPQALVPPALNIVPPESSIHSTEEKKGDEYNGNDKDSSLISNIFRTRVGRSSHENLSRPKLSLKTASFGAAESSRRNVSPSTKSAKSSSQYIDLNDERLRRRSFSSYSRSSSRRVSNSPSSTDRPPRSAKVLSLIAADDMDDFEDLQKGFKSAIDEEGLTWLPQLKSEKSRPVSDVGEDRGEGEQESIPDVHTPNVGASATPGSIHLTPEPAQNGSVSEGLEGSINNSRKKPSPKFFHHLSPQKEDKDQTEVIEYAEDILDFETLQRKLESRPFVLYGHSLGVFSPTNPLRIKIARFLLHRRYSLLYNTLLTFYAILLAIRTYNPHNVVFLYRFSNWTDYFIFILSACFTGNDIAKIIAFGFWDDSEMFKAYGREYKSILQRSGIMKLYIYLREKYGRKLIDFIIPFRIISPGEETKYQRSSLSTSLTKPYGAKENQRPFGTPRAFARSSWNRIDLVSSVSFWLGMFLSIKSYDTKTGIRIFKPLAILRILRLVNVDTGMPSILRGLKYGIPQLVNVSSMLVYFWIFFGILGVQIFQGSFRRQCVWFNPEDPTDTYQYDMQFCGGYLDPVTKRKQNYIYEDGSEGSVSKGFLCPQYSKCVSNANPYNGRISFDNIVNSMELVFVIMSANTFTDLMYYTMDSDEMAACLFFIVCIFVLTIWLLNLLIAVLVSSFEIANEEYKKKKFIYGSRKTGYVARIVTGYWKYFKLKANQTKFPNWSQKGLAIYSHVEFIFVILIICDIGMRASVKVSTSANCNNILLKTDRGISIVLFIESLARLVLYLPNMWKFLTKPSYVYDFIISIITLVISCLAVEGVLGHMYAWLSIFHISRFYRVIISFNLTKKLWKQILSNGVMIWNLSSFYFFFTFLVAIIMAVYFEGVIPPEEMADQPFGMYSLPNSFLSLFIIGSTENWTDILYALQKHSPNISSTFFCSVFFIIWFLLSNSVILNIFIALISESMEVKEEEKRPQQIKHYLKFVYPQKIQEYTHASLVARIRKKFFGGHRNEDTRDFKQFLMRGTAIMNIAQNMGELADEFKEPPSENLFKKGLSKLTIGVPSLKRLRMFANNPFYKNSDVVFTETNDINGRTYILELNEYEDEKLDYLKKYPLFNYSYYFFSPQHRFRRFCQRLVPPSTGKRTDGSRFFEDSTDLYNKRSYFHHIERDVFVFIFALATILLIVCSCYVTPLYRMHHKMGTWNWSSALDCAFIGAFSIEFIVKTVADGFIYSPNAYLRNPWNFIDFCVLISMWINLIAYLKNNGNLSRIFKGLTALRALRCLTISNTARQTFNLVMFDGLNKIFEAGLISLSLLFPFTVWGLSIFKGRLGTCNDGSLGRADCYNEYSNSVFQWDIMSPRVYQQPYLHLDSFASAFSSLYQIISLEGWVDLLENMMNSSGIGTPATVMGSAGNALFLVLFNFLSMVFILNLFVSFIVNNQARTTGSAYFTIEEKAWLESQKLLSQAKPKAIPNLIELSRVRQFFYQLAVEKKNFYYASFLQVVLYLHIIMLLSRSYNPGNLIGYQGVYFMFSTSVFLIQEALHMCGEGPRLYFRQKWNSIRLSIIIIAFIMNAVAFHVPASHYWFHNIKGFFLLVIFLFIIPQNDTLTELLETAMASLPPILSLTYTWGVLFLVYAIALNQIFGLTRLGSNTTDNINFRTVIKSMIVLFRCSFGEGWNYIMADLTVSEPYCSSDDNSTYTDCGSETYAYLLLMSWNIISMYIFVNMFVSLIIGNFSYVYRSGGSRSGINRSEIKKYIEAWSKFDTDGTGELELSYLPRIMHSFDGPLSFKIWEGRLTIKSLVENYMEVNPDDPYDVKIDLIGLNKELNTIDKAKIIQRKLQYRRFVQSIHYTNAYNGCIRFSDLLLQIPLYTAYSARECLGIDQYVHHLYILGKVDKYLENQRNFDVLEMVVTRWKFHCRMKRTIEPEWDVKDPTVSSHISNINVNLEPAPGILEREPIATPRMDYGVNNFMWSPRMNQDSTMEPPEEPIDNNDDSANDLIDR

SEQ ID NO: 21995 - protein, 1084 aa, Saccharomyces cerevisiae
MEGILDFSNDLDIALLDQVVSTFYQGSGVQQKQAQEILTKFQDNPDAWQKADQILQFSTNPQSKFIALSILDKLITRKWKLLPNDHRIGIRNFVVGMIISMCQDDEVFKTQKNLINKSDLTLVQILKQEWPQNWPEFIPELIGSSSSSVNVCENNMIVLKLLSEEVFDFSAEQMTQAKALHLKNSMSKEFEQIFKLCFQVLEQGSSSSLIVATLESLLRYLHWIPYRYIYETNILELLSTKFMTSPDTRAITLKCLTEVSNLKIPQDNDLIKRQTVLFFQNTLQQIATSVMPVTADLKATYANANGNDQSFLQDLAMFLTTYLARNRALLESDESLRELLLNAHQYLIQLSKIEERELFKTTLDYWHNLVADLFYEVQRLPATEMSPLIQLSVGSQAISTGSGALNPEYMKRFPLKKHIYEEICSQLRLVIIENMVRPEEVLVVENDEGEIVREFVKESDTIQLYKSEREVLVYLTHLNVIDTEEIMISKLARQIDGSEWSWHNINTLSWAIGSISGTMSEDTEKRFVVTVIKDLLDLTVKKRGKDNKAVVASDIMYVVGQYPRFLKAHWNFLRTVILKLFEFMHETHEGVQDMACDTFIKIVQKCKYHFVIQQPRESEPFIQTIIRDIQKTTADLQPQQVHTFYKACGIIISEERSVAERNRLLSDLMQLPNMAWDTIVEQSTANPTLLLDSETVKIIANIIKTNVAVCTSMGADFYPQLGHIYYNMLQLYRAVSSMISAQVAAEGLIATKTPKVRGLRTIKKEILKLVETYISKARNLDDVVKVLVEPLLNAVLEDYMNNVPDARDAEVLNCMTTVVEKVGHMIPQGVILILQSVFECTLDMINKDFTEYPEHRVEFYKLLKVINEKSFAAFLELPPAAFKLFVDAICWAFKHNNRDVEVNGLQIALDLVKNIERMGNVPFANEFHKNYFFIFVSETFFVLTDSDHKSGFSKQALLLMKLISLVYDNKISVPLYQEAEVPQGTSNQVYLSQYLANMLSNAFPHLTSEQIASFLSALTKQYKDLVVFKGTLRDFLVQIKEVGGDPTDYLFAEDKENALMEQNRLEREKAAKIGGLLKPSELDD

SEQ ID NO: 21996 - protein, 505 aa, Saccharomyces cerevisiae
MDLFKRKVKEWVYSLSTDDHYAEYNPDETPTFNMGKRLNSNNGQVNPSQMHLNSVDEEMSMGFQNGVPSNEDINIDEFTSTESNDGVSETLLAWRHIDFWTSEHNPDLNATLSDPCTQNDITHAEEDLEVSFPNPVKASFKIHDGQEDLESMTGTSGLFYGFQLMTLDQVVAMTQAWRNVAKNLNKRSQQGLSHVTSTGSSSSMERLNGNKFKLPNIPDQKSIPPNAVQPVYAHPAWIPLITDNAGNHIGVDLAPGPNGKYAQIITFGRDFDTKFVIAENWGEFLLSFANDLEAGNWYLVDDNDDYFSGDGELVFRDKKSNGPIQDYFEVLKRRTWIKYQENLRSQQQKSQPDTSLQEQKYVPASQKKVAAEQPSTLNAESIKGEDSGSADVQSVQDHESVKIVKTEPSEAETTTVNTESLGQAEHEIKADNVDIKQESERKEDEKQPKVEEKEHVENEHVTESAKKDDDVNKQTEEMNKKEENEIRSDDAKVEEAREEFENIAL

SEQ ID NO: 21997 - protein, 1178 aa, Saccharomyces cerevisiae
MKFGKYLEARQLELAEYNSHFIDYKALKKLIKQLAIPTLKASSDLDLHLTLDDIDEKIIHQRLQENKAAFFFKLERELEKVNGYYLARESDLRIKFNILHSKYKDYKINGKLNSNQATSFKNLYAAFKKFQKDLRNLEQYVELNKTGFSKALKKWDKRSQSHDKDFYLATVVSIQPIFTRDGPLKLNDETLHILLELNDIDNNNRRADIQSSTFTNDDDDDNNTSNNNKHNNNNNNNNNNNNNNNNNNILHNNYELTTSKISENQLEHLFQASSSSLDMEMEIENWYKEILNIATVKDVQRKHALLRNFRETKIFTYLLQNSSESFHKNVFSLLKECLTTLFLLLVASPLDDNSLHIFYKSNQDHIDLSYCDEDDQVFSRKNVFHEAASCPEKSRLFILDEALTTSKLSKETVQKLLNAQDIHSRVPLHYAAELGKLEFVHSLLITNLLEDVDPIDSDSKTPLVLAITNNHIDVVRDLLTIGGANASPIEKPILDYSKNVISSTKVQFDPLNVACKFNNHDAAKLLLEIRSKQNADNAKNKSSQHLCQPLFKKNSTGLCTLHIVAKIGGDPQLIQLLIRYGADPNEIDGFNKWTPIFYAVRSGHSEVITELLKHNARLDIEDDNGHSPLFYALWESHVDVLNALLQRPLNLPSAPLNEINSQSSTQRLNTIDLTPNDDKFDLDIQDSIPDFALPPPIIPLRKYGHNFLEKKIFIKLKLRPGLESIKLTQDNGIIMSSSPGRITLSSNLPEIIPRNVILPVRSGEINNFCKDISETNDEEDDDEISEDHDDGEIIFQVDSIDDFSMDFEIFPSFGTRIIAKTTAMPFLFKKVAINSIATMNLPLFDTRLNNIGSLTLDYQIIFPYPGNPLKIINYEPYWKSTGSDLMTSSKDGNFVTSSSLNGSFISVLVCALNDETIVAAPKPYVEFKGTKILLNDLTKEQLEKVVDYDFGKIDGSFDEVTLKQYLSSRVVPLRSLLEVIPGSAQLVIRVYFPTDKEIDTIPIKISPFININQFIDKLLLIIFEHERFLRHSGSGSMRQIVFSSCNWEACSILNWKQPNFPVLLQMKNLLRDSTTGKFVGDTPNCLKELAVNPQKMSYLNTELINIHTMVQFAMNNNLLGVTLPYEVLKICPSLARIIKQNGLLLIASVGENDQIPADGGYSGIYYACELLFENNIDM

SEQ ID NO: 21998 - protein, 987 aa, Saccharomyces cerevisiae
MQSQDSCYGVAFRSIITNDEALFKKTIHFYHTLGFATVKDFNKFKHGENSLLSSGTSQDSLREVWLESFKLSEVDASGFRIPQQEATNKAQSQGALLKIRLVMSAPIDETFDTNETATITYFSTDLNKIVEKFPKQAEKLSDTLVFLKDPMGNNITFSGLANATDSAPTSKDAFLEATSEDEIISRASSDASDLLRQTLGSSQKKKKIAVMTSGGDSPGMNAAVRAVVRTGIHFGCDVFAVYEGYEGLLRGGKYLKKMAWEDVRGWLSEGGTLIGTARSMEFRKREGRRQAAGNLISQGIDALVVCGGDGSLTGADLFRHEWPSLVDELVAEGRFTKEEVAPYKNLSIVGLVGSIDNDMSGTDSTIGAYSALERICEMVDYIDATAKSHSRAFVVEVMGRHCGWLALMAGIATGADYIFIPERAVPHGKWQDELKEVCQRHRSKGRRNNTIIVAEGALDDQLNPVTANDVKDALIELGLDTKVTILGHVQRGGTAVAHDRWLATLQGVDAVKAVLEFTPETPSPLIGILENKIIRMPLVESVKLTKSVATAIENKDFDKAISLRDTEFIELYENFLSTTVKDDGSELLPVSDRLNIGIVHVGAPSAALNAATRAATLYCLSHGHKPYAIMNGFSGLIQTGEVKELSWIDVENWHNLGGSEIGTNRSVASEDLGTIAYYFQKNKLDGLIILGGFEGFRSLKQLRDGRTQHPIFNIPMCLIPATVSNNVPGTEYSLGVDTCLNALVNYTDDIKQSASATRRRVFVCEVQGGHSGYIASFTGLITGAVSVYTPEKKIDLASIREDITLLKENFRHDKGENRNGKLLVRNEQASSVYSTQLLADIISEASKGKFGVRTAIPGHVQQGGVPSSKDRVTASRFAVKCIKFIEQWNKKNEASPNTDAKVLRFKFDTHGEKVPTVEHEDDSAAVICVNGSHVSFKPIANLWENETNVELRKGFEVHWAEYNKIGDILSGRLKLRAEVAALAAENK

SEQ ID NO: 21999 - protein, 427 aa, Saccharomyces cerevisiae
MYSRKSLSLISKCGQLSRLNAQAALQARRHLSIHEYRSAQLLREYGIGTPEGFPAFTPEEAFEAAKKLNTNKLVIKAQALTGGRGKGHFDTGYKSGVHMIESPQQAEDVAKEMLNHNLITKQTGIAGKPVSAVYIVKRVDTKHEAYLSILMDRQTKKPMIIASSQGGMNIEEVAERTPDAIKKFSIETSKGLSPQMAKDVAKSLGFSPDAQDEAAKAVSNLYKIFMERDATQVEINPLSEIEHDPTHKIMCTDAKFGFDDNASFRQEKIYSWRDLSQEDPDEVKAKKYDLNFVKLKGNIGCLVNGAGLAMATMDVIKLNGGDPANFLDCGGGATPETIKQGFELILSNKNVDAIFVNIFGGIVRCDYVALGLVEAARELEVRVPIVARLQGTKVEEGRDIINKSGVKIYSFDELDPAAKKVVELTQN

SEQ ID NO: 22000 - protein, 260 aa, Saccharomyces cerevisiae
MFLTRSEYDRGVSTFSPEGRLFQVEYSLEAIKLGSTAIGIATKEGVVLGVEKRATSPLLESDSIEKIVEIDRHIGCAMSGLTADARSMIEHARTAAVTHNLYYDEDINVESLTQSVCDLALRFGEGASGEERLMSRPFGVALLIAGHDADDGYQLFHAEPSGTFYRYNAKAIGSGSEGAQAELLNEWHSSLTLKEAELLVLKILKQVMEEKLDENNAQLSCITKQDGFKIYDNEKTAELIKELKEKEAAESPEEADVEMS

SEQ ID NO: 22001 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 22002 - protein, 492 aa, Saccharomyces cerevisiae
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 22003 - protein, 366 aa, Saccharomyces cerevisiae
MSDRNTSNSLTLKERMLSAGAGSVLTSLILTPMDVVRIRLQQQQMIPDCSCDGAAEVPNAVSSGSKMKTFTNVGGQNLNNAKIFWESACFQELHCKNSSLKFNGTLEAFTKIASVEGITSLWRGISLTLLMAIPANMVYFSGYEYIRDVSPIASTYPTLNPLFCGAIARVFAATSIAPLELVKTKLQSIPRSSKSTKTWMMVKDLLNETRQEMKMVGPSRALFKGLEITLWRDVPFSAIYWSSYELCKERLWLDSTRFASKDANWVHFINSFASGCISGMIAAICTHPFDVGKTRWQISMMNNSDPKGGNRSRNMFKFLETIWRTEGLAALYTGLAARVIKIRPSCAIMISSYEISKKVFGNKLHQ

SEQ ID NO: 22004 - protein, 1031 aa, Saccharomyces cerevisiae
MGVHSFWDIAGPTARPVRLESLEDKRMAVDASIWIYQFLKAVRDQEGNAVKNSHITGFFRRICKLLYFGIRPVFVFDGGVPVLKRETIRQRKERRQGKRESAKSTARKLLALQLQNGSNDNVKNSTPSSGSSVQIFKPQDEWDLPDIPGFKYDKEDARVNSNKTFEKLMNSINGDGLEDIDLDTINPASAEFEELPKATQYLILSSLRLKSRLRMGYSKEQLETIFPNSMDFSRFQIDMVKRRNFFTQKLINTTGFQDGGASKLNEEVINRISGQKSKEYKLTKTNNGWILGLGANDGSDAQKAIVIDDKDAGALVKQLDSNAEDGDVLRWDDLEDNSLKIVRHESSNATTAPQKRSNRSEDEGCDSDECEWEEVELKPKNVKFVEDFSLKAARLPYMGQSLNNAGSKSFLDKRHDQASPSKTTPTMRISRISVEDDDEDYLKQIEEIEMMEAVQLSKMEKKPEADDKSKIAKPVTSKGTEARPPIVQYGLLGAQPDSKQPYHVTNLNSKSESVIKRTSKTVLSEFRPPSQQEDKGAILTEGEQNLNFISHKIPQFDFNNENSLLFQKNTESNVSQEATKEKSPIPEMPSWFSSTASQQLYNPYNTTNFVEDKNVRNEQESGAETTNKGSSYELLTGLNATEILERESEKESSNDENKDDDLEVLSEELFEDVPTKSQISKEAEDNDSRKVESINKEHRKPLIFDYDFSEDEEDNIVENMIKEQEEFDTFKNTTLSTSAERNVAENAFVEDELFEQQMKDKRDSDEVTMDMIKEVQELLSRFGIPYITAPMEAEAQCAELLQLNLVDGIITDDSDVFLFGGTKIYKNMFHEKNYVEFYDAESILKLLGLDRKNMIELAQLLGSDYTNGLKGMGPVSSIEVIAEFGNLKNFKDWYNNGQFDKRKQETENKFEKDLRKKLVNNEIILDDDFPSVMVYDAYMRPEVDHDTTPFVWGVPDLDMLRSFMKTQLGWPHEKSDEILIPLIRDVNKRKKKGKQKRINEFFPREYISGDKKLNTSKRISTATGKLKKRKM

SEQ ID NO: 22005 - protein, 534 aa, Saccharomyces cerevisiae
MSNKFTMESPKHLVDDVLFISPTNDGSEEKPTEVTFQEDEGHDASLHNRSHDKKSELATEREIMATTTDDDGIPSPSHPMEKRVLRKMDIYLIPLMGMLYFLSNLDKSNIGNAEVAGLSKDIHLVGTQYNTCVTVFFATYVLFDPIGTNLLKIMGPPLMMSICLTCFGAISLGTAWVKNYAQLIVVRLLLGAFEGMIYPAINMYLSVCYRREQYALRFAFVFSAACLSSSFGGLIAYGCSKISGSLKDWQYIYIVEGCISLGFVPFYAFGLSKNLEDSWFFNKEEKEYISERYKTMNTFDPDEKFEWFQVWQAVKDVKTWASAVALFGIDLTTFGLTVFLPIIITSMGFTNVRAQLMTVPIYFLTAIVFFICAVWSDRIKLRSPFILGACLTTSIGIAIVLGSQVHGVRYFGVYILCMGIYVNAACNCLWLSGNTGNYFKRATALGINLFFGSGSGLVSGQIFVAKDKPRYIKGLSISLAFQVFSIFMTVVQIFLYKRENDKKKAIIDRCNELGEPIPYDERLSDKNPEFKYMY

SEQ ID NO: 22006 - protein, 243 aa, Saccharomyces cerevisiae
MHNIQLVQEIERHETPLNIRPTSPYTLNPPVERDGFSWPSVGTRQRAEETEEEEKERIQRISGAIKTILTELGEDVNREGLLDTPQRYAKAMLYFTKGYQTNIMDDVIKNAVFEEDHDEMVIVRDIEIYSLCEHHLVPFFGKVHIGYIPNKKVIGLSKLARLAEMYARRLQVQERLTKQIAMALSDILKPLGVAVVMEASHMCMVSRGIQKTGSSTVTSCMLGGFRAHKTREEFLTLLGRRSI

SEQ ID NO: 22007 - protein, 1066 aa, Saccharomyces cerevisiae
MVKQQGSGKTNLANEDEAYEAIFGGEFGSLEIGSYIGGDEGANSKDYTEHLPDAVDFEDEDELADDDDDLPEESDANLHPAMMTMGAYDDVNENGAVLGIDSNSLNMQLPEINGDLSQQFILEDDGGTPATSNALFMGMDANEIHLATETGVLDGSGANEIGHSQLSIGGVNGNDMSINGGFIMEPDMSDGKHKKATKLDLINHEKYLLKKYFPDFEKGKILKWNKLIYRRSVPYHWHSEISRVKKPFMPLNLKFKVQQDDKRLFNSRTISYVAPIYQGKNNLLQSNSSASRRGLIHVSIDELFPIKEQQKKRKIIHDEKTISEDLLIATDDWDQEKIINQGTSSTATLADSSMTPNLKFSGGYKLKSLIEDVAEDWQWDEDMIIDAKLKESKHAELNMNDEKLLLMIEKTNNLAQQKQQLDSSNLILPLNETILQQKFNLSNDDKYQILKKTHQTKVRSTISNLNIQHSQPAINLQSPFYKVAVPRYQLRHFHRENFGSHIRPGTKIVFSKLKARKRKRDKGKDVKESFSTSQDLTIGDTAPVYLMEYSEQTPVALSKFGMANKLINYYRKANEQDTLRPKLPVGETHVLGVQDKSPFWNFGFVEPGHIVPTLYNNMIRAPVFKHDISGTDFLLTKSSGFGISNRFYLRNINHLFTVGQTFPVEEIPGPNSRKVTSMKATRLKMIIYRILNHNHSKAISIDPIAKHFPDQDYGQNRQKVKEFMKYQRDGPEKGLWRLKDDEKLLDNEAVKSLITPEQISQVESMSQGLQFQEDNEAYNFDSKLKSLEENLLPWNITKNFINSTQMRAMIQIHGVGDPTGCGEGFSFLKTSMKGGFVKSGSPSSNNNSSNKKGTNTHSYNVAQQQKAYDEEIAKTWYTHTKSLSISNPFEEMTNPDEINQTNKHVKTDRDDKKILKIVRKKRDENGIIQRQTIFIRDPRVIQGYIKIKEQDKEDVNKLLEEDTSKINNLEELEKQKKLLQLELANLEKSQQRRAARQNSKRNGGATRTENSVDNGSDLAGVTDGKAARNKGKNTTRRCATCGQIGHIRTNKSCPMYSSKDNPASPK

SEQ ID NO: 22008 - protein, 553 aa, Saccharomyces cerevisiae
MQVEGPDTNFVSDLALGSKKRRLSKTSVQEDDHTNVVSEVNKNKKKKKAKPMTCTLLKSVVEKGIGIKDVRDMTQYLLQAENNSPKWIDICNRSSLQKMIVLFIPGLQPDDFENGKNTFNEISDDNFKYIPGEIASTFHTFPVMAPGSKMTLFSPYNSFINVGLSKMEKINKLKELQKKKKITINDLVLSEQQLVANDYPLDSGDTNFDTDWVQTVDFTHGGSHIFALDCEMCLSEQGLVLTRISLVNFDNEVIYEELVKPDVPIVDYLTRYSGITEEKLTVGAKKTLREVQKDLLKIISRSDILIGHSLQNDLKVMKLKHPLVVDTAIIYHHKAGDPFKPSLKYLSETFLNKSIQNGEHDSVEDARACLELTKLKILNGLAFGIGINTENLFTKLHRFEVKTVLLNDMIIKNHTEDDSKGQLIRCVEDDETWTHIHENLNKDVKLIVGRIKNLERSRNYNKKPRKETPSFDASMVLHDIGQHLTQLYENATPGTMILIMSGTGDTRPWNNLSTELEFIQDKKERLDKRREREPEIVEAIKLARGGVASFTVK

SEQ ID NO: 22009 - protein, 1477 aa, Saccharomyces cerevisiae
MTITVGDAVSETELENKSQNVVLSPKASASSDISTDVDKDTSSSWDDKSLLPTGEYIVDRNKPQTYLNSDDIEKVTESDIFPQKRLFSFLHSKKIPEVPQTDDERKIYPLFHTNIISNMFFWWVLPILRVGYKRTIQPNDLFKMDPRMSIETLYDDFEKNMIYYFEKTRKKYRKRHPEATEEEVMENAKLPKHTVLRALLFTFKKQYFMSIVFAILANCTSGFNPMITKRLIEFVEEKAIFHSMHVNKGIGYAIGACLMMFVNGLTFNHFFHTSQLTGVQAKSILTKAAMKKMFNASNYARHCFPNGKVTSFVTTDLARIEFALSFQPFLAGFPAILAICIVLLIVNLGPIALVGIGIFFGGFFISLFAFKLILGFRIAANIFTDARVTMMREVLNNIKMIKYYTWEDAYEKNIQDIRTKEISKVRKMQLSRNFLIAMAMSLPSIASLVTFLAMYKVNKGGRQPGNIFASLSLFQVLSLQMFFLPIAIGTGIDMIIGLGRLQSLLEAPEDDPNQMIEMKPSPGFDPKLALKMTHCSFEWEDYELNDAIEEAKGEAKDEGKKNKKKRKDTWGKPSASTNKAKRLDNMLKDRDGPEDLEKTSFRGFKDLNFDIKKGEFIMITGPIGTGKSSLLNAMAGSMRKTDGKVEVNGDLLMCGYPWIQNASVRDNIIFGSPFNKEKYDEVVRVCSLKADLDILPAGDMTEIGERGITLSGGQKARINLARSVYKKKDIYLFDDVLSAVDSRVGKHIMDECLTGMLANKTRILATHQLSLIERASRVIVLGTDGQVDIGTVDELKARNQTLINLLQFSSQNSEKEDEEQEAVVAGELGQLKYESEVKELTELKKKATEMSQTANSGKIVADGHTSSKEERAVNSISLKIYREYIKAAVGKWGFIALPLYAILVVGTTFCSLFSSVWLSYWTENKFKNRPPSFYMGLYSFFVFAAFIFMNGQFTILCAMGIMASKWLNLRAVKRILHTPMSYIDTTPLGRILNRFTKDTDSLDNELTESLRLMTSQFANIVGVCVMCIVYLPWFAIAIPFLLVIFVLIADHYQSSGREIKRLEAVQRSFVYNNLNEVLGGMDTIKAYRSQERFLAKSDFLINKMNEAGYLVVVLQRWVGIFLDMVAIAFALIITLLCVTRAFPISAASVGVLLTYVLQLPGLLNTILRAMTQTENDMNSAERLVTYATELPLEASYRKPEMTPPESWPSMGEIIFENVDFAYRPGLPIVLKNLNLNIKSGEKIGICGRTGAGKSTIMSALYRLNELTAGKILIDNVDISQLGLFDLRRKLAIIPQDPVLFRGTIRKNLDPFNERTDDELWDALVRGGAIAKDDLPEVKLQKPDENGTHGKMHKFHLDQAVEEEGSNFSLGERQLLALTRALVRQSKILILDEATSSVDYETDGKIQTRIVEEFGDCTILCIAHRLKTIVNYDRILVLEKGEVAEFDTPWTLFSQEDSIFRSMCSRSGIVENDFENRS

SEQ ID NO: 22010 - protein, 313 aa, Saccharomyces cerevisiae
MRFSTTLATAATALFFTASQVSAIGELAFNLGVKNNDGTCKSTSDYETELQALKSYTSTVKVYAASDCNTLQNLGPAAEAEGFTIFVGVWPTDDSHYAAEKAALQTYLPKIKESTVAGFLVGSEALYRNDLTASQLSDKINDVRSVVADISDSDGKSYSGKQVGTVDSWNVLVAGYNSAVIEASDFVMANAFSYWQGQTMQNASYSFFDDIMQALQVIQSTKGSTDITFWVGETGWPTDGTNFESSYPSVDNAKQFWKEGICSMRAWGVNVIVFEAFDEDWKPNTSGTSDVEKHWGVFTSSDNLKYSLDCDFS

SEQ ID NO: 22011 - protein, 589 aa, Saccharomyces cerevisiae
MTISSAHPETEPKWWKEATFYQIYPASFKDSNDDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWKSYFGGSAWTFDEKTQEFYLRLFCSTQPDLNWENEDCRKAIYESAVGYWLDHGVDGFRIDVGSLYSKVVGLPDAPVVDKNSTWQSSDPYTLNGPRIHEFHQEMNQFIRNRVKDGREIMTVGEMQHASDETKRLYTSASRHELSELFNFSHTDVGTSPLFRYNLVPFELKDWKIALAELFRYINGTDCWSTIYLENHDQPRSITRFGDDSPKNRVISGKLLSVLLSALTGTLYVYQGQELGQINFKNWPVEKYEDVEIRNNYNAIKEEHGENSEEMKKFLEAIALISRDHARTPMQWSREEPNAGFSGPSAKPWFYLNDSFREGINVEDEIKDPNSVLNFWKEALKFRKAHKDITVYGYDFEFIDLDNKKLFSFTKKYNNKTLFAALNFSSDATDFKIPNDDSSFKLEFGNYPKKEVDASSRTLKPWEGRIYISE

SEQ ID NO: 22012 - protein, 616 aa, Saccharomyces cerevisiae
MKNIISLVSKKKAASKNEDKNISESSRDIVNQQEVFNTEDFEEGKKDSAFELDHLEFTTNSAQLGDSDEDNENVINEMNATDDANEANSEEKSMTLKQALLKYPKAALWSILVSTTLVMEGYDTALLSALYALPVFQRKFGTLNGEGSYEITSQWQIGLNMCVLCGEMIGLQITTYMVEFMGNRYTMITALGLLTAYIFILYYCKSLAMIAVGQILSAIPWGCFQSLAVTYASEVCPLALRYYMTSYSNICWLFGQIFASGIMKNSQENLGNSDLGYKLPFALQWIWPAPLMIGIFFAPESPWWLVRKDRVAEARKSLSRILSGKGAEKDIQVDLTLKQIELTIEKERLLASKSGSFFNCFKGVNGRRTRLACLTWVAQNSSGAVLLGYSTYFFERAGMATDKAFTFSLIQYCLGLAGTLCSWVISGRVGRWTILTYGLAFQMVCLFIIGGMGFGSGSSASNGAGGLLLALSFFYNAGIGAVVYCIVAEIPSAELRTKTIVLARICYNLMAVINAILTPYMLNVSDWNWGAKTGLYWGGFTAVTLAWVIIDLPETTGRTFSEINELFNQGVPARKFASTVVDPFGKGKTQHDSLADESISQSSSIKQRELNAADKC

SEQ ID NO: 22013 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMTVGEVAHGSDNALYTSAARYEVSEVFSFTHVEVGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFLLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 22014 - protein, 546 aa, Saccharomyces cerevisiae
MEPLLFNSGKANPSQDVFIDVEVGDITTKYGSTNTGSFSSMDTVEAQAIKAETARFMEVPQGRHLGVFSTVVLFVSRIMGSGIFAVPSVILLNTGGNKLIYFAIWVFSAAIAFAGLYLFLEFGSWIPKSGGRKNFLERSFERPRLLISVVFSCYSVLTGYALTGSIVFGKYVLSAFGVTDDSWSKYVSISFIIFAVLIHGVSVRHGVFIQNALGGLKLIMIVLMCFAGLYTLFFYKSTGQVAWDLPVTQVEKDSLLSVSSIATAFISSFFCFSGWDTVHTVTSEIKNPVKTLKVSGPLSLIICFVCYTMMNVAYLKVLTYEEIVSAGPLVGSVLFTKLFGPRVGGKFIAFSIAISAASNILVVIYSISRVNQEIFKEGYLPFSIHMSKNWPFDAPLPSISLCGFITIAWILILPKEGESFNYLVSMDGYGNQFFLLLVAIGLFIWRFKHKNEVPEIRASTFGVLAIITLSLYMLMAPFFADPSLNRVGFLPPYQIMSLLVIVACFFFWLVKFVLLPKFFHYKLLPKITYLHDGLIVTEWVKKPCLC

SEQ ID NO: 22015 - protein, 709 aa, Saccharomyces cerevisiae
MFPSLFRLVVFSKRYIFRSSQRLYTSLKQEQSRMSKIMEDLRSDYVPLIASIDVGTTSSRCILFNRWGQDVSKHQIEYSTSASKGKIGVSGLRRPSTAPARETPNAGDIKTSGKPIFSAEGYAIQETKFLKIEELDLDFHNEPTLKFPKPGWVECHPQKLLVNVVQCLASSLLSLQTINSERVANGLPPYKVICMGIANMRETTILWSRRTGKPIVNYGIVWNDTRTIKIVRDKWQNTSVDRQLQLRQKTGLPLLSTYFSCSKLRWFLDNEPLCTKAYEENDLMFGTVDTWLIYQLTKQKAFVSDVTNASRTGFMNLSTLKYDNELLEFWGIDKNLIHMPEIVSSSQYYGDFGIPDWIMEKLHDSPKTVLRDLVKRNLPIQGCLGDQSASMVGQLAYKPGAAKCTYGTGCFLLYNTGTKKLISQHGALTTLAFWFPHLQEYGGQKPELSKPHFALEGSVAVAGAVVQWLRDNLRLIDKSEDVGPIASTVPDSGGVVFVPAFSGLFAPYWDPDARATIMGMSQFTTASHIARAAVEGVCFQARAILKAMSSDAFGEGSKDRDFLEEISDVTYEKSPLSVLAVDGGMSRSNEVMQIQADILGPCVKVRRSPTAECTALGAAIAANMAFKDVNERPLWKDLHDVKKWVFYNGMEKNEQISPEAHPNLKIFRSESDDAERRKHWKYWEVAVERSKGWLKDIEGEHEQVLENFQ

SEQ ID NO: 22016 - protein, 605 aa, Saccharomyces cerevisiae
MQTSMVSAKVSIWLVCSVICSSLVRATQSVCSSQNTATTDGVRNQFQSNGWCSNNCAGHQFAIVQGFMCWCSDSEPSTQTSVGDCSGTCPGYGYEDCGNADKDLFGYIYLGQTPLSSVQSVETSTESSVYVSSSSITSSSSTSIVDTTTISPTLTSTSTTPLTTASTSTTPSTDITSALPTTTSTKLSTSIPTSTTSSTSTTTSTSSSTSTTVSVTSSTSTTTSTTSSTLISTSTSSSSSSTPTTTSSAPISTSTTSSTSTSTSTTSPTSSSAPTSSSNTTPTSTTFTTTSPSTAPSSTTVTYTSTTASPITSTITSVNLQTSLKYSVITVTSVHTMDTNISEITSRYLTMKKVITQIYSSTLGATPTSAVATTSASVGGRITNNNNSNTTNSNTPTNKSTEKKGYWDSPGKIAATFVVVGVVCLVIICILIYLIHHYRTRPARKAQDFENEYQSKFYQSKYPNEVTTTTLHTPSPSSNSTFSTPRLIYTDEKGQIMSESPSPRQSTYSLTAGSPPNDPSTLASPFHDPILPRRTSTFLHSPIQKQHEKMESNVTLGEDTVLVDQRLDPSKMLNTLANDDATNHSTISLSDNVDYSRRVLRLMNE

SEQ ID NO: 22017 - protein, 493 aa, Saccharomyces cerevisiae
MTVFSGVNKIEFEGTFEGIGKDVVMSQMIRALQKHFPSIRDKNYEFSLFLHIFQRYVLENTSITHDLVCDKIRLPIIDEVVELDDIKNYGLLEGKLLSKLAILKLTGKANPIIGKESPLFEVKNGMSSLDVIVRQTQNLNVRYNSDVPLIFMTSLETESQVSNFLEEHYSSSKVRWKTVVQSSFPQIDKDRLLPIDLQINSHENDFWYPCGTGNLTDTLYFSGELDKLIAQGKEILFVSNVDNLGATGDLNILNFIINEKIEYLVEVVERTANVSNTGVLATYKGKLRSVYYNCLSNESASTCRIVNTNNIWIDLKKLKVLIESNSLNLPIHSSESKITHKNEEIECLQFKTQLVDCIAFFPNSRVLKVSRDRFLPLRTCKDLFLLKSTLYDLDSNGTFNLYPLKFGLLPSIDLGDEFATYETFKIGVPDIPNILELEHLTVMGNVFFGRNITLKGTVIIICDENDVITVPDGSILENVTIWHKSQLEDMNGY

SEQ ID NO: 22018 - protein, 320 aa, Saccharomyces cerevisiae
MPTNSIKLLAPDVHRGLAELVAKRLGLQLTSSKLKRDPTGEVSFSIGESVRDQDIFIITQIGSGVVNDRVLELLIMINASKTASARRITAIIPNFPYARQDRKDKSRAPITAKLMADMLTTAGCDHVITMDLHASQIQGFFDVPVDNLYAEPSVVRYIKENVNYMDSIIISPDAGGAKRAATLADRLDLNFALIHKERARANEVSRMVLVGDVTDKICIIVDDMADTCGTLAKAAEILLENRAKSVIAIVTHGVLSGRAIENINNSKLDRVVCTNTVPFEEKIKKCPKLAVIDISSVLAESIRRLHNGESISYLFKNYPL

SEQ ID NO: 22019 - protein, 939 aa, Saccharomyces cerevisiae
MSNDPSAVSELPDKDSLDNGISNDNERAMGGNGDGGDGLRLPRTTGTLNVNALQKGTNAAHEAGGYKSMDPAKNAETTNDDDNNVVSLDDPIQFTRVSSSSVISGMSSSMSPHSNIDETKSLEAVTPNINTSNITPDHSADNTFSTINASESDHQFNDTLLSKLSLTDSTETIENNATVKHQQPVASSTVNSNKSSTDIRRATPVSTPVISKPSMTTTPRQINSASHSLSNPKHKQHKPKVKPSKPEAKSKPVSVKKSFPSKNPLKNSSPPKKQTEKSYYSSSSKKRKSGSNSGTLRMKDVFTSFVQNIKRNSQDDKRASSSSNNSSSSSITTALRISTPYNAKHIHHVGVDSKTGEYTGLPEEWEKLLTSSGISKREQQQNMQAVMDIVKFYQDVTETNGEDKMFKTFNTTTGLPGSPQVSTPPANSFNKFPPSTSDSHNYGSRTGTPMSNHVMSPTLNTDSSSANGKFIPSRPAPKPPSSASASAPIIKSPVMNSAANVSPLKQTHAPTTPNRTSPNRSSISRNATLKKEEQPLPPIPPTKSKTSPIISTAHTPQQVAQSPKAPAQETVTTPTSKPAQARSLSKELNEKKREERERRKKQLYAKLNEICSDGDPSTKYANLVKIGQGASGGVYTAYEIGTNVSVAIKQMNLEKQPKKELIINEILVMKGSKHPNIVNFIDSYVLKGDLWVIMEYMEGGSLTDVVTHCILTEGQIGAVCRETLSGLEFLHSKGVLHRDIKSDNILLSMEGDIKLTDFGFCAQINELNLKRTTMVGTPYWMAPEVVSRKEYGPKVDIWSLGIMIIEMIEGEPPYLNETPLRALYLIATNGTPKLKEPENLSSSLKKFLDWCLCVEPEDRASATELLHDEYITEIAEANSSLAPLVKLARLKKVAENMDADEDNDDDNDNEHINKTNNCDDNNDSKETVNLDVTEDDKQK

SEQ ID NO: 22020 - protein, 357 aa, Saccharomyces cerevisiae
MTRDSPDSNDSYKHINKNTTQKTSFDRNSFDYIVRSGLAGGISGSCAKTLIAPLDRIKILFQTSNPHYTKYTGSLIGLVEAAKHIWINDGVRGFFQGHSATLLRIFPYAAVKFVAYEQIRNTLIPSKEFESHWRRLVSGSLAGLCSVFITYPLDLVRVRLAYETEHKRVKLGRIIKKIYKEPASATLIKNDYIPNWFCHWCNFYRGYVPTVLGMIPYAGVSFFAHDLLHDVLKSPFFAPYSVLELSEDDELERVQKKQRRPLRTWAELISGGLAGMASQTAAYPFEIIRRRLQVSALSPKTMYDHKFQSISEIAHIIFKERGVRGFFVGLSIGYIKVTPMVACSFFVYERMKWNFGI

SEQ ID NO: 22021 - protein, 472 aa, Saccharomyces cerevisiae
MGCTVSTQTIGDESDPFLQNKRANDVIEQSLQLEKQRDKNEIKLLLLGAGESGKSTVLKQLKLLHQGGFSHQERLQYAQVIWADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDADRNNSSRINLQDICKDLNQEGDDQMFVRKTSREIQGQNRRNLIHEDIAKAIKQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKIGII

SEQ ID NO: 22022 - protein, 530 aa, Saccharomyces cerevisiae
MSATKSIVGEALEYVNIGLSHFLALPLAQRISLIIIIPFIYNIVWQLLYSLRKDRPPLVFYWIPWVGSAVVYGMKPYEFFEECQKKYGDIFSFVLLGRVMTVYLGPKGHEFVFNAKLADVSAEAAYAHLTTPVFGKGVIYDCPNSRLMEQKKFVKGALTKEAFKSYVPLIAEEVYKYFRDSKNFRLNERTTGTIDVMVTQPEMTIFTASRSLLGKEMRAKLDTDFAYLYSDLDKGFTPINFVFPNLPLEHYRKRDHAQKAISGTYMSLIKERRKNNDIQDRDLIDSLMKNSTYKDGVKMTDQEIANLLIGVLMGGQHTSAATSAWILLHLAERPDVQQELYEEQMRVLDGGKKELTYDLLQEMPLLNQTIKETLRMHHPLHSLFRKVMKDMHVPNTSYVIPAGYHVLVSPGYTHLRDEYFPNAHQFNIHRWNKDSASSYSVGEEVDYGFGAISKGVSSPYLPFGGGRHRCIGEHFAYCQLGVLMSIFIRTLKWHYPEGKTVPPPDFTSMVTLPTGPAKIIWEKRNPEQKI

SEQ ID NO: 22023 - protein, 238 aa, Saccharomyces cerevisiae
MPINIRRATINDIICMQNANLHNLPENYMMKYYMYHILSWPEASFVATTTTLDCEDSDEQDENDKLELTLDGTNDGRTIKLDPTYLAPGEKLVGYVLVKMNDDPDQQNEPPNGHITSLSVMRTYRRMGIAENLMRQALFALREVHQAEYVSLHVRQSNRAALHLYRDTLAFEVLSIEKSYYQDGEDAYAMKKVLKLEELQISNFTHRRLKENEEKLEDDLESDLLEDIIKQGVNDIIV

SEQ ID NO: 22024 - protein, 463 aa, Saccharomyces cerevisiae
MSDGTQKLWGGRFTGETDPLMHLYNASLPYDYKMYKADLEGTKVYTAGLQKLGLLTETELAKIHEGLAEIKKEWDADKFVRHPNDEDIHTANERRLGELIGRDIAGKVHTGRSRNDQVVTDLRIYCRDIVNDTLFPALKGLVEVLIKRAEGEIDVLMPGYTHLQRAQPIRWSHWLSSYATYFTEDYKRLGQILHRLNQSPLGAGALAGHPYGIDREFLAEGLGFNSVIGNSLVAVSDRDFIVELMFWGTLFMNHISRFAEDLIIYCTAEFGFIQLSDAYSTGSSLMPQKKNADSLELLRGKSGRVFGDLTGFLMSLKGIPSTYDKDMQEDKEPLFDCLTTVEHSMLIATGVISTLTVNKEKMEAALTMDMLATDLADYLVRKGVPFRETHHISGECVATAERLGLSGIDKLTLEQYQKIDSRFGQDLFETFNFEQSVERRDATGGTAKSAVLKQLDNLKSQLN

SEQ ID NO: 22025 - protein, 1928 aa, Saccharomyces cerevisiae
MTGGQSCSSNMIVWIPDEKEVFVKGELMSTDINKNKFTGQEEQIGIVHPLDSTEVSNLVQVRISDVFPVNPSTFDKVENMSELTHLNEPSVLYNLEKRYDCDLIYTYSGLFLVAINPYHNLNLYSEDHINLYHNKHNRLSKSRLDENSHEKLPPHIFAIAEEAYENLLSEGKDQSILVTGESGAGKTENTKKILQYLASITSGSPSNIAPVSGSSIVESFEMKILQSNPILESFGNAQTVRNNNSSRFGKFIKIEFNEHGMINGAHIEWYLLEKSRIVHQNSKERNYHIFYQLLSGLDDSELKNLRLKSRNVKDYKILSNSNQDIIPGINDVENFKELLSALNIIGFSKDQIRWIFQVVAIILLIGNIEFVSDRAEQASFKNDVSAICSNLGVDEKDFQTAILRPRSKAGKEWVSQSKNSQQAKFILNALSRNLYERLFGYIVDMINKNLDHGSATLNYIGLLDIAGFEIFENNSFEQLCINYTNEKLQQFFNNHMFVLEQSEYLKENIQWDYIDYGKDLQLTIDLIESKGPPTGVLPLLDEEAVLPKSTDESFYSKLISTWDQNSSKFKRSRLKNGFILKHYAGDVEYTVEGWLSKNKDPLNDNLLSLLSSSQNDIISKLFQPEGEKSSSAGVEANISNQEVKKSARTSTFKTTSSRHREQQITLLNQLASTHPHFVRCIIPNNVKKVKTFNRRLILDQLRCNGVLEGIRLAREGYPNRIAFQEFFQRYRILYPENSTTTTFSSKLKASTKQNCEFLLTSLQLDTKVYKIGNTKLFFKAGVLADLEKQKDVKLNNIMIKLTATIRGYTVRKEITYHLQKLKKTRVIGNTFRLYNRLVKEDPWFNLFIRIKPLLTSSNDMTRTKKFNEQINKLKNDLQEMESKKKFLEEKNQKTVNELENTQDLLNQEKENLRKNESLLNRVKTSSETLQKQFDDLVSEKDEISREKLEVAQNLEEAHQKIQGLQETIREREATLEKLHSKNNELIKQISDLNCDISKEQSSQSLIKESKLKLENEIKRLKDVINSKEEEIKSFNDKLSSSEEDLDIKLVTLEKNCNIAMSRLQSLVTENSDLRSKNENFKKEKAALNNQLKNKESELLKMKEKIDNHKKELATFSKQRDDAVSEHGKITAELKETRIQLTEYKSNYQKIKEEYSNFQRETKEQEQKKRNSLVESLNDSKIKELEARLSQEISLNQYLNKRISGNSVETNISSTRRSTSYSDDPLDKEDIIKKYYDLQLAFTEITRNLENEIEEKKNLISRLRFTETRLASSSFEDQKIKAQMKKLKKLIQDMDPSIPLDSILNEPLDNCPDKESDINKLMLEVDYLKRQLDIETRAHYDAENAISALHSKFRKIQGESSLSSSDIYKLKFEASEERVKSLEDKLKTMPLRDRTNLPVGDIIKNRDSISKYEEEIRYYKLENYKLQEILNESNGKLSQLTLDLRQSKSKEALLSEQLDRLQKDLESTERQKELLSSTIKQQKQQFENCMDDLQGNELRLREHIHALKQAEEDVKNMASIIEKLKTQNKQKEKLIWEREMERNDSDMQLQETLLELKRVQDVKKILSDDLAHLKERLSAVEDRSQYTDEINRLKEELNCSLKAETNLKKEFATLKYKLETSTNDSEAKISDLLKQLDHYTKVVEMLNNEKDAISLAEKELYQKYEALNTECESLKGKIVSLTKIKQELESDLNQKTDALQISNAALSSSTQKNKEITEKIKYLEETLQLQMEQNSRNGELVKTLQASCNGYKDKFDDEKQKNIDLYEENQTLQKLNTDLQLQLKNLHERLSDTTEKNAWLSKIHELENMVSLETDLKYEEMKKNKSLERAVEELQTKNSQQTDVIELANKNRSEFEEATLKYEAQISDLEKYISQQELEMKKSIRDNSSYRDKVQEMAQEIEFWKSRYESTMIGSKNIDSNNAQSKIFS

SEQ ID NO: 22026 - protein, 482 aa, Saccharomyces cerevisiae
MLRNGVQRLYSNIARTDNFKLSSLANGLKVATSNTPGHFSALGLYIDAGSRFEGRNLKGCTHILDRLAFKSTEHVEGRAMAETLELLGGNYQCTSSRENLMYQASVFNQDVGKMLQLMSETVRFPKITEQELQEQKLSAEYEIDEVWMKPELVLPELLHTAAYSGETLGSPLICPRELIPSISKYYLLDYRNKFYTPENTVAAFVGVPHEKALELTEKYLGDWQSTHPPITKKVAQYTGGESCIPPAPVFGNLPELFHIQIGFEGLPIDHPDIYALATLQTLLGGGGSFSAGGPGKGMYSRLYTHVLNQYYFVENCVAFNHSYSDSGIFGISLSCIPQAAPQAVEVIAQQMYNTFANKDLRLTEDEVSRAKNQLKSSLLMNLESKLVELEDMGRQVLMHGRKIPVNEMISKIEDLKPDDISRVAEMIFTGNVNNAGNGKGRATVVMQGDRGSFGDVENVLKAYGLGNSSSSKNDSPKKKGWF

SEQ ID NO: 22027 - protein, 213 aa, Saccharomyces cerevisiae
MNKESKDDDMSLGKFSFSHFLYYLVLIVVIVYGLYKLFTGHGSDINFGKFLLRTSPYMWANLGIALCVGLSVVGAAWGIFITGSSMIGAGVRAPRITTKNLISIIFCEVVAIYGLIIAIVFSSKLTVATAENMYSKSNLYTGYSLFWAGITVGASNLICGIAVGITGATAAISDAADSALFVKILVIEIFGSILGLLGLIVGLLMAGKASEFQ

SEQ ID NO: 22028 - protein, 993 aa, Saccharomyces cerevisiae
MVDESDKKQQTIDEQSQISPEKQTPNKKDKKKEEEEQLSEEDAKLKTDLELLVERLKEDDSSLYEASLNALKESIKNSTSSMTAVPKPLKFLRPTYPDLCSIYDKWTDPNLKSSLADVLSILAMTYSENGKHDSLRYRLLSDVSDFEGWGHEYIRHLALEIGEVYNDQVEKDAEDETSSDGSKSDGSAATSGFEFSKEDTLRLCLDIVPYFLKHNGEEDAVDLLLEIESIDKLPQFVDENTFQRVCQYMVACVPLLPPPEDVAFLKTAYSIYLSQNELTDAIALAVRLGEEDMIRSVFDATSDPVMHKQLAYILAAQKTSFEYEGVQDIIGNGKLSEHFLYLAKELNLTGPKVPEDIYKSHLDNSKSVFSSAGLDSAQQNLASSFVNGFLNLGYCNDKLIVDNDNWVYKTKGDGMTSAVASIGSIYQWNLDGLQQLDKYLYVDEPEVKAGALLGIGISASGVHDGEVEPALLLLQDYVTNPDTKISSAAILGLGIAFAGSKNDEVLGLLLPIAASTDLPIETAAMASLALAHVFVGTCNGDITTSIMDNFLERTAIELKTDWVRFLALALGILYMGQGEQVDDVLETISAIEHPMTSAIEVLVGSCAYTGTGDVLLIQDLLHRLTPKNVKGEEDADEEETAEGQTNSISDFLGEQVNEPTKNEEAEIEVDEMEVDAEGEEVEVKAEITEKKNGESLEGEEIKSEEKKGKSSDKDATTDGKNDDEEEEKEAGIVDELAYAVLGIALIALGEDIGKEMSLRHFGHLMHYGNEHIRRMVPLAMGIVSVSDPQMKVFDTLTRFSHDADLEVSMNSIFAMGLCGAGTNNARLAQLLRQLASYYSREQDALFITRLAQGLLHLGKGTMTMDVFNDAHVLNKVTLASILTTAVGLVSPSFMLKHHQLFYMLNAGIRPKFILALNDEGEPIKVNVRVGQAVETVGQAGRPKKITGWITQSTPVLLNHGERAELETDEYISYTSHIEGVVILKKNPDYREEE

SEQ ID NO: 22029 - protein, 818 aa, Saccharomyces cerevisiae
MEGGEEEVERIPDELFDTKKKHLLDKLIRVGIILVLLIWGTVLLLKSIPHHSNTPDYQEPNSNYTNDGKLKVSFSVVRNNTFQPKYHELQWISDNKIESNDLGLYVTFMNDSYVVKSVYDDSYNSVLLEGKTFIHNGQNLTVESITASPDLKRLLIRTNSVQNWRHSTFGSYFVYDKSSSSFEEIGNEVALAIWSPNSNDIAYVQDNNIYIYSAISKKTIRAVTNDGSSFLFNGKPDWVYEEEVFEDDKAAWWSPTGDYLAFLKIDESEVGEFIIPYYVQDEKDIYPEMRSIKYPKSGTPNPHAELWVYSMKDGTSFHPRISGNKKDGSLLITEVTWVGNGNVLVKTTDRSSDILTVFLIDTIAKTSNVVRNESSNGGWWEITHNTLFIPANETFDRPHNGYVDILPIGGYNHLAYFENSNSSHYKTLTEGKWEVVNGPLAFDSMENRLYFISTRKSSTERHVYYIDLRSPNEIIEVTDTSEDGVYDVSFSSGRRFGLLTYKGPKVPYQKIVDFHSRKAEKCDKGNVLGKSLYHLEKNEVLTKILEDYAVPRKSFRELNLGKDEFGKDILVNSYEILPNDFDETLSDHYPVFFFAYGGPNSQQVVKTFSVGFNEVVASQLNAIVVVVDGRGTGFKGQDFRSLVRDRLGDYEARDQISAASLYGSLTFVDPQKISLFGWSYGGYLTLKTLEKDGGRHFKYGMSVAPVTDWRFYDSVYTERYMHTPQENFDGYVESSVHNVTALAQANRFLLMHGTGDDNVHFQNSLKFLDLLDLNGVENYDVHVFPDSDHSIRYHNANVIVFDKLLDWAKRAFDGQFVK

SEQ ID NO: 22030 - protein, 484 aa, Saccharomyces cerevisiae
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 22031 - protein, 723 aa, Saccharomyces cerevisiae
MFRSHASGNKKQWSKRSSNGSTPAASASGSHAYRQQTLSSFFMGCGKKSAAASKNSTTIIDLESGDEGNRNITAPPRPRLIRNNSSSLFSQSQGSFGDDDPDAEFKKLVDVPRLNSYKKSSRSLSMTSSLHKTASASTTQKTYHFDEDETLREVTSVKSNSRQLSFTSTINIEDSSMKLSTDSERPAKRSKPSMEFQGLKLTVPKKIKPLLRKTVSNMDSMNHRSASSPVVLTMEQERVVNLIVKKRTNVFYTGSAGTGKSVILQTIIRQLSSLYGKESIAITASTGLAAVTIGGSTLHKWSGIGIGNKTIDQLVKKIQSQKDLLAAWRYTKVLIIDEISMVDGNLLDKLEQIARRIRKNDDPFGGIQLVLTGDFFQLPPVAKKDEHNVVKFCFESEMWKRCIQKTILLTKVFRQQDNKLIDILNAIRYGELTVDIAKTIRNLNRDIDYADGIAPTELYATRREVELSNVKKLQSLPGDLYEFKAVDNAPERYQAILDSSLMVEKVVALKEDAQVMMLKNKPDVELVNGSLGKVLFFVTESLVVKMKEIYKIVDDEVVMDMRLVSRVIGNPLLKESKEFRQDLNARPLARLERLKILINYAVKISPHKEKFPYVRWTVGKNKYIHELMVPERFPIDIPRENVGLERTQIPLMLCWALSIHKAQGQTIQRLKVDLRRIFEAGQVYVALSRAVTMDTLQVLNFDPGKIRTNERVKDFYKRLETLK

SEQ ID NO: 22032 - protein, 575 aa, Saccharomyces cerevisiae
MLSARCLKSIYFKRSFSQLGHIKPPKHIRNEPVKPFRNIDLKDWDLLRASLMKFKSSSLEVPLVINGERIYDNNERALFPQTNPANHQQVLANVTQATEKDVMNAVKAAKDAKKDWYNLPFYDRSAIFLKAADLISTKYRYDMLAATMLGQGKNVYQAEIDCITELSDFFRYYVKYASDLYAQQPVESADGTWNKAEYRPLEGFVYAVSPFNFTAIAANLIGAPALMGNTVVWKPSQTAALSNYLLMTVLEEAGLPKGVINFIPGDPVQVTDQVLADKDFGALHFTGSTNVFKSLYGKIQSGVVEGKYRDYPRIIGETGGKNFHLVHPSANISHAVLSTIRGTFEFQGQKCSAASRLYLPESKSEEFLSDMFGILQSQNVVPMNTSASPISGGNLRGFMGPVIHEQSFDKLVKVIEDAKKDPELEILYGGQYDKSQGWFVGPTVIKAKRPDHPYMSTEFFGPILTVYEYPDTEFNEICDIIDNTSQYALTGAIFAKDRKAIEYADEKLKFSAGNFYINDKCTGAVVSQQWFGGARMSGTDDKAGGPNILSRFVSIRNTKENFYELTDFKYPSNYE

SEQ ID NO: 22033 - protein, 644 aa, Saccharomyces cerevisiae
MSKVYLNSDMINHLNSTVQAYFNLWLEKQNAIMRSQPQIIQDNQKLIGITTLVASIFTLYVLVKIISTPAKCSSSYKPVKFSLPAPEAAQNNWKGKRSVSTNIWNPEEPNFIQCHCPATGQYLGSFPSKTEADIDEMVSKAGKAQSTWGNSDFSRRLRVLASLHDYILNNQDLIARVACRDSGKTMLDASMGEILVTLEKIQWTIKHGQRALQPSRRPGPTNFFMKWYKGAEIRYEPLGVISSIVSWNYPFHNLLGPIIAALFTGNAIVVKCSEQVVWSSEFFVELIRKCLEACDEDPDLVQLCYCLPPTENDDSANYFTSHPGFKHITFIGSQPVAHYILKCAAKSLTPVVVELGGKDAFIVLDSAKNLDALSSIIMRGTFQSSGQNCIGIERVIVSKENYDDLVKILNDRMTANPLRQGSDIDHLENVDMGAMISDNRFDELEALVKDAVAKGARLLQGGSRFKHPKYPQGHYFQPTLLVDVTPEMKIAQNEVFGPILVMMKAKNTDHCVQLANSAPFGLGGSVFGADIKECNYVANSLQTGNVAINDFATFYVCQLPFGGINGSGYGKFGGEEGLLGLCNAKSVCFDTLPFVSTQIPKPLDYPIRNNAKAWNFVKSFIVGAYTNSTWQRIKSLFSLAKEAS

SEQ ID NO: 22034 - protein, 691 aa, Saccharomyces cerevisiae
MPFGIDNTDFTVLAGLVLAVLLYVKRNSIKELLMSDDGDITAVSSGNRDIAQVVTENNKNYLVLYASQTGTAEDYAKKFSKELVAKFNLNVMCADVENYDFESLNDVPVIVSIFISTYGEGDFPDGAVNFEDFICNAEAGALSNLRYNMFGLGNSTYEFFNGAAKKAEKHLSAAGAIRLGKLGEADDGAGTTDEDYMAWKDSILEVLKDELHLDEQEAKFTSQFQYTVLNEITDSMSLGEPSAHYLPSHQLNRNADGIQLGPFDLSQPYIAPIVKSRELFSSNDRNCIHSEFDLSGSNIKYSTGDHLAVWPSNPLEKVEQFLSIFNLDPETIFDLKPLDPTVKVPFPTPTTIGAAIKHYLEITGPVSRQLFSSLIQFAPNADVKEKLTLLSKDKDQFAVEITSKYFNIADALKYLSDGAKWDTVPMQFLVESVPQMTPRYYSISSSSLSEKQTVHVTSIVENFPNPELPDAPPVVGVTTNLLRNIQLAQNNVNIAETNLPVHYDLNGPRKLFANYKLPVHVRRSNFRLPSNPSTPVIMIGPGTGVAPFRGFIRERVAFLESQKKGGNNVSLGKHILFYGSRNTDDFLYQDEWPEYAKKLDGSFEMVVAHSRLPNTKKVYVQDKLKDYEDQVFEMINNGAFIYVCGDAKGMAKGVSTALVGILSRGKSITTDEATELIKMLKTSGRYQEDVW

SEQ ID NO: 22035 - protein, 246 aa, Saccharomyces cerevisiae
MPQFSVDLCLFDLDGTIVSTTTAAESAWKKLCRQHGVDPVELFKHSHGARSQEMMKKFFPKLDNTDNKGVLALEKDMADNYLDTVSLIPGAENLLLSLDVDTETQKKLPERKWAIVTSGSPYLAFSWFETILKNVGKPKVFITGFDVKNGKPDPEGYSRARDLLRQDLQLTGKQDLKYVVFEDAPVGIKAGKAMGAITVGITSSYDKSVLFDAGADYVVCDLTQVSVVKNNENGIVIQVNNPLTRD

SEQ ID NO: 22036 - protein, 246 aa, Saccharomyces cerevisiae
MAEFSADLCLFDLDGTIVSTTVAAEKAWTKLCYEYGVDPSELFKHSHGARTQEVLRRFFPKLDDTDNKGVLALEKDIAHSYLDTVSLIPGAENLLLSLDVDTETQKKLPERKWAIVTSGSPYLAFSWFETILKNVGKPKVFITGFDVKNGKPDPEGYSRARDLLRQDLQLTGKQDLKYVVFEDAPVGIKAGKAMGAITVGITSSYDKSVLFDAGADYVVCDLTQVSVVKNNENGIVIQVNNPLTRA

SEQ ID NO: 22037 - protein, 856 aa, Saccharomyces cerevisiae
MSREVLPNNVTPLHYDITLEPNFRAFTFEGSLKIDLQINDHSINSVQINYLEIDFHSARIEGVNAIEVNKNENQQKATLVFPNGTFENLGPSAKLEIIFSGILNDQMAGFYRAKYTDKVTGETKYMATTQMEATDARRAFPCFDEPNLKATFAVTLVSESFLTHLSNMDVRNETIKEGKKYTTFNTTPKMSTYLVAFIVADLRYVESNNFRIPVRVYSTPGDEKFGQFAANLAARTLRFFEDTFNIEYPLPKMDMVAVHEFSAGAMENWGLVTYRVIDLLLDIENSSLDRIQRVAEVIQHELAHQWFGNLVTMDWWEGLWLNEGFATWMSWYSCNKFQPEWKVWEQYVTDNLQRALNLDSLRSSHPIEVPVNNADEINQIFDAISYSKGSSLLRMISKWLGEETFIKGVSQYLNKFKYGNAKTGDLWDALADASGKDVCSVMNIWTKRVGFPVLSVKEHKNKITLTQHRYLSTGDVKEEEDTTIYPILLALKDSTGIDNTLVLNEKSATFELKNEEFFKINGDQSGIFITSYSDERWAKLSKQANLLSVEDRVGLVADAKALSASGYTSTTNFLNLISNWKNEDSFVVWEQIINSLSALKSTWVFEPEDILNALDKFTLDLVLNKLSELGWNIGEDDSFAIQRLKVTLFSAACTSGNEKMQSIAVEMFEEYANGNKQAIPALFKAVVFNTVARLGGENNYEKIFNIYQNPVSSEEKIIALRALGRFEDKELLERTLSYLLDGTVLNQDFYIPMQGIRVHKKGIERLWAWMQEHWDEIAKRLQPGSPVLGGVLTLGLTNFTSFEALEKISAFYSRKVTKGFDQTLAQALDTIRSKAQWVSRDREIVATYLREHEYDQ

SEQ ID NO: 22038 - protein, 148 aa, Saccharomyces cerevisiae
MLSRAIFRNPVINRTLLRARPGAYHATRLTKNTFIQSRKYSDAHDEETFEEFTARYEKEFDEAYDLFEVQRVLNNCFSYDLVPAPAVIEKALRAARRVNDLPTAIRVFEALKYKVENEDQYKAYLDELKDVRQELGVPLKEELFPSSS

SEQ ID NO: 22039 - protein, 314 aa, Saccharomyces cerevisiae
MTEGKRLQQMELPQMKSIWIDEDQEMEKLYGFQVRQRFMNGPSTDSDEDADEDLGIVLVDSKKLALPNKNNIKLPPLPNYMTINPNINSNHKSLTNKKKNFLGMFKKKDLLSRRHGSAKTAKQSSISTPFDFHHISHANGKREDNPLESHEEKHDVESLVKFTSLAPQPRPDSNVSSKYSNVVMNDSSRIVSSSTIATTMDSHHDGNETNNTPNGNKQLDSPTDLEMTLEDLRNYTFPSVLGDSVSEKTNPSSPSVSSFSGKFKPRELSALHTPELGNCFNVDQSLNSPGNRISVDDVLKFYYQCSETSTPRNT

SEQ ID NO: 22040 - protein, 572 aa, Saccharomyces cerevisiae
MKYMVVSSPIQEVLRLHKYIEISTTTITVKITNKMSSPVIGITFGNTSSSIAYINPKNDVDVIANPDGERAIPSALSYVGEDEYHGGQALQQLIRNPKNTIINFRDFIGLPFDKCDVSKCANGAPAVEVDGKVGFVISRGEGKEEKLTVDEVVSRHLNRLKLAAEDYIGSAVKEAVLTVPTNFSEEQKTALKASAAKIGLQIVQFINEPSAALLAHAEQFPFEKDVNVVVADFGGIRSDAAVIAVRNGIFTILATAHDLSLGGDNLDTELVEYFASEFQKKYQANPRKNARSLAKLKANSSITKKTLSNATSATISIDSLADGFDYHASINRMRYELVANKVFAQFSSFVDSVIAKAELDPLDIDAVLLTGGVSFTPKLTTNLEYTLPESVEILGPQNKNASNNPNELAASGAALQARLISDYDADELAEALQPVIVNTPHLKKPIGLIGAKGEFHPVLLAETSFPVQKKLTLKQAKGDFLIGVYEGDHHIEEKTLEPIPKEENAEEDDESEWSDDEPEVVREKLYTLGTKLMELGIKNANGVEIIFNINKDGALRVTARDLKTGNAVKGEL

SEQ ID NO: 22041 - protein, 543 aa, Saccharomyces cerevisiae
MKNLKLINEHLAIVHGIHRIVTYLRSNIYQDSVKYFTESAIKMSKIVKRKEKKANDELTSLAEKIRAKALENQKKLIEAEKEGGSESDSEEDATAEKKKVLKSKSKSTVSTQNENTNEDESFESFSELNLVPELIQACKNLNYSKPTPIQSKAIPPALEGHDIIGLAQTGSGKTAAFAIPILNRLWHDQEPYYACILAPTRELAQQIKETFDSLGSLMGVRSTCIVGGMNMMDQARDLMRKPHIIIATPGRLMDHLENTKGFSLRKLKFLVMDEADRLLDMEFGPVLDRILKIIPTQERTTYLFSATMTSKIDKLQRASLTNPVKCAVSNKYQTVDTLVQTLMVVPGGLKNTYLIYLLNEFIGKTMIIFTRTKANAERLSGLCNLLEFSATALHGDLNQNQRMGSLDLFKAGKRSILVATDVAARGLDIPSVDIVVNYDIPVDSKSYIHRVGRTARAGRSGKSISLVSQYDLELILRIEEVLGKKLPKESVDKNIILTLRDSVDKANGEVVMEMNRRNKEKIARGKGRRGRMMTRENMDMGER

SEQ ID NO: 22042 - protein, 229 aa, Saccharomyces cerevisiae
MDGNHRFTPDSKEFNTVVKSKESSTGRNPYQTPPLEHNGTHHQTNYSRKKTNLAIIISNFLSEISRPLSNGKINNSTHNILKFLNEVLKRSKCSKENAVLATFYFQKIHQSRGVRDESSLPEFSHCSRRIFLCCLILSHKFLNDNTYSMKNWQIISGLHAKDLSLMERWCLGKLNYELAIPYDEFLLWETNTLMKAKLRVGTPANAPVKRPRESDNDYDANSWKQIKSC

SEQ ID NO: 22043 - protein, 731 aa, Saccharomyces cerevisiae
MTEFYSDTIGLPKTDPRLWRLRTDELGRESWEYLTPQQAANDPPSTFTQWLLQDPKFPQPHPERNKHSPDFSAFDACHNGASFFKLLQEPDSGIFPCQYKGPMFMTIGYVAVNYIAGIEIPEHERIELIRYIVNTAHPVDGGWGLHSVDKSTVFGTVLNYVILRLLGLPKDHPVCAKARSTLLRLGGAIGSPHWGKIWLSALNLYKWEGVNPAPPETWLLPYSLPMHPGRWWVHTRGVYIPVSYLSLVKFSCPMTPLLEELRNEIYTKPFDKINFSKNRNTVCGVDLYYPHSTTLNIANSLVVFYEKYLRNRFIYSLSKKKVYDLIKTELQNTDSLCIAPVNQAFCALVTLIEEGVDSEAFQRLQYRFKDALFHGPQGMTIMGTNGVQTWDCAFAIQYFFVAGLAERPEFYNTIVSAYKFLCHAQFDTECVPGSYRDKRKGAWGFSTKTQGYTVADCTAEAIKAIIMVKNSPVFSEVHHMISSERLFEGIDVLLNLQNIGSFEYGSFATYEKIKAPLAMETLNPAEVFGDIMVEYPYVECTDSSVLGLTYFHKYFDYRKEEIRTRIRIAIEFIKKSQLPDGSWYGSWGICFTYAGMFALEALHTVGETYENSSTVRKGCDFLVSKQMKDGGWGESMKSSELHSYVDSEKSLVVQTAWALIALLFAEYPNKEVIDRGIDLLKNRQEESGEWKFESVEGVFNHSCAIEYPSYRFLFPIKALGMYSRAYETHTL

SEQ ID NO: 22044 - protein, 1108 aa, Saccharomyces cerevisiae
MLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGFMPEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 22045 - protein, 688 aa, Saccharomyces cerevisiae
MKVQITNSRTEEILKVQANNENDEVSKATPGEVEESLRLIGDLKFFLATAPVNWQENQIIRRYYLNSGQGFVSCVFWNNLYYITGTDIVKCCLYRMQKFGREVVQKKKFEEGIFSDLRNLKCGIDATLEQPKSEFLSFLFRNMCLKTQKKQKVFFWFSVAHDKLFADALERDLKRESLNQPSTTKPVNEPALSFSYDSSSDKPLYDQLLQHLDSRRPSSTTKSDNSPPKLESENFKDNELVTVTNQPLLGVGLMDDDAPESPSQINDFIPQKLIIEPNTLELNGLTEETPHDLPKNTAKGRDEEDFPLDYFPVSVEYPTEENAFDPFPPQAFTPAAPSMPISYDNVNERDSMPVNSLLNRYPYQLSVAPTFPVPPSSSRQHFMTNRDFYSSNNNKEKLVSPSDPTSYMKYDEPVMDFDESRPNENCTNAKSHNSGQQTKQHQLYSNNFQQSYPNGMVPGYYPKMPYNPMGGDPLLDQAFYGADDFFFPPEGCDNNMLYPQTATSWNVLPPQAMQPAPTYVGRPYTPNYRSTPGSAMFPYMQSSNSMQWNTAVSPYSSRAPSTTAKNYPPSTFYSQNINQYPRRRTVGMKSSQGNVPTGNKQSVGKSAKISKPLHIKTSAYQKQYKINLETKARPSAGDEDSAHPDKNKEISMPTPDSNTLVVQSEEGGAHSLEVDTNRRSDKNLPDAT

SEQ ID NO: 22046 - protein, 560 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWFHQTREVLTTTLMI

SEQ ID NO: 22047 - protein, 570 aa, Saccharomyces cerevisiae
MNSTPDLISPQKSNSSNSYELESGRSKAMNTPEGKNESFHDNLSESQVQPAVAPPNTGKGVYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 22048 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 22049 - protein, 327 aa, Saccharomyces cerevisiae
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 22050 - protein, 407 aa, Saccharomyces cerevisiae
MSAATATAAPVPPPVGISNLPNQRYKIVNEEGGTFTVMLCGESGLGKTTFINTLFQTVLKRADGQQHRQEPIRKTVEIDITRALLEEKHFELRVNVIDTPGFGDNVNNNKAWQPLVDFIDDQHDSYMRQEQQPYRTKKFDLRVHAVLYFIRPTGHGLKPIDIETMKRLSTRANLIPVIAKADTLTAQELQQFKSRIRQVIEAQEIRIFTPPLDADSKEDAKSGSNPDSAAVEHARQLIEAMPFAIVGSEKKFDNGQGTQVVARKYPWGLVEIENDSHCDFRKLRALLLRTYLLDLISTTQEMHYETYRRLRLEGHENTGEGNEDFTLPAIAPARKLSHNPRYKEEENALKKYFTDQVKAEEQRFRQWEQNIVNERIRLNGDLEEIQGKVKKLEEQVKSLQVKKSHLK

SEQ ID NO: 22051 - protein, 378 aa, Saccharomyces cerevisiae
MVDLSTALIHGDDKDNRVTDVAPPINVSTTFRYDDDDLIPWTERENLDFMEKKPVYSRLAHPNSTRLESIFSEILDGYAVIYSSGLAAFYAAMVHYNPKKIFIGQSYHGVRAIANILTRNYGIEQHPLEDIEKCASEGDIVHLESPVNPYGTSSDIESLARRAHAKGALLIVDSTFASPPLQYAWNFGADIVLYSATKYFGGHSDLLSGVLVVKEEATSRQLKDDRIYLGTNVANLESFMLLRSLRTYEMRITKQSENATKLVRFLSDHQSEFDKVLKTIYHSSLQTEEFVKKQLVGGYGPVFAITLYTKEQCKQLPLKLKYFHHATSLGGIESLVEWRAMTDPYIDQTLIRVSVGCESANDLIKDLASALKELQDAA

SEQ ID NO: 22052 - protein, 959 aa, Saccharomyces cerevisiae
MKHFFRLPTAFRPISRVSLRYSSTDTAQPKISKLKISFNKISESNSEKKDNLGSIDTRNCLSTQQDDKLSSTEPSKASLPPSLQYVRDLMDLYKDHVVLTQMGSFYELYFEQAIRYAPELNISLTNRAYSHGKVPFAGFPVHQLSRHLKMLVNNCGYSVTIAEQFKKKDVADNEANKFYRRVTRIVTPGTFIDEAFENLRENTYLLNIEFPENCMSQVADTSLKVGICWCDVSTGEIFVQQVYLRDLVSAITRIQPKEILLDERLLEFHIESGTWYPELVELKKFFIKYQKMPSQHRTIESFYGLFNLGGKEATERQLKIQFQTFTQKELAALRNTLIYVSNHLPDFSINFQIPQRQLATAIMQIDSRTSTALELHSTVRDNNKKGSLLSSIRRTVTPSGTRLLSQWLSGPSLDLKEIKKRQKIVAFFKDNRDITETLRTMLKKVNDLSRILQKFSFGRGEALELIQMARSLEVSREIRKYLLNNTSLMKATLKSQITQLTESLNFEKNLIDDILKFLNEEELAKSQDAKQNADVTRMLDIDVKDKKESNKDEIFELRDFIVNPSFNTKLRKLHDTYQGVWQKKTEYNALLKGFFVGDLGAKTFTLKERQNGEYALHVTGTASSLKKIDELISKSTEYHGSCFHILQKSSQTRWLSHKIWTDLGHELELLNLKIRNEEANIIDLFKRKFIDRSNEVRQVATTLGYLDTLSSFAVLANERNLVCPKVDESNKLEVVNGRHLMVEEGLSARSLETFTANNCELAKDNLWVITGPNMGGKSTFLRQNAIIVILAQIGCFVPCSKARVGIVDKLFSRVGSADDLYNEMSTFMVEMIETSFILQGATERSLAILDEIGRGTSGKEGISIAYATLKYLLENNQCRTLFATHFGQELKQIIDNKCSKGMSEKVKFYQSGITDLGGNNFCYNHKLKPGICTKSDAIRVAELAGFPMEALKEAREILG

SEQ ID NO: 22053 - protein, 391 aa, Saccharomyces cerevisiae
MGYFVPDSHIENLKSYKYQSEDRSLVSKYFLKPFWQRFCHIFPTWMAPNIITLSGFAFIVINVLTVFYYDPNLNTDTPRWTYFSYALGVFLYQTFDGCDGVHARRINQSGPLGELFDHSIDAINSTLSIFIFASETGMGFSYNLMLSQFAMLTNFYLSTWEEYHTHTLYLSEFSGPVEGILIVCVSLILTGIYGKQVIWHTYLFTITVGDKVIDVDTLDIVFSLAVFGLVMNALSAKRNVDKYYRNSTSSANNITQIEQDSAIKGLLPFFAYYASIALLVWMQPSFITLSFILSVGFTGAFTVGRIIVCHLTKQSFPMFNAPMLIPLCQIVLYKICLSLWGIESNKIVFALSWLGFGLSLGVHIMFMNDIIHEFTEYLDVYALSIKRSKLT

SEQ ID NO: 22054 - protein, 384 aa, Saccharomyces cerevisiae
MDQLSDSYALYNQPVVIDNGSGIIKAGFSGEERPKALEYCLVGNTKYDKVMLEGLQGDTFIGNNAQKLRGLLKLRYPIKHGVVEDWDSMELIWSYVLNEVLQLQNIGEHPLLITEAPMNPLKNREQMAQVLFETFDVSALYVSNPAVLSLYASGRTTGCVVDCGEGYCSTVPIYDGFALPASMMRMDIGGADITEQLQFQLRKSAGVSLFSSSEREIVRTMKEKVCYLAKNIKKEEEKYLQGTQDLISTFKLPDGRCIEVGNDRYRAPEILFSPQIIGLGYDGLSDMCMQSIWKVDLDLRKPLLSSIILSGGTTTLKGFGDRMLWDLEALTKGTSKIKIIAPSERKYTTWIGGSILTGLSTFQRLWTKKSDWLEDSTRVYSNLM

SEQ ID NO: 22055 - protein, 430 aa, Saccharomyces cerevisiae
MLHMNSLWGCFLFVLLAVTGAVQGLQEDYSEYAVYRFTSDNYSTLVRDVIAPLTDDYDVWTRSNNFIDIKLPKEIGEQINDGQVIIDNMNELIQNTLPTSQMMAREQAVFENDYDFFFNEYRDLDTIYMWLDLLERSFPSLVAVEHLGRTFEGRELKALHISGNKPESNPEKKTIVITGGIHAREWISVSTVCWALYQLLNRYGSSKKETKYLDDLDFLVIPVFNPDGYAYTWSHDRLWRKNRQRTHVPQCLGIDIDHSFGFQWEKAHTHACSEEYSGETPFEAWEASAWYKYINETKGDYKIYGYIDMHSYSQEILYPYAYSCDALPRDLENLLELSYGLSKAIRSKSGRNYDVISACKDRGSDIFPGLGAGSALDFMYHHRAHWAFQLKLRDTGNHGFLLPPENIKPVGKETYAALKYFCDFLLDPEI

SEQ ID NO: 22056 - protein, 538 aa, Saccharomyces cerevisiae
MSMPIASTTLAVNNLTNINGNANFNVQANKQLHHQAVDSPARSSMTATTAANSNSNSSRDDSTIVGLHYKIGKKIGEGSFGVLFEGTNMINGVPVAIKFEPRKTEAPQLRDEYKTYKILNGTPNIPYAYYFGQEGLHNILVIDLLGPSLEDLFDWCGRKFSVKTVVQVAVQMITLIEDLHAHDLIYRDIKPDNFLIGRPGQPDANNIHLIDFGMAKQYRDPKTKQHIPYREKKSLSGTARYMSINTHLGREQSRRDDMEALGHVFFYFLRGHLPWQGLKAPNNKQKYEKIGEKKRSTNVYDLAQGLPVQFGRYLEIVRSLSFEECPDYEGYRKLLLSVLDDLGETADGQYDWMKLNDGRGWDLNINKKPNLHGYGHPNPPNEKSRKHRNKQLQMQQLQMQQLQQQQQQQQYAQKTEADMRNSQYKPKLDPTSYEAYQHQTQQKYLQEQQKRQQQQKLQEQQLQEQQLQQQQQQQQQLRATGQPPSQPQAQTQSQQFGARYQPQQQPSAALRTPEQHPNDDNSSLAASHKGFFQKLGCC

SEQ ID NO: 22057 - protein, 182 aa, Saccharomyces cerevisiae
MSIEEEDTNKITCTQDFLHQYFVTERVSIQFGLNNKTVKRINKDEFDKAVNCIMSWTNYPKPGLKRTASTYLLSNSFKKSATVSLPFILGDPVCMPKRVESNNNDTCLLYSDTLYDDPLIQRNDQAGDEIEDEFSFTLLRSEVNEIRPISSSSTAQILQSDYSALMYERQASNGSIFQFSSP

SEQ ID NO: 22058 - protein, 1522 aa, Saccharomyces cerevisiae
MPGTPQKNKRSASISVSPAKKTEEKEIIQNDSKAILSKQTKRKKKYAFAPINNLNGKNTKVSNASVLKSIAVSQVRNTSRTKDINKAVSKSVKQLPNSQVKPKREMSNLSRHHDFTQDEDGPMEEVIWKYSPLQRDMSDKTTSAAEYSDDYEDVQNPSSTPIVPNRLKTVLSFTNIQVPNADVNQLIQENGNEQVRPKPAEISTRESLRNIDDILDDIEGDLTIKPTITKFSDLPSSPIKAPNVEKKAEVNAEEVDKMDSTGDSNDGDDSLIDILTQKYVEKRKSESQITIQGNTNQKSGAQESCGKNDNTKSRGEIEDHENVDNQAKTGNAFYENEEDSNCQRIKKNEKIEYNSSDEFSDDSLIELLNETQTQVEPNTIEQDLDKVEKMVSDDLRIATDSTLSAYALRAKSGAPRDGVVRLVIVSLRSVELPKIGTQKILECIDGKGEQSSVVVRHPWVYLEFEVGDVIHIIEGKNIENKRLLSDDKNPKTQLANDNLLVLNPDVLFSATSVGSSVGCLRRSILQMQFQDPRGEPSLVMTLGNIVHELLQDSIKYKLSHNKISMEIIIQKLDSLLETYSFSIIICNEEIQYVKELVMKEHAENILYFVNKFVSKSNYGCYTSISGTRRTQPISISNVIDIEENIWSPIYGLKGFLDATVEANVENNKKHIVPLEVKTGKSRSVSYEVQGLIYTLLLNDRYEIPIEFFLLYFTRDKNMTKFPSVLHSIKHILMSRNRMSMNFKHQLQEVFGQAQSRFELPPLLRDSSCDSCFIKESCMVLNKLLEDGTPEESGLVEGEFEILTNHLSQNLANYKEFFTKYNDLITKEESSITCVNKELFLLDGSTRESRSGRCLSGLVVSEVVEHEKTEGAYIYCFSRRRNDNNSQSMLSSQIAANDFVIISDEEGHFCLCQGRVQFINPAKIGISVKRKLLNNRLLDKEKGVTTIQSVVESELEQSSLIATQNLVTYRIDKNDIQQSLSLARFNLLSLFLPAVSPGVDIVDERSKLCRKTKRSDGGNEILRSLLVDNRAPKFRDANDDPVIPYKLSKDTTLNLNQKEAIDKVMRAEDYALILGMPGTGKTTVIAEIIKILVSEGKRVLLTSYTHSAVDNILIKLRNTNISIMRLGMKHKVHPDTQKYVPNYASVKSYNDYLSKINSTSVVATTCLGINDILFTLNEKDFDYVILDEASQISMPVALGPLRYGNRFIMVGDHYQLPPLVKNDAARLGGLEESLFKTFCEKHPESVAELTLQYRMCGDIVTLSNFLIYDNKLKCGNNEVFAQSLELPMPEALSRYRNESANSKQWLEDILEPTRKVVFLNYDNCPDIIEQSEKDNITNHGEAELTLQCVEGMLLSGVPCEDIGVMTLYRAQLRLLKKIFNKNVYDGLEILTADQFQGRDKKCIIISMVRRNSQLNGGALLKELRRVNVAMTRAKSKLIIIGSKSTIGSVPEIKSFVNLLEERNWVYTMCKDALYKYKFPDRSNAIDEARKGCGKRTGAKPITSKSKFVSDKPIIKEILQEYES

SEQ ID NO: 22059 - protein, 626 aa, Saccharomyces cerevisiae
MNDDSQDKIIHDIRIQLRKAATELSRWKLYGSSKWAAEALAGLAEAIDVDQTHSLADESPLRNKQGVPKQMFEIPQNGFGLSETEYDLYLLGSTLFDAKEFDRCVFFLKDVTNPYLKFLKLYSKFLSWDKKSQESMENILTTGKFTDEMYRANKDGDGSGNEDINQSGHQRANLKMVSNEHESQSNISSILKEINTFLESYEIKIDDDEADLGLALLYYLRGVILKQEKNISKAMSSFLKSLSCYSFNWSCWLELMDCLQKVDDALLLNNYLYQNFQFKFSENLGSQRTIEFNIMIKFFKLKVFEELNGQLEDYFEDLEFLLQVFPNFTFLKAYNATISYNNLDYVTAESRFDDIVKQDPYRLNDLETYSNILYVMQKNSKLAYLAQFVSQIDRFRPETCCIIANYYSARQEHEKSIMYFRRALTLDKKTTNAWTLMGHEFVELSNSHAAIECYRRAVDICPRDFKAWFGLGQAYALLDMHLYSLYYFQKACTLKPWDRRIWQVLGECYSKTGNKVEAIKCYKRSIKASQTVDQNTSIYYRLAQLYEELEDLQECKKFMMKCVDVEELLEGIVTDETVKARLWLAIFEIKAGNYQLAYDYAMGVSSGTSQEIEEARMLARECRRHM

SEQ ID NO: 22060 - protein, 431 aa, Saccharomyces cerevisiae
MADFKSLGLSKWLTESLRAMKITQPTAIQKACIPKILEGRDCIGGAKTGSGKTIAFAGPMLTKWSEDPSGMFGVVLTPTRELAMQIAEQFTALGSSMNIRVSVIVGGESIVQQALDLQRKPHFIIATPGRLAHHIMSSGDDTVGGLMRAKYLVLDEADILLTSTFADHLATCISALPPKDKRQTLLFTATITDQVKSLQNAPVQKGKPPLFAYQVESVDNVAIPSTLKIEYILVPEHVKEAYLYQLLTCEEYENKTAIIFVNRTMTAEILRRTLKQLEVRVASLHSQMPQQERTNSLHRFRANAARILIATDVASRGLDIPTVELVVNYDIPSDPDVFIHRSGRTARAGRIGDAISFVTQRDVSRIQAIEDRINKKMTETNKVHDTAVIRKALTKVTKAKRESLMAMQKENFGERKRQQKKKQNDGKSLRS

SEQ ID NO: 22061 - protein, 437 aa, Saccharomyces cerevisiae
MAVSKVYARSVYDSRGNPTVEVELTTEKGVFRSIVPSGASTGVHEALEMRDEDKSKWMGKGVMNAVNNVNNVIAAAFVKANLDVKDQKAVDDFLLSLDGTANKSKLGANAILGVSMAAARAAAAEKNVPLYQHLADLSKSKTSPYVLPVPFLNVLNGGSHAGGALALQEFMIAPTGAKTFAEAMRIGSEVYHNLKSLTKKRYGASAGNVGDEGGVAPNIQTAEEALDLIVDAIKAAGHDGKVKIGLDCASSEFFKDGKYDLDFKNPESDKSKWLTGVELADMYHSLMKRYPIVSIEDPFAEDDWEAWSHFFKTAGIQIVADDLTVTNPARIATAIEKKAADALLLKVNQIGTLSESIKAAQDSFAANWGVMVSHRSGETEDTFIADLVVGLRTGQIKTGAPARSERLAKLNQLLRIEEELGDKAVYAGENFHHGDKL

SEQ ID NO: 22062 - protein, 489 aa, Saccharomyces cerevisiae
MSADFGLIGLAVMGQNLILNAADHGFTVCAYNRTQSKVDHFLANEAKGKSIIGATSIEDFISKLKRPRKVMLLVKAGAPVDALINQIVPLLEKGDIIIDGGNSHFPDSNRRYEELKKKGILFVGSGVSGGEEGARYGPSLMPGGSEEAWPHIKNIFQSISAKSDGEPCCEWVGPAGAGHYVKMVHNGIEYGDMQLICEAYDIMKRLGGFTDKEISDVFAKWNNGVLDSFLVEITRDILKFDDVDGKPLVEKIMDTAGQKGTGKWTAINALDLGMPVTLIGEAVFARCLSALKNERIRASKVLPGPEVPKDAVKDREQFVDDLEQALYASKIISYAQGFMLIREAAATYGWKLNNPAIALMWRGGCIIRSVFLGQITKAYREEPDLENLLFNKFFADAVTKAQSGWRKSIALATTYGIPTPAFSTALSFYDGYRSERLPANLLQAQRDYFGAHTFRVLPECASDNLPVDKDIHINWTGHGGNVSSSTYQA

SEQ ID NO: 22063 - protein, 444 aa, Saccharomyces cerevisiae
MGKLLQLALHPVEMKAALKLKFCRTPLFSIYDQSTSPYLLHCFELLNLTSRSFAAVIRELHPELRNCVTLFYLILRALDTIEDDMSIEHDLKIDLLRHFHEKLLLTKWSFDGNAPDVKDRAVLTDFESILIEFHKLKPEYQEVIKEITEKMGNGMADYILDENYNLNGLQTVHDYDVYCHYVAGLVGDGLTRLIVIAKFANESLYSNEQLYESMGLFLQKTNIIRDYNEDLVDGRSFWPKEIWSQYAPQLKDFMKPENEQLGLDCINHLVLNALSHVIDVLTYLAGIHEQSTFQFCAIPQVMAIATLALVFNNREVLHGNVKIRKGTTCYLILKSRTLRGCVEIFDYYLRDIKSKLAVQDPNFLKLNIQISKIEQFMEEMYQDKLPPNVKPNETPIFLKVKERSRYDDELVPTQQEEEYKFNMVLSIILSVLLGFYYIYTLHRA

SEQ ID NO: 22064 - protein, 268 aa, Saccharomyces cerevisiae
MVLEATVLVIDNSEYSRNGDFPRTRFEAQIDSVEFIFQAKRNSNPENTVGLISGAGANPRVLSTFTAEFGKILAGLHDTQIEGKLHMATALQIAQLTLKHRQNKVQHQRIVAFVCSPISDSRDELIRLAKTLKKNNVAVDIINFGEIEQNTELLDEFIAAVNNPQEETSHLLTVTPGPRLLYENIASSPIILEEGSSGMGAFGGSGGDSDANGTFMDFGVDPSMDPELAMALRLSMEEEQQRQERLRQQQQQQDQPEQSEQPEQHQDK

SEQ ID NO: 22065 - protein, 397 aa, Saccharomyces cerevisiae
MSPLRKTVPEFLAHLKSLPISKIASNDVLTICVGNESADMDSIASAITYSYCQYIYNEGTYSEEKKKGSFIVPIIDIPREDLSLRRDVMYVLEKLKIKEEELFFIEDLKSLKQNVSQGTELNSYLVDNNDTPKNLKNYIDNVVGIIDHHFDLQKHLDAEPRIVKVSGSCSSLVFNYWYEKLQGDREVVMNIAPLLMGAILIDTSNMRRKVEESDKLAIERCQAVLSGAVNEVSAQGLEDSSEFYKEIKSRKNDIKGFSVSDILKKDYKQFNFQGKGHKGLEIGLSSIVKRMSWLFNEHGGEADFVNQCRRFQAERGLDVLVLLTSWRKAGDSHRELVILGDSNVVRELIERVSDKLQLQLFGGNLDGGVAMFKQLNVEATRKQVVPYLEEAYSNLEE

SEQ ID NO: 22066 - protein, 796 aa, Saccharomyces cerevisiae
MVCCLWVLLALLLHLDHVACEDDAYSFTSKELKAYKQEVKELFYFGFDNYLEHGYPYDEVKPISCVPKKRNFEDPTDQGTNDILGNFTITLIDSLTTIAILEDRPQFLKAVRLVERTFPDGNFDIDSTIQVFEITIRVIGSLLSSHLYATDPTKAVYLGDDYDGSLLRLAQNMADRLLPAYLTSTGLPMPRRNIKRKWDVSEFPEFLETENNVAAMASPMFEFTILSYLTGDPKYEKVTRYAFDKTWSLRTGLDLLPMSFHPEKLTPYTPMTGIGASIDSLFEYALKGAILFDDSELMEVWNVAYEALKTNCKNDWFFANVMADTGHLFVPWIDSLSAFFSGLQVLAGDLDDAIANHLMFLKMWNTFGGIPERWNFSPPEFPPLSPLERSGAVALDNILPLEWYPLRPEFFESTYFLYRATKDPFYLNIGVHLLKDLKQRFKSNCGFAGFQNVITGELQDRMETFVLSETLKYLYLLFDEENELHNSASDVIFSTEAHPMWLPQEVRSNYKRNAKFNNSVYSSHLEICQKKDREQAGENTLSQRIVGFAKSIFHKGPPDEEATDPIIDYTIDTELPGTCSIKPHHVIGDEFWYSPMLSNFDRLFEIDSRFAATLIKPSHMHNYNAIELEPGFYNRWSNPQFSTCLIPPTTEIFELLFDLPGYHQLNPLMLENKTITFETFGGRSRLKIEKLQIYQIDYYGDLITASTFQDVSRKDIFSNACDAVASLYSPTYLYRVVAINGRILPRHGSVQIKKHSPVLTSNGTREEDEFKMDGIGINDHSQLMLECTPIINLFIV

SEQ ID NO: 22067 - protein, 823 aa, Saccharomyces cerevisiae
MNFFTSKSSNQDTGFSSQHQHPNGQNNGNNNSSTAGNDNGYPCKLVSSGPCASSNNGALFTNFTLQTATPTTAISQDLYAMGTTGITSENALFQMKSMNNGISSVNNNNSNTPTIITTSQEETNAGNVHGDTGGNSLQNSEDDNFSSSSTTKCLLSSTSSLSINQREAAAAAYGPDTDIPRGKLEVTIIEARDLVTRSKDSQPYVVCTFESSEFISNGPESLGAINNNNNNNNNNQHNQNQHINNNNENTNPDAASQHHNNNSGWNGSQLPSIKEHLKKKPLYTHRSSSQLDQLNSCSSVTDPSKRSSNSSSGSSNGPKNDSSHPIWHHKTTFDVLGSHSELDISVYDAAHDHMFLGQVRLYPMIHNLAHASQHQWHSLKPRVIDEVVSGDILIKWTYKQTKKRHYGPQDFEVLRLLGKGTFGQVYQVKKKDTQRIYAMKVLSKKVIVKKNEIAHTIGERNILVTTASKSSPFIVGLKFSFQTPTDLYLVTDYMSGGELFWHLQKEGRFSEDRAKFYIAELVLALEHLHDNDIVYRDLKPENILLDANGNIALCDFGLSKADLKDRTNTFCGTTEYLAPELLLDETGYTKMVDFWSLGVLIFEMCCGWSPFFAENNQKMYQKIAFGKVKFPRDVLSQEGRSFVKGLLNRNPKHRLGAIDDGRELRAHPFFADIDWEALKQKKIPPPFKPHLVSETDTSNFDPEFTTASTSYMNKHQPMMTATPLSPAMQAKFAGFTFVDESAIDEHVNNNRKFLQNSYFMEPGSFIPGNPNLPPDEDVIDDDGDEDINDGFNQEKNMNNSHSQMDFDGDQHMDDEFVSGRFEI

SEQ ID NO: 22068 - protein, 1075 aa, Saccharomyces cerevisiae
MTIAHHCIFLVILAFLALINVASGATEACLPAGQRKSGMNINFYQYSLKDSSTYSNAAYMAYGYASKTKLGSVGGQTDISIDYNIPCVSSSGTFPCPQEDSYGNWGCKGMGACSNSQGIAYWSTDLFGFYTTPTNVTLEMTGYFLPPQTGSYTFSFATVDDSAILSVGGSIAFECCAQEQPPITSTNFTINGIKPWDGSLPDNITGTVYMYAGYYYPLKVVYSNAVSWGTLPISVELPDGTTVSDNFEGYVYSFDDDLSQSNCTIPDPSIHTTSTITTTTEPWTGTFTSTSTEMTTITDTNGQLTDETVIVIRTPTTASTITTTTEPWTGTFTSTSTEMTTVTGTNGQPTDETVIVIRTPTSEGLITTTTEPWTGTFTSTSTEMTTVTGTNGQPTDETVIVIRTPTSEGLITTTTEPWTGTFTSTSTEVTTITGTNGQPTDETVIVIRTPTSEGLITTTTEPWTGTFTSTSTEMTTVTGTNGQPTDETVIVIRTPTSEGLISTTTEPWTGTFTSTSTEVTTITGTNGQPTDETVIVIRTPTSEGLITTTTEPWTGTFTSTSTEMTTVTGTNGQPTDETVIVIRTPTSEGLITRTTEPWTGTFTSTSTEVTTITGTNGQPTDETVIVIRTPTTAISSSLSSSSGQITSSITSSRPIITPFYPSNGTSVISSSVISSSVTSSLVTSSSFISSSVISSSTTTSTSIFSESSTSSVIPTSSSTSGSSESKTSSASSSSSSSSISSESPKSPTNSSSSLPPVTSATTGQETASSLPPATTTKTSEQTTLVTVTSCESHVCTESISSAIVSTATVTVSGVTTEYTTWCPISTTETTKQTKGTTEQTKGTTEQTTETTKQTTVVTISSCESDICSKTASPAIVSTSTATINGVTTEYTTWCPISTTESKQQTTLVTVTSCESGVCSETTSPAIVSTATATVNDVVTVYPTWRPQTTNEQSVSSKMNSATSETTTNTGAAETKTAVTSSLSRFNHAETQTASATDVIGHSSSVVSVSETGNTMSLTSSGLSTMSQQPRSTPASSMVGSSTASLEISTYAGSANSLLAGSGLSVFIASLLLAII

SEQ ID NO: 22069 - protein, 198 aa, Saccharomyces cerevisiae; identical to SEQ ID NO: 1400

SEQ ID NO: 22070 - protein, 467 aa, Saccharomyces cerevisiae
MLKSAVYSILAASLVNAGTIPLGKLSDIDKIGTQTEIFPFLGGSGPYYSFPGDYGISRDLPESCEMKQVQMVGRHGERYPTVSKAKSIMTTWYKLSNYTGQFSGALSFLNDDYEFFIRDTKNLEMETTLANSVNVLNPYTGEMNAKRHARDFLAQYGYMVENQTSFAVFTSNSNRCHDTAQYFIDGLGDKFNISLQTISEAESAGANTLSAHHSCPAWDDDVNDDILKKYDTKYLSGIAKRLNKENKGLNLTSSDANTFFAWCAYEINARGYSDICNIFTKDELVRFSYGQDLETYYQTGPGYDVVRSVGANLFNASVKLLKESEVQDQKVWLSFTHDTDILNYLTTIGIIDDQNNLTAEHVPFMENTFHRSWYVPQGARVYTEKFQCSNDTYVRYVINDAVVPIETCSTGPGFSCEINDFYGYAEKRVAGTDFLKVCNVSSVSNSTELTFFWDWNTKHYNDTLLKQ

SEQ ID NO: 22071 - protein, 589 aa, Saccharomyces cerevisiae
MTISSAHPETEPKWWKEATIYQIYPASFKDSNNDGWGDMKGIASKLEYIKELGTDAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQLSDPFTMNGPRIHEFHQEMNKFIRNRVKDGREIMTVGEMRHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 22072 - protein, 457 aa, Saccharomyces cerevisiae
MGLIVSIFNIGCAIGGIVLSKVGDIYGRRIGLITVTAIYVVGILIQITSINKWYQYFIGRIISGIGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKHSLSKSNKVSVDDPALLAEYDTIKAGIEIEKLAGNASWSELLSTKTKVFQRVLMGVIIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCFVIVSETFPLRAKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 22073 - protein, 542 aa, Saccharomyces cerevisiae
MSVQKEEYDIVEKAQLSVSAESLTSDSESISHNPFDDFHKAERWRKVYESSGYEGLSKFDPEFTWTKDEEKKLVRKMDLKIFLWVFIMFAFLDLIRKNIARAVSDNFIVDLKMNTNDYNLGQTVYLVIFLASELPGNLLSKRFGPERVIPVQIVLWSVICITQAGLKNRGQFIATRCLLGMVQGGFIPDNILYLSYYYTGAELTFRLSFFWCAIPLFQILGSLLASGIIEMRGIHNLAGWQYLFIIEGFLSLSVGVASFYLMRRGPTQTGESAFHKGKSLFTEYEEKIMVNRILRDDPSKGDMSNRQPVTFKEILYTLTEFDLWPLFIQGITAFISLQTVGSYLSLILKSLNYSTFLSNILAIPGQALLLINLPLAALLSRKLKEKSLCVGIANVWVLPFIVSLVALPTDTNPWIKYILLTGILGLPYTHSILAGWVSEISNSVRSRTVGTALYNMSAQVGAIIASNMYRNDDKPYYTRGNKILLGFTCFNICMAVATKFYYISRNKYKDRKWNSMTKEEQINYLDTTKDKGMKRLDYRFIH

SEQ ID NO: 22074 - protein, 532 aa, Saccharomyces cerevisiae
MLLQAFLFLLAGFAAKISASMTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 22075 - protein, 417 aa, Saccharomyces cerevisiae
MSQRLQSIKDHLVESAMGKGESKRKNSLLEKRPEDVVIVAANRSAIGKGFKGAFKDVNTDYLLYNFLNEFIGRFPEPLRADLNLIEEVACGNVLNVGAGATEHRAACLASGIPYSTPFVALNRQCSSGLTAVNDIANKIKVGQIDIGLALGVESMTNNYKNVNPLGMISSEELQKNREAKKCLIPMGITNENVAANFKISRKDQDEFAANSYQKAYKAKNEGLFEDEILPIKLPDGSICQSDEGPRPNVTAESLSSIRPAFIKDRGTTTAGNASQVSDGVAGVLLARRSVANQLNLPVLGRYIDFQTVGVPPEIMGVGPAYAIPKVLEATGLQVQDIDIFEINEAFAAQALYCIHKLGIDLNKVNPRGGAIALGHPLGCTGARQVATILRELKKDQIGVVSMCIGTGMGAAAIFIKE

SEQ ID NO: 22076 - protein, 1375 aa, Saccharomyces cerevisiae
MDSSPNKKTYRYPRRSLSLHARDRVSEARKLEELNLNDGLVAAGLQLVGVALEKQGTGSHIYMKQKNFSANDVSSSPMVSEEVNGSEMDFNPKCMPQDASLVERMFDELLKDGTFFWGAAYKNLQNISLRRKWLLICKIRSSNHWGKKKVTSSTTYSTHLATNELAENAHFLDGLVRNLSTGGMKLSKALYKLEKFLRKQSFLQLFLKDEIYLTTLIEKTLPLISKELQFVYLRCFKILMNNPLARIRALHSEPLIRWFTELLTDQNSNLKCQLLSMELLLLLTYVEGSTGCELIWDQLSILFTDWLEWFDKILADDIAIHSSLYLNWNQLKIDYSTTFLLLINSILQGFNNKTALEILNFLKKNNIHNTITFLELAYKDDPNSVVIMEQIKQFKSKESAIFDSMIKTTNDTNSLHPTKDIARIESEPLCLENCLLLKAKDSPVEAPINEIIQSLWKILDSQKPYSESIKLLKLINSLLFYLIDSFQVSTNPSFDETLESAENVDYVFQDSVNKLLDSLQSDEIARRAVTEIDDLNAKISHLNEKLNLVENHDKDHLIAKLDESESLISLKTKEIENLKLQLKATKKRLDQITTHQRLYDQPPSLASSNLSIAGSIIKNNSHGNIIFQNLAKKQQQQQKISLPKRSTSLLKSKRVTSLSSYLTDANNENESQNESEDKSKDSLFQRSTSTINFNIPSMKNITNMQNVSLNSILSELEFSNSLGTQPNYQSSPVLSSVSSSPKLFPRLSSDSLDNGIQLVPEVVKLPQLPPPPPPPPPPPLPQSLLTEAEAKPDGVSCIAAPAPPPLPDLFKTKTCGAVPPPPPPPPLPESLSMNKGPSNHDLVTPPAPPLPNGLLSSSSVSINPTTTDLKPPPTEKRLKQIHWDKVEDIKDTLWEDTFQRQETIKELQTDGIFSQIEDIFKMKSPTKIANKRNAESSIALSSNNGKSSNELKKISFLSRDLAQQFGINLHMFSQLSDMEFVMKVLNCDNDIVQNVNILKFFCKEELVNIPKSMLNKYEPYSQGKDGKAVSDLQRADRIFLELCINLRFYWNARSKSLLTLSTYERDYYDLIFKLQKIDDAISHLNRSPKFKSLMFIITEIGNHMNKRIVKGIKLKSLTKLAFVRSSIDQNVSFLHFIEKVIRIKYPDIYGFVDDLKNIEDLGKISLEHVESECHEFHKKIEDLVTQFQVGKLSKEENLDPRDQIIKKVKFKINRAKTKSELLIGQCKLTLIDLNKLMKYYGEDPKDKESKNEFFQPFIEFLAMFKKCAKENIEKEEMERVYEQRKSLLDMRTSSNKKSNGSDENDGEKVNRDAVDLLISKLREVKKDPEPLRRRKSTKLNEIAINVHEGDVKTRKDEDHVLLERTHAMLNDIQNI

SEQ ID NO: 22077 - protein, 1071 aa, Saccharomyces cerevisiae
MLDDDKGTAMHPHITPFTPEYSNELLRRVQDLYHEDIKHYYPQLKLEKLLDLLEHTEYLFELYLDSIHHDRPNDALTAFIIGCYYVFLIIPQSLQFQTRNKSYSIYTDLKKMYENEMNMTNVVLMVKKEIGVVLDESVKHGAGIEHRITKKRAFSVPADDLSGQVASLSLDTAAPQDHGLKGTFTEDDAEQSSPVWTAPNLEPNDQLKLALLPEVIPTPAFREPERKTSVPVRPSVLLEDVPSIYHEDDTSFASLNPPFREITADRSVTHRKDSYHSVYMVDSGNLKEDNDDLFNVENDGFIQSLDILQKQSIITAPELFSILSNRVEREKVLLIDLRIPQRSAINHIVAPNLVNVDPNLLWDKQTNTPIYKDDILEHLLKENENFINRNKFDYIVYYTDVKTFMTINFDYAFIFFYLMLTSQKTPLTTVPTTLLGGYEKWKKTLHSYAQEYHISIEDYLYRPYSQKARLQQEQQQQQQQPDSQDSFSAKESSTKVPEPPSWKPPDLPIRLRKRPPPPPPVSMPTTPEIPPPLPPKIMVHSQVSSISRKPPIPAKQHVKKEQLNSNEIIQRKRQHQHQHYDQQILQPQRAYNIPTIERSPNVYVSLSITGLRNLGNTCYINSMIQCLFAAKTFRTLFISSKYKSYLQPIRSNGSHYSPKLSNSLSMLFNKMYLNGGCSVVPTGFLKVINQLRPDLKIPDDQQDTQEFLMILLDRLHDELSDQQHVANDYPNLLLYNADALKVSNNEYKHWFDKNVIGNGISPIDDIFQGQMENSLQCKRCGYTTFNYSTFYVLSLAIPRRSMKLSKLGRSTEKRVKLEDCINMFTSDEVLSGENAWDCPRCGPTASVSTSVSALENEPSIVKSKKKKSRFFTLHTGTKRRHLDFFGDGITEGHNSNNNNTTIFERERSRSPFRMLGGSGKRSSSSTPFSTGGNDSNNSSDYKNKKLTTVKTINFVTLPKILVIHLSRFYYDLTKKNNTVVTYPLILNIILKNNDTMKYKLFGVVNHTGTLISGHYTSLVNKDLEHNVNIGRSKWYYFDDEVVKADRKHGSDKNLKISSSDVYVLFYERVYD

SEQ ID NO: 22078 - protein, 649 aa, Saccharomyces cerevisiae
MFSVTRRRAAGAAAAMATATGTLYWMTSQGDRPLVHNDPSYMVQFPTAAPPQVSRRDLLDRLAKTHQFDVLIIGGGATGTGCALDAATRGLNVALVEKGDFASGTSSKSTKMIHGGVRYLEKAFWEFSKAQLDLVIEALNERKHLINTAPHLCTVLPILIPIYSTWQVPYIYMGCKFYDFFAGSQNLKKSYLLSKSATVEKAPMLTTDNLKASLVYHDGSFNDSRLNATLAITAVENGATVLNYVEVQKLIKDPTSGKVIGAEARDVETNELVRINAKCVVNATGPYSDAILQMDRNPSGLPDSPLNDNSKIKSTFNQIAVMDPKMVIPSIGVHIVLPSFYCPKDMGLLDVRTSDGRVMFFLPWQGKVLAGTTDIPLKQVPENPMPTEADIQDILKELQHYIEFPVKREDVLSAWAGVRPLVRDPRTIPADGKKGSATQGVVRSHFLFTSDNGLITIAGGKWTTYRQMAEETVDKVVEVGGFHNLKPCHTRDIKLAGAEEWTQNYVALLAQNYHLSSKMSNYLVQNYGTRSSIICEFFKESMENKLPLSLADKENNVIYSSEENNLVNFDTFRYPFTIGELKYSMQYEYCRTPLDFLLRRTRFAFLDAKEALNAVHATVKVMGDEFNWSEKKRQWELEKTVNFIKTFGV

SEQ ID NO: 22079 - protein, 346 aa, Saccharomyces cerevisiae
MQKSILLTKPDGTQSNLHSIKTETPTTVEFDSEQMERGHRERGRSKKKRGERDSNVSSLSRSRSRASSRSRVREEEFLKWTVLRQDPSMRLRVVDVDSEEEGEGNDEDDDDGDGDDMDEEESDEEQVSDIENDLEIDEEFHYDLGMKVLPNFCTSINEVLDSSKPWIAKYEISIRGHENEDVSLEQLDGGYVRAMQLLTKGAGAEAGNQRSFILYTDLSSESTYALTYLMGAAVNQGDTVYIVHWEPSKPTDDSQMFANVARIRKHVMHLFDCVAGVLDDLDVVVLSLTHPYPKHLLNEMIHGLKPVALCCSLSVILSTLQNFVCSVPILAVRKKLKRAKRKGISE

SEQ ID NO: 22080 - protein, 1679 aa, Saccharomyces cerevisiae
MEDKISEFLNVPFESLQGVTYPVLRKLYKKIAKFERSEEEVTKLNVLVDEIKSQYYSRISKLKQLLDESSEQKNTAKEELNGLKDQLNEERSRYRREIDALKKQLHVSHEAMREVNDEKRVKEEYDIWQSRDQGNDSLNDDLNKENKLLRRKLMEMENILQRCKSNAISLQLKYDTSVQEKELMLQSKKLIEEKLSSFSKKTLTEEVTKSSHVENLEEKLYQMQSNYESVFTYNKFLLNQNKQLSQSVEEKVLEMKNLKDTASVEKAEFSKEMTLQKNMNDLLRSQLTSLEKDCSLRAIEKNDDNSCRNPEHTDVIDELIDTKLRLEKSKNECQRLQNIVMDCTKEEEATMTTSAVSPTVGKLFSDIKVLKRQLIKERNQKFQLQNQLEDFILELEHKTPELISFKERTKSLEHELKRSTELLETVSLTKRKQEREITSLRQKINGCEANIHSLVKQRLDLARQVKLLLLNTSAIQETASPLSQDELISLRKILESSNIVNENDSQAIITERLVEFSNVNELQEKNVELLNCIRILADKLENYEGKQDKTLQKVENQTIKEAKDAIIELENINAKMETRINILLRERDSYKLLASTEENKANTNSVTSMEAAREKKIRELEAELSSTKVENSAIIQNLRKELLIYKKSQCKKKTTLEDFENFKGLAKEKERMLEEAIDHLKAELEKQKSWVPSYIHVEKERASTELSQSRIKIKSLEYEISKLKKETASFIPTKESLTRDFEQCCKEKKELQMRLKESEISHNENKMDFSSKEGQYKAKIKELENNLERLRSDLQSKIQEIESIRSCKDSQLKWAQNTIDDTEMKMKSLLTELSNKETTIEKLSSEIENLDKELRKTKFQYKFLDQNSDASTLEPTLRKELEQIQVQLKDANSQIQAYEEIISSNENALIELKNELAKTKENYDAKIELEKKEKWAREEDLSRLRGELGEIRALQPKLKEGALHFVQQSEKLRNEVERIQKMIEKIEKMSTIVQLCKKKEMSQYQSTMKENKDLSELVIRLEKDAADCQAELTKTKSSLYSAQDLLDKHERKWMEEKADYERELISNIEQTESLRVENSVLIEKVDDTAANNGDKDHLKLVSLFSNLRHERNSLETKLTTCKRELAFVKQKNDSLEKTINDLQRTQTLSEKEYQCSAVIIDEFKDITKEVTQVNILKENNAILQKSLKNVTEKNREIYKQLNDRQEEISRLQRDLIQTKEQVSINSNKILVYESEMEQCKQRYQDLSQQQKDAQKKDIEKLTNEISDLKGKLSSAENANADLENKFNRLKKQAHEKLDASKKQQAALTNELNELKAIKDKLEQDLHFENAKVIDLDTKLKAHELQSEDVSRDHEKDTYRTLMEEIESLKKELQIFKTANSSSDAFEKLKVNMEKEKDRIIDERTKEFEKKLQETLNKSTSSEAEYSKDIETLKKEWLKEYEDETLRRIKEAEENLKKRIRLPSEERIQKIISKRKEELEEEFRKKLKENAGSLTFLDNKGSGEDAEEELWNSPSKGNSERPSAVAGFINQKNLKPQEQLKNVKNDVSFNDSQSMVTNKENNIVDSSAAGNKAIPTFSFGKPFFSSNTSSLQSFQNPFTASQSNINTNAPLRTLNIQPEVAVKAAINFSNVTDLTNNSTDGAKITEIGSTSKRPIESGTSSDPDTKKVKESPANDQASNE

SEQ ID NO: 22081 - protein, 128 aa, Saccharomyces cerevisiae [sequence omitted]

SEQ ID NO: 22082 - protein, 1220 aa, Saccharomyces cerevisiae
MRFGLPSKLELTPPFRIGIRTQLTALVSIVALGSLIILAVTTGVYFTSNYKNLRSDRLYIAAQLKSSQIDQTLNYLYYQAYYLASRDALQSSLTSYVAGNKSADNWVDSLSVIQKFLSSSNLFYVAKVYDSSFNAVLNATNNGTGDLIPEDVLDSLFPLSTDTPLPSSLETIGILTDPVLNSTDYLMSMSLPIFANPSIILTDSRVYGYITIIMSAEGLKSVFNDTTALEHSTIAIISAVYNSQGKASGYHFVFPPYGSRSDLPQKVFSIKNDTFISSAFRNGKGGSLKQTNILSTRNTALGYSPCSFNLVNWVAIVSQPESVFLSPATKLAKIITGTVIAIGVFVILLTLPLAHWAVQPIVRLQKATELITEGRGLRPSTPRTISRASSFKRGFSSGFAVPSSLLQFNTAEAGSTTSVSGHGGSGHGSGAAFSANSSMKSAINLGNEKMSPPEEENKIPNNHTDAKISMDGSLNHDLLGPHSLRHNDTDRSSNRSHILTTSANLTEARLPDYRRLFSDELSDLTETFNTMTDALDQHYALLEERVRARTKQLEAAKIEAEAANEAKTVFIANISHELRTPLNGILGMTAISMEETDVNKIRNSLKLIFRSGELLLHILTELLTFSKNVLQRTKLEKRDFCITDVALQIKSIFGKVAKDQRVRLSISLFPNLIRTMVLWGDSNRIIQIVMNLVSNALKFTPVDGTVDVRMKLLGEYDKELSEKKQYKEVYIKKGTEVTENLETTDKYDLPTLSNHRKSVDLESSATSLGSNRDTSTIQEEITKRNTVANESIYKKVNDREKASNDDVSSIVSTTTSSYDNAIFNSQFNKAPGSDDEEGGNLGRPIENPKTWVISIEVEDTGPGIDPSLQESVFHPFVQGDQTLSRQYGGTGLGLSICRQLANMMHGTMKLESKVGVGSKFTFTLPLNQTKEISFADMEFPFEDEFNPESRKNRRVKFSVAKSIKSRQSTSSVATPATNRSSLTNDVLPEVRSKGKHETKDVGNPNMGREEKNDNGGLEQLQEKNIKPSICLTGAEVNEQNSLSSKHRSRHEGLGSVNLDRPFLQSTGTATSSRNIPTVKDDDKNETSVKILVVEDNHVNQEVIKRMLNLEGIENIELACDGQEAFDKVKELTSKGENYNMIFMDVQMPKVDGLLSTKMIRRDLGYTSPIVALTAFADDSNIKECLESGMNGFLSKPIKRPKLKTILTEFCAAYQGKKNNK

SEQ ID NO: 22083 - protein, 843 aa, Saccharomyces cerevisiae
MTDVEGYQPKSKGKIFPDMGESFFSSDEDSPATDAEIDENYDDNRETSEGRGERDTGAMVTGLKKPRKKTKSSRHTAADSSMNQMDAKDKALLQDTNSDIPADFVPDSVSGMFRSHDFSYLRLRPDHASRPLWISPSDGRIILESFSPLAEQAQDFLVTIAEPISRPSHIHEYKITAYSLYAAVSVGLETDDIISVLDRLSKVPVAESIINFIKGATISYGKVKLVIKHNRYFVETTQADILQMLLNDSVIGPLRIDSDHQVQPPEDVLQQQLQQTAGKPATNVNPNDVEAVFSAVIGGDNEREEEDDDIDAVHSFEIANESVEVVKKRCQEIDYPVLEEYDFRNDHRNPDLDIDLKPSTQIRPYQEKSLSKMFGNGRARSGIIVLPCGAGKTLVGITAACTIKKSVIVLCTSSVSVMQWRQQFLQWCTLQPENCAVFTSDNKEMFQTESGLVVSTYSMVANTRNRSHDSQKVMDFLTGREWGFIILDEVHVVPAAMFRRVVSTIAAHAKLGLTATLVREDDKIGDLNFLIGPKLYEANWMELSQKGHIANVQCAEVWCPMTAEFYQEYLRETARKRMLLYIMNPTKFQACQFLIQYHERRGDKIIVFSDNVYALQEYALKMGKPFIYGSTPQQERMNILQNFQYNDQINTIFLSKVGDTSIDLPEATCLIQISSHYGSRRQEAQRLGRILRAKRRNDEGFNAFFYSLVSKDTQEMYYSTKRQAFLVDQGYAFKVITHLHGMENIPNLAYASPRERRELLQEVLLKNEEAAGIEVGDDADNSVGRGSNGHKRFKSKAVRGEGSLSGLAGGEDMAYMEYSTNKNKELKEHHPLIRKMYYKNLKK

SEQ ID NO: 22084 - protein, 527 aa, Saccharomyces cerevisiae
MSVQIFGDQVTEERAENARLSAFVGAIAVGDLVKSTLGPKGMDKLLQSASSNTCMVTNDGATILKSIPLDNPAAKVLVNISKVQDDEVGDGTTSVTVLSAELLREAEKLIDQSKIHPQTIIEGYRLASAAALDALTKAAVDNSHDKTMFREDLIHIAKTTLSSKILSQDKDHFAELATNAILRLKGSTNLEHIQIIKILGGKLSDSFLDEGFILAKKFGNNQPKRIENAKILIANTTLDTDKVKIFGTKFKVDSTAKLAQLEKAEREKMKNKIAKISKFGINTFINRQLIYDYPEQLFTDLGINSIEHADFEGVERLALVTGGEVVSTFDEPSKCKLGECDVIEEIMLGEQPFLKFSGCKAGEACTIVLRGATDQTLDEAERSLHDALSVLSQTTKETRTVLGGGCAEMVMSKAVDTEAQNIDGKKSLAVEAFARALRQLPTILADNAGFDSSELVSKLRSSIYNGISTSGLDLNNGTIADMRQLGIVESYKLKRAVVSSASEAAEVLLRVDNIIRARPRTANRQHM

SEQ ID NO: 22085 - protein, 245 aa, Saccharomyces cerevisiae
MNRWVEKWLRVYLKCYINLILFYRNVYPPQSFDYTTYQSFNLPQFVPINRHPALIDYIEELILDVLSKLTHVYRFSICIINKKNDLCIEKYVLDFSELQHVDKDDQIITETEVFDEFRSSLNSLIMHLEKLPKVNDDTITFEAVINAIELELGHKLDRNRRVDSLEEKAEIERDSNWVKCQEDENLPDNNGFQPPKIKLTSLVGSDVGPLIIHQFSEKLISGDDKILNGVYSQYEEGESIFGSLF

SEQ ID NO: 22086 - protein, 946 aa, Saccharomyces cerevisiae
MSDNLLSLENPVVPSHYELRLEIDPKQSSPNFKGSAIIHLKFNPNSTTLASIEDSFTQFKLHSKDLIVLSAHATIGSTKFDLKISQDTGKHLSIFNSESPIQLSNDCPLILSVQYVGKIRDIKTHHDKTFGIFKTNFMDRKTGTANNHVVATHCQPFSASNIFPCIDEPSNKSTFQLNIATDAQYKAVSNTPVEMVEALDSSQKHLVKFAKTPLMTTSVFGFSIGDLEFLKTEIKLEGDRTIPVSIYAPWDIANAAFTLDTVQKYLPLLESYFKCPYPLPKLDFVLLPYLSDMAMENFGMITIQLNHLLIPPNALANETVREQAQQLIVHELVHQWMGNYISFDSWESLWFNESFATWLACHILEQNGDLSHYWTSEPYLLQQVEPTMCRDAADVNGRSIFQIAQRNTGIDSQTSDIFDPEAYTKGIIMLRSLQLATGESHLQKGLESVFEDTKTFHARSVKPMDIWNHIGKFLKSQNITNFVSSWTRTPGLPVVKVEVEEKDGKTQTKLTQHRFINQLSTEEKDQLEDVPYQVPLFGVLPDGKMDTKNVLLTDRTLKFDYPILVINHLAQGYYRVSYESEECYALINDKITEETLSEIDLRKIFLDLSQFIGDEGFQNSIHLHGLFKILNHIASPSTKIASKYWDPLSKGLEVLQTIDRASLTSSKLQSFLKKKIVIPLFNKIDWPHGEFDKSTNPHELKVMSQVLFLNKNSAKCAELCQIYFKHLLQGPRSSVPLELVNSILVVVSQHCANIKQWKKIFDLVKRSSCTGITNHVINMYDQNSSETAMLIQNGAIESLGFCLDSDIVKKTLNFITSNIESEGMELALFGFNYNFKKRLNKNEKPQDQVVRETIWEWYMGNFDQWARKATRKGTTTGDHLHKALRSISLIIFQMFVADEPQKIEKFINLEKEKLGQSLLSLDDIWASVQQDEESRKTIRRDLASLV

SEQ ID NO: 22087 - protein, 393 aa, Saccharomyces cerevisiae
MSSRIIVGSAALAAAITASIMVREQKAKGQRREGNVSAYYNGQEYGSSAPPQLGKLHNIKQGIKEDALSLKDALLGVSQKAREEAPKVTKRVISPEEDAQTRKQLGQKAKDSSSQSIFNWGFSEAERRKAIAIGEFDTAKKRFEEAVDRNEKELLSTVMREKKAALDRASIEYERYGRARDFNELSDKLDQQERNSNPLKRLLKNNTGDANTEEAAARSVQGWGDTAQEFGREELEEAKRNASSEPSEAQKRLDELKKIKEKGWFGYNKGEQSEQQIAERVARGLEGWGETAAQLSKDEMDDLRWNYENSKKQLDKNVSDAMDSLSKAKEDLKQYGSHWWSGWTSKVDNDKQALKDEAQKKYDEALKKYDEAKNKFKEWNDKGDGKFWSSKKD

SEQ ID NO: 22088 - protein, 311 aa, Saccharomyces cerevisiae
MVDHQWTPLQKEVISGLSAGSVTTLVVHPLDLLKVRLQLSATSAQKAHYGPFMVIKEIIRSSANSGRSVTNELYRGLSINLFGNAIAWGVYFGLYGVTKELIYKSVAKPGETQLKGVGNDHKMNSLIYLSAGASSGLMTAILTNPIWVIKTRIMSTSKGAQGAYTSMYNGVQQLLRTDGFQGLWKGLVPALFGVSQGALYFAVYDTLKQRKLRRKRENGLDIHLTNLETIEITSLGKMVSVTLVYPFQLLKSNLQSFRANEQKFRLFPLIKLIIANDGFVGLYKGLSANLVRAIPSTCITFCVYENLKHRL

SEQ ID NO: 22089 - protein, 871 aa, Saccharomyces cerevisiae
GSSTEQVKRINDLFIETFLHVANGEKDPRNLLLSFALNKSITSSLQNVENFKEDLFDVLFCYFPITFKPPKHDPYKISNQDLKTALRSAITATPLFAEDAYSNLLDKLTASSPVVKNDTLLTLLECVRKFGGSSILENWTLLWNALKFEIMQNSEGNENTLLNPYNKDQQSDDVGQYTNYDACLKIINLMALQLYNFDKVSFEKFFTHVLDELKPNFKYEKDLKQTCQILSAIGSGNVEIFNKVISSTFPLFLINTSEVAKLKLLIMNFSFFVDSYIDLFGRTSKESLGTPVPNNKMAEYKDEIIMILSMALTRSSKAEVTIRTLSVIQFTKMIKMKGFLTPEEVSLIIQYFTEEILTDNNKNIYYACLEGLKTISEIYEDLVFEISLKKLLDLLPDCFEEKIRVNDEENIHIETILKIILDFTTSRHILVKESITFLATKLNRVAKISKSREYCFLLISTIYSLFNNNNQNENVLNEEDALALKNAIEPKLFEIITQESAIVSDNYNLTLLSNVLFFTNLKIPQAAHQEELDRYNELFISEGKIRILDTPNVLAISYAKILSALNKNCQFPQKFTVLFGTVQLLKKHAPRMTETEKLGYLELLLVLSNKFVSEKDVIGLFDWKDLSVINLEVMVWLTKGLIMQNSLESSEIAKKFIDLLSNEEIGSLVSKLFEVFVMDISSLKKFKGISWNNNVKILYKQKFFGDIFQTLVSNYKNTVDMTIKCNYLTALSLVLKHTPSQSVGPFINDLFPLLLQALDMPDPEVRVSALETLKDTTDKHHTLITEHVSTIVPLLLSLSLPHKYNSVSVRLIALQLLEMITTVVPLNYCLSYQDDVLSALIPVLSDKKRIIRKQCVDTRQVYYELGQIPFE

SEQ ID NO: 22090 - protein, 1359 aa, Saccharomyces cerevisiae
MLQEQSELMSTVMNNTPTTVAALAAVAAASETNGKLGSEEQPEITIPKPRSSAQLEQLLYRYRAIQNHPKENKLEIKAIEDTFRNISRDQDIYETKLDTLRKSIDKGFQYDEDLLNKHLVALQLLEKDTDVPDYFLDLPDTKNDNTTAIEVDYSEKKPIKISADFNAKAKSLGLESKFSNATKTALGDPDTEIRISARISNRINELERLPANLGTYSLDDCLEFITKDDLSSRMDTFKIKALVELKSLKLLTKQKSIRQKLINNVASQAHHNIPYLRDSPFTAAAQRSVQIRSKVIVPQTVRLAEELERQQLLEKRKKERNLHLQKINSIIDFIKERQSEQWSRQERCFQFGRLGASLHNQMEKDEQKRIERTAKQRLAALKSNDEEAYLKLLDQTKDTRITQLLRQTNSFLDSLSEAVRAQQNEAKILHGEEVQPITDEEREKTDYYEVAHRIKEKIDKQPSILVGGTLKEYQLRGLEWMVSLYNNHLNGILADEMGLGKTIQSISLITYLYEVKKDIGPFLVIVPLSTITNWTLEFEKWAPSLNTIIYKGTPNQRHSLQHQIRVGNFDVLLTTYEYIIKDKSLLSKHDWAHMIIDEGHRMKNAQSKLSFTISHYYRTRNRLILTGTPLQNNLPELWALLNFVLPKIFNSAKTFEDWFNTPFANTGTQEKLELTEEETLLIIRRLHKVLRPFLLRRLKKEVEKDLPDKVEKVIKCKLSGLQQQLYQQMLKHNALFVGAGTEGATKGGIKGLNNKIMQLRKICNHPFVFDEVEGVVNPSRGNSDLLFRVAGKFELLDRVLPKFKASGHRVLMFFQMTQVMDIMEDFLRMKDLKYMRLDGSTKTEERTEMLNAFNAPDSDYFCFLLSTRAGGLGLNLQTADTVIIFDTDWNPHQDLQAQDRAHRIGQKNEVRILRLITTDSVEEVILERAMQKLDIDGKVIQAGKFDNKSTAEEQEAFLRRLIESETNRDDDDKAELDDDELNDTLARSADEKILFDKIDKERMNQERADAKAQGLRVPPPRLIQLDELPKVFREDIEEHFKKEDSEPLGRIRQKKRVYYDDGLTEEQFLEAVEDDNMSLEDAIKKRREARERRRLRQNGTKENEIETLENTPEASETSLIENNSFTAAVDEETNADKETTASRSKRRSSRKKRTISIVTAEDKENTQEESTSQENGGAKVEEEVKSSSVEIINGSESKKKKPKLTVKIKLNKTTVLENNDGKRAEEKPESKSPAKKTAAKKTKTKSKSLGIFPTVEKLVEEMREQLDEVDSHPRTSIFEKLPSKRDYPDYFKVIEKPMAIDIILKNCKNGTYKTLEEVRQALQTMFENARFYNEEGSWVYVDADKLNEFTDEWFKEHSS

SEQ ID NO: 22091 - protein, 1014 aa, Saccharomyces cerevisiae
MLRFVSSQTCRYSSRGLLKTSLLKNASTVKIVGRGLATTGTDNFLSTSNATYIDEMYQAWQKDPSSVHVSWDAYFKNMSNPKIPATKAFQAPPSISNFPQGTEAAPLGTAMTGSVDENVSIHLKVQLLCRAYQVRGHLKAHIDPLGISFGSNKNNPVPPELTLDYYGFSKHDLDKEINLGPGILPRFARDGKSKMSLKEIVDHLEKLYCSSYGVQYTHIPSKQKCDWLRERIEIPEPYQYTVDQKRQILDRLTWATSFESFLSTKFPNDKRFGLEGLESVVPGIKTLVDRSVELGVEDIVLGMAHRGRLNVLSNVVRKPNESIFSEFKGSSARDDIEGSGDVKYHLGMNYQRPTTSGKYVNLSLVANPSHLESQDPVVLGRTRALLHAKNDLKEKTKALGVLLHGDAAFAGQGVVYETMGFLTLPEYSTGGTIHVITNNQIGFTTDPRFARSTPYPSDLAKAIDAPIFHVNANDVEAVTFIFNLAAEWRHKFHTDAIIDVVGWRKHGHNETDQPSFTQPLMYKKIAKQKSVIDVYTEKLISEGTFSKKDIDEHKKWVWNLFEDAFEKAKDYVPSQREWLTAAWEGFKSPKELATEILPHEPTNVPESTLKELGKVLSSWPEGFEVHKNLKRILKNRGKSIETGEGIDWATGEALAFGTLVLDGQNVRVSGEDVERGTFSQRHAVLHDQQSEAIYTPLSTLNNEKADFTIANSSLSEYGVMGFEYGYSLTSPDYLVMWEAQFGDFANTAQVIIDQFIAGGEQKWKQRSGLVLSLPHGYDGQGPEHSSGRLERFLQLANEDPRYFPSEEKLQRQHQDCNFQVVYPTTPANLFHILRRQQHRQFRKPLALFFSKQLLRHPLARSSLSEFTEGGFQWIIEDIEHGKSIGTKEETKRLVLLSGQVYTALHKRRESLGDKTTAFLKIEQLHPFPFAQLRDSLNSYPNLEEIVWCQEEPLNMGSWAYTEPRLHTTLKETDKYKDFKVRYCGRNPSGAVAAGSKSLHLAEEDAFLKDVFQQS

SEQ ID NO: 22092 - protein, 475 aa, Saccharomyces cerevisiae
MKFSTAVTTLISSGAIVSALPHVDVHQEDAHQHKRAVAYKYVYETVVVDSDGHTVTPAASEVATAATSAIITTSVLAPTSSAAAGIAASIAVSSAALAKNEKISDAAASATASTSQGASSSSSSSSATSTLESSSVSSSSEEAAPTSTVVSTSSATQSSASSATKSSTSSTSPSTSTSTSTSSTSSSSSSSSSSSSSSSGSGSIYGDLADFSGPSEKFQDGTIPCDKFPSGQGVISIDWIGEGGWSGVENTDTSTGGSCKEGSYCSYSCQPGMSKTQWPSDQPSDGRSVGGLLCKNGYLYRSNTDADYLCEWGVEAAYVVSKLSKGVAICRTDYPGTENMVIPTYVEGGSSLPLTVVDQDTYFTWEGKKTSAQYYVNNAGVSVEDGCIWGTSGSGIGNWAPLNFGAGSTGGVTYLSLIPNPNNSDALNYNVKIVAADDSSNVIGECVYENGEFSGGADGCTVSVTSGKAHFVLYN

SEQ ID NO: 22093 - protein, 407 aa, Saccharomyces cerevisiae
MYLEYLQPKLNLMDESSTISKNFPDYSPNLNTPITSNFNEETGSDCSLVTPRIISSSNSNSNSNSNSNSNSNSGSIDENELNNSNSSSSSARQIRKKWKEPEDIAFITTIMNNSQLLTFVEYFKPMKNFWKKISKILFQQYGYERNSRQCHDRFKVLYTKSLKVHPSKKSKQKKKKSKQEAGSNLNFDPSKLSRMQYLLVQLQNTFSFVNGNIILKSQKTLKPNKNGTNDNINNHYYNNCNNNNNNINNSNNSNNNNSNNINRNSNHSTNVFSTPEHIQSSINLDKLESLPALDTKGEPSFISPAQFSLLSSAPADNLILQTPPSPFFQQTMPIQLPRDAQQEQISPVFSTDVIYMWQTMFNTIENLKEQVNCLKNEVKQLNHKFYQQNKPLHNMSTSDSENFMQQH

SEQ ID NO: 22094 - protein, 227 aa, Saccharomyces cerevisiae
MSFLCGSASTSNKPIERKIVILGDGACGKTSLLNVFTRGYFPEVYEPTVFENYIHDIFVDSKHITLSLWDTAGQEEFDRLRSLSYSDTQCIMLCFSIDSRDSLENVQNKWVGEITDHCEGVKLVLVALKCDLRNNENESNAITPNNIQQDNSVSNDNGNNINSTSNGKNLISYEEGLAMAKKIGALRYLECSAKLNKGVNEAFTEAARVALTAGPVATEVKSDSGSS

SEQ ID NO: 22095 - protein, 385 aa, Saccharomyces cerevisiae
MVFDLKRIVRPKIYNLEPYRCARDDFTEGILLDANENAHGPTPVELSKTNLHRYPDPHQLEFKTAMTKYRNKTSSYANDPEVKPLTADNLCLGVGSDESIDAIIRACCVPGKEKILVLPPTYSMYSVCANINDIEVVQCPLTVSDGSFQMDTEAVLTILKNDSLIKLMFVTSPGNPTGAKIKTSLIEKVLQNWDNGLVVVDEAYVDFCGGSTAPLVTKYPNLVTLQTLSKSFGLAGIRLGMTYATAELARILNAMKAPYNISSLASEYALKAVQDSNLKKMEATSKIINEEKMRLLKELTALDYVDDQYVGGLDANFLLIRINGGDNVLAKKLYYQLATQSGVVVRFRGNELGCSGCLRITVGTHEENTHLIKYFKETLYKLANE

SEQ ID NO: 22096 - protein, 549 aa, Saccharomyces cerevisiae
MARQKMFYNKLLGMLSVGFGFAWALENITIYEFDFGKGILDQSYGGVFSNNGPSQVQLRDAVLMNGTVVYDSNGAWDSSALEEWLQGQKKVSIEKIFENIGPSAVYPSISPGVVIASPSQTHPDYFYQWIRDSALTINSIVSHSAGPAIETLLQYLNVSFHLQRSNNTLGAGIGYTNDTVALGDPKWNVDNTAFTEDWGRPQNDGPALRSIAILKIIDYIKQSGTDLGAKYPFQSTADIFDDIVRWDLRFIIDHWNSSGFDLWEEVNGMHFFTLLVQLSAVDKSLSYFNASERSSPFVEELRQTRRDISKFLVDPANGFINGKYNYIVGTPMIADTLRSGLDISTLLAANTVHDAPSASHLPFDINDPAVLNTLHHLMLHMRSIYPINDSSKNATGIALGRYPEDVYDGYGFGEGNPWVLATCTASTTLYQLIYRHISEQHDLVVPMNNDCSNAFWSELVFSNLTTLGNDEGYLILEFNTPAFNQTIQKIFQLADSFLVKLKAHVGTDGELSEQFNKYTGFMQGAQHLTWSYTSFWDAYQIRQEVLQSL

SEQ ID NO: 22097 - protein, 371 aa, Saccharomyces cerevisiae
MFRSVATRLSACRGLASNAARKSLTIGLIPGDGIGKEVIPAGKQVLENLNSKHGLSFNFIDLYAGFQTFQETGKALPDETVKVLKEQCQGALFGAVQSPTTKVEGYSSPIVALRREMGLFANVRPVKSVEGEKGKPIDMVIVRENTEDLYIKIEKTYIDKATGTRVADATKRISEIATRRIATIALDIALKRLQTRGQATLTVTHKSNVLSQSDGLFREICKEVYESNKDKYGQIKYNEQIVDSMVYRLFREPQCFDVIVAPNLYGDILSDGAAALVGSLGVVPSANVGPEIVIGEPCHGSAPDIAGKGIANPIATIRSTALMLEFLGHNEAAQDIYKAVDANLREGSIKTPDLGGKASTQQVVDDVLSRL

SEQ ID NO: 22098 - protein, 517 aa, Saccharomyces cerevisiae
MAIRLNPKVRRFLLDKCRQKRYGFLFLGCIFAILYCMGTWPFFAKDIVHDPNNLPYSLQDYSTDKDEPFFRGCTDTKLYLQNPAYSKMNASFVMLTRNEEIEDVLKTMRSIEGHFNKWFKYPYVFLNDDPFTDHFKDQIQAATNATVEFGTVDEIMWEFPAKVRNSLQFKASLEDQNDRGIMYGNMESYHKMCRFYSGIFYKHPLVSKYEWYWRIEPDVDFFCDISYDPFFEMAKHNKKYGFTVLITELYWTVPNLFRTTKSFIKKTAGLKENLGTLWKLFTFNYNILDTDDEEISRWVNFPWDAKPKLTEKLMVDFLLENHGQVNNEEDLEGIQYLVERARSKVPMLEDSLEGEDYNLCHFWSNFEIARVDLFDNEIYNAYFKFLEESGGFWTERWGDAPIHSIGLGMTLDLEDVHYFRDIGYRHSSLQHCPKNALQSQENLNTFDEGYNFGCGCRCVCPKKGEDIEDHSTPCMDIFFELLHGREYEKEFPGCYKPSIKDKDVIEEIRRENFRVIE

SEQ ID NO: 22099 - protein, 1099 aa, Saccharomyces cerevisiae
TNVEHVRRVLTDLELESKDQQTLFIKTLPIVHYIAIPEMDNTAEKTIKIQNTKVKTLFDSGSPTSFIRRDIVELLKYEIYETPPLRFRGFVATKSAVTSEAVTIDLKINDLQITLAAYILDNMDYQLLIGNPILRRYPKILHTVLNTRESPDSLKPKTYRSETVNNVRTYSAGNRGNPRNIKLSFAPTILEATDPKSAGNRGNPRNTKLSLAPTILEATDPKSAGNRGDSRTKTLSLATTTPAAIDPLTTLDNPGSTQSTFAQFPIPEEASILEEDGKYSNVVSTIQSVEPNATDHSNKDTFCTLPVWLQQKYREIIRNDLPPRPADINNIPVKHDIEIKPGARLPRLQPYHVTEKNEQEINKIVQKLLDNKFIVPSKSPCSSPVVLVPKKDGTFRLCVDYRTLNKATISDPFPLPRIDNLLSRIGNAQIFTTLDLHSGYHQIPMEPKDRYKTAFVTPSGKYEYTVMPFGLVNAPSTFARYMADTFRDLRFVNVYLDDILIFSESPEEHWKHLDTVLERLKNENLIVKKKKCKFASEETEFLGYSIGIQKIAPLQHKCAAIRDFPTPKTVKQAQRFLGMINYYRRFIPNCSKIAQPIQLFICDKSQWTEKQDKAIEKLKAALCNSPVLVPFNNKANYRLTTDASKDGIGAVLEEVDNKNKLVGVVGYFSKSLESAQKNYPAGELELLGIIKALHHFRYMLHGKHFTLRTDHISLLSLQNKNEPARRVQRWLDDLATYDFTLEYLAGPKNVVADAISRAIYTITPETSRPIDTESWKSYYKSDPLCSAVLIHMKELTQHNVTPEDMSAFRSYQKKLELSETFRKNYSLEDEMIYYQDRLVVPIKQQNAVMRLYHDHTLFGGHFGVTVTLAKISPIYYWPKLQHSIIQYIRTCVQCQLIKSHRPRLHGLLQPLPIAEGRWLDISMDFVTGLPPTSNNLNMILVVVDRFSKRAHFIATRKTLDATQLIDLLFRYIFSYHGFPRTITSDRDVRMTADKYQELTKRLGIKSTMSSANHPQTDGQSERTIQTLNRLLRAYVSTNIQNWHVYLPQIEFVYNSTPTRTLGKSPFEIDLGYLPNTPAIKSDDEVNARSFTAVELAKHL

SEQ ID NO: 22100 - protein, 805 aa, Saccharomyces cerevisiae
MSSDPLQQVCDLIKGDLSLERVRDIKEQLLKEKSVVEYQLNKESDKYYGEVEESLKLLNLSKNSVTSIKQQINEVNKLGNDNRFAINRYDILFRATKLYETVNTTSSIYDRIYNFVALMEHIERLLVAELAEDALETGCPHLLEIHFLLTSARDFQEQVVVMAKEATEDAQRTVMKLFSRLSGIISKFDKLLDGLTYDIVEMARAEQISLAIRLFKIYDLEEREDLRIEAIRNIIKKKEIEIEKSSIKKLPNSKNTARLQDETPKVIEYPTNKGLYQEIMSGTISTRTAPRGYKHFLINGINNSISEMFGEMREKYVGDQKFDVLDNMDWIFNELIIVKEHIANCCPPHWNIFEVYFDQYYKELHSLITDLVESEPETIIILDILAFDKTFQDTLKQDFGFTKSEVKSVIGDKEKETLFKDYLNLIVVKMTEWIGNLEKAEFDVFLERSTPPHSDSDGLLFLDGTKTCFQMFTQQVEVAAGTNQAKILVGVVERFSDLLTKRQKNWISKISEEIKKQINYNHKYDIDPESITPEDECPGGLVEYLIAVSNDQMKAADYAVAISSKYGKLVSKVYEKQITNHLEGTLDGFAEVAQCSSLGLITLMFDDLRKPYQEIFSKTWYMGSQAQQIADTLDEYLLDIKPQMNSVLFVNFIDNVIGETIIKFLTALSFEHSFKNKNNKFLEAMKRDFEIFYQLFVKVLDGNESKDTLITQNFTVMEFFMDLSCEPIDSILDIWQKYLEVYWDSRIDLLVGILKCRKDVSSSERKKIVQQATEMLHEYRRNMEANGVDREPTLMRRFVLEFEKQ

SEQ ID NO: 22101 - protein, 885 aa, Saccharomyces cerevisiae
MTSKNSSSNKSNTPTQMYVIKRDGRKEPVQFDKITSRITRLSYGLDPNRIDAVKVTQRIISGVYSGVTTVELDNLAAETCAYMTTVHPDYATLAARIAISNLHKQTTKQFSKVIEDLHDWINPATGKHAPMISDEIYNIVMENKDTLNSAIVYDRDFQYTYFGFKTLERSYLLRLNGEVAERPQHLVMRVALGIHGSDIESVLKTYNLMSLRYFTHASPTLFNAGTPHPQMSSCFLIAMKDDSIEGIYDTLKECAMISKTAGGVGLHINNIRSTGSYIAGTNGTSNGLIPMIRVFNNTARYVDQGGNKRPGAFALFLEPWHADIFDFVDIRKTHGKEEIRARDLFPALWIPDLFMKRVQEDGPWTLFSPSAAPGLDDVWGDEFEELYTRYEREGRGKTIKAQKLWYAILQAQTETGTPFMVYKDACNRKTNQQNLGTIKSSNLCCEIVEYSSPDETAVCNLASIALPAFVEVSEDGKTASYNFERLHEIAKVITHNLNRVIDRNYYPVPEARNSNMKHRPIALGVQGLADTYMMLRLPFESEEAQTLNKQIFETIYHATLEASCELAQKEGKYSTFEGSPASKGILQFDMWNAKPFGMWDWETLRKDIVKHGLRNSLTMAPMPTASTSQILGYNECFEPVTSNMYSRRVLSGEFQVVNPYLLRDLVDLGIWDDSMKQYLITQNGSIQGLPNVPQELKELYKTVWEISQKTIINMAADRAIYIDQSHSLNLFLQAPSMGKITSMHFYGWKKGLKTGMYYLRTQAASAAIQFTIDQEVADQAATHIASVSELDRPVYVPKGTKFSEQKAASALTESSDNEKDASPVPSEQSSVSSAMSNVKLEDSVAPAVPTETIKEDSDEKKCDIYNEKVIACTAPTPEACESCSG

SEQ ID NO: 22102 - protein, 271 aa, Saccharomyces cerevisiae
MKRFNVLKYIRTTKANIQTIAMPLTTKPLSLKINAALFDVDGTIIISQPAIAAFWRDFGKDKPYFDAEHVIHISHGWRTYDAIAKFAPDFADEEYVNKLEGEIPEKYGEHSIEVPGAVKLCNALNALPKEKWAVATSGTRDMAKKWFDILKIKRPEYFITANDVKQGKPHPEPYLKGRNGLGFPINEQDPSKSKVVVFEDAPAGIAAGKAAGCKIVGIATTFDLDFLKEKGCDIIVKNHESIRVGEYNAETDEVELIFDDYLYAKDDLLKW

SEQ ID NO: 22103 - protein, 285 aa, Saccharomyces cerevisiae
MELSSPSKKTTTSPINIPGGNRDNLIIGPHSHSFKTDPFSSNNSSLLSKISTNPSLESPFSSKSLLDCSPVQAVKKSLESEAKTHSLDEETNEQTDVKILNIADFPTDELILMISALLNRIITANDETTDVSQQVSDETEDELLTPILAFYGKNVPEIAVVQYLERIQKYCPTTNDIFLSLLVYFDRISKNYGHSSERNGCAKQLFVMDSGNIHRLLITGVTICTKFLSDFFYSNSRYAKVGGISLQELNHLELQFLILCDFKLLVSVEEMQKYANLLYKFWNDQ

SEQ ID NO: 22104 - protein, 1151 aa, Saccharomyces cerevisiae
MPNPPSFKSHKQNLFNSNNNQHANSVDSFDLHLDDSFDAALDSLQINNNPEPLSKHNTVGDRESFEMRTVDDLDNFSNHSSDSHRKSSNTDTHPLMYDNRLSQDDNFKFTNIASSPPSSSNNIFSKALSYLKVSNTKNWSKFGSPIELSDQHIEREIHPDTTPVYDRNRYVSNELSNAKYNAVTFVPTLLYEQFKFFYNLYFLVVALSQAVPALRIGYLSSYIVPLAFVLTVTMAKEAIDDIQRRRRDRESNNELYHVITRNRSIPSKDLKVGDLIKVHKGDRIPADLVLLQSSEPSGESFIKTDQLDGETDWKLRVACPLTQNLSENDLINRISITASAPEKSIHKFLGKVTYKDSTSNPLSVDNTLWANTVLASSGFCIACVVYTGRDTRQAMNTTTAKVKTGLLELEINSISKILCACVFALSILLVAFAGFHNDDWYIDILRYLILFSTIIPVSLRVNLDLAKSVYAHQIEHDKTIPETIVRTSTIPEDLGRIEYLLSDKTGTLTQNDMQLKKIHLGTVSYTSETLDIVSDYVQSLVSSKNDSLNNSKVALSTTRKDMSFRVRDMILTLAICHNVTPTFEDDELTYQAASPDEIAIVKFTESVGLSLFKRDRHSISLLHEHSGKTLNYEILQVFPFNSDSKRMGIIVRDEQLDEYWFMQKGADTVMSKIVESNDWLEEETGNMAREGLRTLVIGRKKLNKKIYEQFQKEYNDASLSMLNRDQQMSQVITKYLEHDLELLGLTGVEDKLQKDVKSSIELLRNAGIKIWMLTGDKVETARCVSISAKLISRGQYVHTITKVTRPEGAFNQLEYLKINRNACLLIDGESLGMFLKHYEQEFFDVVVHLPTVIACRCTPQQKADVALVIRKMTGKRVCCIGDGGNDVSMIQCADVGVGIVGKEGKQASLAADFSITQFCHLTELLLWHGRNSYKRSAKLAQFVMHRGLIIAICQAVYSICSLFEPIALYQGWLMVGYATCYTMAPVFSLTLDHDIEESLTKIYPELYKELTEGKSLSYKTFFVWVLLSLFQGSVIQLFSQAFTSLLDTDFTRMVAISFTALVVNELIMVALEIYTWNKTMLVTEIATLLFYIVSVPFLGDYFDLGYMTTVNYYAGLLVILLISIFPVWTAKAIYRRLHPPSYAKVQEFATP

SEQ ID NO: 22105 - protein, 640 aa, Saccharomyces cerevisiae
MRRERQRMMSFEDKDKDDLDNSNSNNSSEMTDTAMMPPLKRLLITGSSDDLAQGSSGKKKMTMATRSPSSSPDLATNDSGTRVQPLPEYNFTKFCYRHNPDIQFSPTHTACYKQDLKRTQEINANIAKLPLQEQSDIHHIISKYSNSNDKIRKLILDGILSTSCFPQLSYISSLVTHMIKIDFISILPQELSLKILSYLDCQSLCNATRVCRKWQKLADDDRVWYHMCEQHIDRKCPNCGWGLPLLHMKRARIQQNSTGSSSNADIQTQTTRPWKVIYRERFKVESNWRKGHCRIQEFKGHMDGVLTLQFNYRLLFTGSYDSTIGIWDLFTGKLIRRLSGHSDGVKTLYFDDRKLITGSLDKTIRVWNYITGECISTYRGHSDSVLSVDSYQKVIVSGSADKTVKVWHVESRTCYTLRGHTEWVNCVKLHPKSFSCFSCSDDTTIRMWDIRTNSCLKVFRGHVGQVQKIIPLTIKDVENLATDNTSDGSSPQDDPTMTDGADESDTPSNEQETVLDENIPYPTHLLSCGLDNTIKLWDVKTGKCIRTQFGHVEGVWDIAADNFRIISGSHDGSIKVWDLQSGKCMHTFNGRRLQRETQHTQTQSLGDKVAPIACVCIGDSECFSGDEFGCVKMYKFDLND

SEQ ID NO: 22106 - protein, 322 aa, Saccharomyces cerevisiae
MYKYSYYIRRKNEREKKVLKVCIQLALQQETQSIKQSKMAIDAQKLVVVIVIVVVPLLFKFIIGPKTKPVLDPKRNDFQSFPLVEKTILTHNTSMYKFGLPHADDVLGLPIGQHIVIKANINGKDITRSYTPTSLDGDTKGNFELLVKSYPTGNVSKMIGELKIGDSIQIKGPRGNYHYERNCRSHLGMIAGGTGIAPMYQIMKAIAMDPHDTTKVSLVFGNVHEEDILLKKELEALVAMKPSQFKIVYYLDSPDREDWTGGVGYITKDVIKEHLPAATMDNVQILICGPPAMVASVRRSTVDLGFRRSKPLSKMEDQVFVF

SEQ ID NO: 22107 - protein, 394 aa, Saccharomyces cerevisiae
MWKIMRSWKCGGMRWAHRQRPSHELLSQLSFDQHYKIRSNIELLIQDYASKPIAPLNYEYFLQYRPPLTKKEEYMLTIKTINLLLSLTCKRLNAIQRLPYNAVINPHIERTNSLYLKSLQTLLSIAYPYELHNPPKIQAKFTELLDDHEDAIVVLAKGLQEIQSCYPKFQISQFLNFHLKERITMKLLVTHYLSLMAQNKGDTNKRMIGILHRDLPIAQLIKHVSDYVNDICFVKFNTQRTPVLIHPPSQDITFTCIPPILEYIMTEVFKNAFEAQIALGKEHMPIEINLLKPDDDELYLRIRDHGGGITPEVEALMFNYSYSTHTQQSADSESTDLPGEQINNVSGMGFGLPMCKTYLELFGGKIDVQSLLGWGTDVYIKLKGPSKTALLSKK

SEQ ID NO: 22108 - protein, 372 aa, Saccharomyces cerevisiae
MKCRVWSEARVYTNINKQRTEEYWDYENTVIDWSTNTKDYEIENKVGRGKYSEVFQGVKLDSKVKIVIKMLKPVKKKKIKREIKILTDLSNEKVPPTTLPFQKDQYYTNQKEDVLKFIRPYIFDQPHNGHANIIHLFDIIKDPISKTPALVFEYVDNVDFRILYPKLTDLEIRFYMFELLKALDYCHSMGIMHRDVKPHNVMIDHKNKKLRLIDWGLAEFYHVNMEYNVRVASRFFKGPELLVDYRMYDYSLDLWSFGTMLASMIFKREPFFHGTSNTDQLVKIVKVLGTSDFEKYLLKYEITLPREFYDMDQYIRKPWHRFINDGNKHLSGNDEIIDLIDNLLRYDHQERLTAKEAMGHPWFAPIREQIEK

SEQ ID NO: 22109 - protein, 287 aa, Saccharomyces cerevisiae
MSDAQFDAALDLLRRLNPTTLQENLNNLIELQPNLAQDLLSSVDVPLSTQKDSADSNREYLCCDYNRDIDSFRSPWSNTYYPELSPKDLQDSPFPSAPLRKLEILANDSFDVYRDLYYEGGISSVYLWDLNEEDFNGHDFAGVVLFKKNQSDHSNWDSIHVFEVTTSPSSPDSFNYRVTTTIILHLDKTKTDQNSHMMLSGNLTRQTEKDIAIDMSRPLDVIFTSHVANLGSLIEDIESQMRNLLETVYFEKTRDIFHQTKNAAIASSAEEANKDAQAEVIRGLQSL

SEQ ID NO: 22110 - protein, 416 aa, Saccharomyces cerevisiae
MVSSLPKESQAELQLFQNEINAANPSDFLQFSANYFNKRLEQQRAFLKAREPEFKAKNIVLFPEPEESFSRPQSAQSQSRSRSSVMFKSPFVNEDPHSNVFKSGFNLDPHEQDTHQQAQEEQQHTREKTSTPPLPMHFNAQRRTSVSGETLQPNNFDDWTPDHYKEKSEQQLQRLEKSIRNNFLFNKLDSDSKRLVINCLEEKSVPKGATIIKQGDQGDYFYVVEKGTVDFYVNDNKVNSSGPGSSFGELALMYNSPRAATVVATSDCLLWALDRLTFRKILLGSSFKKRLMYDDLLKSMPVLKSLTTYDRAKLADALDTKIYQPGETIIREGDQGENFYLIEYGAVDVSKKGQGVINKLKDHDYFGEVALLNDLPRQATVTATKRTKVATLGKSGFQRLLGPAVDVLKLNDPTRH

SEQ ID NO: 22111 - protein, 1034 aa, Saccharomyces cerevisiae
MSARKRKFNSLKPLDTLNSSRASSPRSSASLPPKRYNTFRKDPKIVDHLNNASTKDFLPVLSMNSESKRQIELSDNDVDNNDEGEGVNSGCSDQDFEPLQSSPLKRHSSLKSTSNGLLFQMSNNLGNGSPEPAVASTSPNGSIISTKLNLNGQFSCVDSKTLRIYRHKAPCIMTFVSDHNHPKFSLYFQQSVIYNSQVNLLDDVELIILDKKNSFMAIILKDLKKVKMILDVNNSSININTNILIWSTASSASNKKIKSIKRFLLMSYSSSIKVEILDHKEQILERLKHLIHPISSSSPSLNMERAINSTKNAFDSLRLKKTKLSTNDDESPQIHTHFLSNKPHGLQSLTKRTRIASLGKKEHSISVPKSNISPSDFYNTNGTETLQSHAVSQLRRSNRFKDVSDPANSNSNSEFDDATTEFETPELFKPSLCYKFNDGSSYTITNQDFKCLFNKDWVNDSILDFFTKFYIESSIEKSIIKREQVHLMSSFFYTKLISNPADYYSNVKKWVNNTDLFSKKYVVIPINISYHWFSCIITNLDAILDFHQNKDKNDAINSDEISINNPLVNILTFDSLRQTHSREIDPIKEFLISYALDKYSIQLDKTQIKMKTCPVPQQPNMSDCGVHVILNIRKFFENPVETIDVWKNSKIKSKHFTAKMINKYFDKNERNSARKNLRHTLKLLQLNYISYLKKENLYEEVMQMEEKKSTNINNNENYDDDDEEIQIIENIDQSSKDNNAQLTSEPPCSRSSSISTTEREPTELHNSVVRQPTGEIITDNEDPVRAASPETASVSPPIRHNILKSSSPFISESANETEQEEFTSPYFGRPSLKTRAKQFEGVSSPIKNDQALSSTHDIMMPSPKPKRIYPSKKIPQLSSHVQSLSTDSMERQSSPNNTNIVISDTEQDSRLGVNSESKNTSGIVNRDDSDVNLIGSSLPNVAEKNHDNTQESNGNNDSLGKILQNVDKELNEKLVDIDDVAFSSPTRGIPRTSATSKGSNAQLLSNYGDENNQSQDSVWDEGRDNPILLEDEDP

SEQ ID NO: 22112 - protein, 1150 aa, Saccharomyces cerevisiae
MTAVRRSTRIRTKSQVIEEDYDDEQNTSAQHVESDKITAKTQHEEEEEQDTGESEESSSEDDYEDQDDDDYVDTATAKRKSRKRKPKSASNTSSKRQKKKPTSAQKSAVSHAPAYHRSKKDQDQYLEIAKDFQPTELFDILSTSEDVSIEELLREWLETYSENRDKFLQEFINLLLNCCGSVARVEDHDVHSNESSNETIGEIQLLFQRQKLHEFYLLISKENKKRKNFKMGPLYQNFAEFMTKLLEVANDLQLLYVESDEDDTQIVTGNLVLDLLTWLSSFSVCKIRCFRYISTLTLYLFQDYLTQQAVNLEKNYLAKLSKQLSLEEKKKRPNNKTLEKLESTIAETQGSKVVIDSIIDNIVKLCFVHRYKDVSDLIRSESMLHLSIWIKNYPEYFLKVTFLKYFGWLLSDNSVSVRLQVTKILPHLIIQNHNSKSTDNSAIRQVFERFKTKILEVAIRDVNLDVRIHSIQVLTEASSLGYLDDSEILIISSLMFDEEFDPFKTSSFNKRSKFLSTVAKFLARVIKEKFDEFIKTHEDLPKEVDGLEVGPVVQVGIFIKILNDSLIYHLKDCAEVDSRTKIRMLTQAAEFLSPYISTHLKTICNLLISDTESNELIQKLQNSANNNSDDEDVDDEELDITPLFPIDRNSTILYLNVFHGLCAGANNPKIQTKDSVKEIVLPLFYDLLNAASIESADILCPLLESFITFSLDDWISIGYETELKKITDKTIKAFMDSTIGNSKVDMKYDIFAKFIHHIHHFEKKELQEKFLNQIATLKIHLKKFLQEKMDPNNSRDDYKDLTCSLYELYINKLTILGRDYPIEVDEELLQLFLNNFVSRIPIMFQDFDDSTAQEINFKMLVLLATWNLEKWREIIEKVRDYENSISKDLRSVWKPIAAIIGRLNTLVISLAATNETFENINSLFYLKWSACTSLMDIIVAIKIFELKLPADATTWRYSMSEQFPFYLHDNASKVLLKIFLYLESLFAKQVDVQLERVADEDANLNDLPETGFFENIETEFLLFTVKLKGLMKLNILDERFASRVALNKEKLGPLFKKIVDDTIMENPEPNKKNIQKAKSNQTQREKAPLQPNSERETDHANTENNDPDIPMTIDLEPIEESSQNNSELAPIEEHPTVVDAIDNSDEITQD

SEQ ID NO: 22113 - protein, 587 aa, Saccharomyces cerevisiae
MSAINHLCLKLILASFAIINTITALTNDGTGHLEFLLQHEEEMYYATTLDIGTPSQSLTVLFDTGSADFWVMDSSNPFCLPNSNTSSYSNATYNGEEVKPSIDCRSMSTYNEHRSSTYQYLENGRFYITYADGTFADGSWGTETVSINGIDIPNIQFGVAKYATTPVSGVLGIGFPRRESVKGYEGAPNEYYPNFPQILKSEKIIDVVAYSLFLNSPDSGTGSIVFGAIDESKFSGDLFTFPMVNEYPTIVDAPATLAMTIQGLGAQNKSSCEHETFTTTKYPVLLDSGTSLLNAPKVIADKMASFVNASYSEEEGIYILDCPVSVGDVEYNFDFGDLQISVPLSSLILSPETEGSYCGFAVQPTNDSMVLGDVFLSSAYVVFDLDNYKISLAQANWNASEVSKKLVNIQTDGSISGAKIATAEPWSTNEPFTVTSDIYSSTGCKSRPFLQSSTASSLIAETNVQSRNCSTKMPGTRSTTVLSKPTQNSAMHQSTGAVTQTSNETKLELSSTMANSGSVSLPTSNSIDKEFEHSKSQTTSDPSVAEHSTFNQTFVHETKYRPTHKTVITETVTKYSTVLINVCKPTY

SEQ ID NO: 22114 - protein, 888 aa, Saccharomyces cerevisiae
MSLSKYFNPIPDASVTFDGATVQLEESLGAVQNDEESASEFKNVGHLEISDITFRANEGEVVLVLGNPTSALFKGLFHGHKHLKYSPEGSIRFKDNEYKQFASKCPHQIIYNNEQDIHFPYLTVEQTIDFALSCKFHIPKQERIEMRDELLKEFGLSHVKKTYVGNDYVRGVSGGERKRISIIETFIANGSVYLWDNSTKGLDSATALEFLSITQKMAKATRSVNFVKISQASDKIVSKFDKILMLGDSFQVFYGTMEECLTHFHDTLQIKKNPNDCIIEYLTSILNFKFKETSNSIVGLDTPSVVSEENQALNINNETDLHTLWIQSPYYKHWKAITSKTVQECTRKDVNPDDISPIFSIPLKTQLKTCTVRAFERIIGDRNYLISQFVSVVVQSLVIGSLFYNIPLTTIGSFSRGSLTFFSILFFTFLSLADMPASFQRQPVVRKHVQLHFYYNWVETLATNFFDCCSKFILVVIFTIILYFLAHLQYNAARFFIFLLFLSVYNFCMVSLFALTALIAPTLSMANLLAGILLLAIAMYASYVIYMKDMHPWFIWIAYLNPAMFAMEAILSNELFNLKLDCHESIIPRGEYYDNISFSHKACAWQGATLGNDYVRGRDYLKSGLKYTYHHVWRNFGIIIGFLCFFLFCSLLAAEYITPLFTRENLLRWNNYLKRYCPFLNSQKKNNKSAITNNDGVCTPKTPIANFSTSSSSVPSVSHQYDTDYNIKHPDETVNNHTKESVAMETQKHVISWKNINYTIGDKKLINDASGYISSGLTALMGESGAGKTTLLNVLSQRTESGVVTGELLIDGQPLTNIDAFRRSIGFVQQQDVHLELLTVRESLEISCVLRGDGDRDYLGVVSNLLRLPSEKLVADLSPTQRKLLSIG

SEQ ID NO: 22115 - protein, 694 aa, Saccharomyces cerevisiae
MSEQHSVAVGKAANEHETAPRRNVRVKKRPLIRPLNSSASTLYEFALECFNKGGKRDGMAWRDVIEIHETKKTIVRKVDGKDKSIEKTWLYYEMSPYKMMTYQELIWVMHDMGRGLAKIGIKPNGEHKFHIFASTSHKWMKIFLGCISQGIPVVTAYDTLGESGLIHSMVETESAAIFTDNQLLAKMIVPLQSAKDIKFLIHNEPIDPNDRRQNGKLYKAAKDAINKIREVRPDIKIYSFEEVVKIGKKSKDEVKLHPPEPKDLACIMYTSGSISAPKGVVLTHYNIVSGIAGVGHNVFGWIGSTDRVLSFLPLAHIFELVFEFEAFYWNGILGYGSVKTLTNTSTRNCKGDLVEFKPTIMIGVAAVWETVRKAILEKISDLTPVLQKIFWSAYSMKEKSVPCTGFLSRMVFKKVRQATGGHLKYIMNGGSAISIDAQKFFSIVLCPMIIGYGLTETVANACVLEPDHFEYGIVGDLVGSVTAKLVDVKDLGYYAKNNQGELLLKGAPVCSEYYKNPIETAVSFTYDGWFRTGDIVEWTPKGQLKIIDRRKNLVKTLNGEYIALEKLESVYRSNSYVKNICVYADESRVKPVGIVVPNPGPLSKFAVKLRIMKKGEDIENYIHDKALRNAVFKEMIATAKSQGLVGIELLCGIVFFDEEWTPENGFVTSAQKLKRREILAAVKSEVERVYKENS

SEQ ID NO: 22116 - protein, 373 aa, Saccharomyces cerevisiae
MTQTDNPVPNCGLLPEQQYCSADHEEPLLLHEEQLIFPDHSSQLSSADIIEPIKMNSSTESIIGTTLRKKWVPLSSTQITALSGAFAGFLSGVAVCPLDVAKTRLQAQGLQTRFENPYYRGIMGTLSTIVRDEGPRGLYKGLVPIVLGYFPTWMIYFSVYEFSKKFFHGIFPQFDFVAQSCAAITAGAASTTLTNPIWVVKTRLMLQSNLGEHPTHYKGTFDAFRKLFYQEGFKALYAGLVPSLLGLFHVAIHFPIYEDLKVRFHCYSRENNTNSINLQRLIMASSVSKMIASAVTYPHEILRTRMQLKSDIPDSIQRRLFPLIKATYAQEGLKGFYSGFTTNLVRTIPASAITLVSFEYFRNRLENISTMVI

SEQ ID NO: 22117 - protein, 1480 aa, Saccharomyces cerevisiae
MYNPYQQQGMGYQQQQQQQQQQPNGFYPQQQQGQSSNQPQGQPQPQQQMAFNQPQATGIGGMPQSFGNSFSSMPQQPQTGYNNNGNNGSVYGNGNFGQQPQQQQQQAKPQHTGYVPNSSMPMMNTTGTMPPPNPAQQPQLQSIQPQGTGYYQAANTANVHSVQPLQSQGTGYYVSTPNLISSNQTQQPLQAQGTGYYQSQPQQVPPPQQAQSLQPLKPQQTGFYLQPQNQAPLEPLKPTATGFVNSFANNGLNNDIKIPAIRLSFITAQDQAKFETLFRSIVTNGSNTVSGANCRKILMRSGLPPSQLARIWTLCDTSKAGELLFPEFALAMHLINDVLQGDTIPYELDSKTKNEVSSFIDAINLSIANQDSSANDAPKTPFDEFITAGVQNLQPQPTGYMPQTSFGIPLQSQITGGGVASALNPQSTGFMAPTTFNMSMNTGTPGLNPQITGGAPASMQPNITGNALQPQTTGMMPQTTGMMPQTTGMMPQTSFGVNLGPQLTGGALQSQYTGGYGSVMPQQSGPASMPNLSFNQQGLQSQLTGLQPQPTGFLPPSNFSATMPLTAQKTGFGNNEIYTKSNFNNNLIDNSSQDKISTEEKSLFYKIFETFDTQNKGLLDSPTAVEIFRKSGLNRADLEQIWNLCDINNTGQLNKQEFALGMHLVYGKLNGKPIPNVLPSSLIPSSTKLLDNLKNQLKTEPTTTKEKPSFGKIDALSYKNNDDDVLPNYRNRRKVYSAKNEEQSSFSSPSAKSVNHSSSTLQTDDISVDKTVEKKTAKPKYAGFSREINLKNIASLENEIKNISNPENCYDSSIPSDLTSRFDAIIAKLPNLFNEISTIDNEITNAKIQLYRKKNPSSIIGSGPNGEITENDRKKAKSRALLRARMSALTGKSTESEDSLSMEDEQQSAEIKRIQQENGKNQEIIKDIRSSISDISASLKSTMTGSNMISNQEFERWEFGIGLEDGVREFLDDLKSNSNKSVTESSPFVPSSTPTPVDDRSSSPSYSQFKTAEERAAYLKEQAKKRMKEKLAKFDKNRRNVTQSSRSISSENSREQPQQIAGSSNLVEPRATPFQEEKYVEVAQPTQPVQSTQPVQPTQPVQPTQPVQPTQPVQPTQPVQPTQPVQNVYNAKQESDDEDEDDEEKRLQEELKRLKLKKKADKEKRLAALRKQIEDAQNESDEEETNGKDNFGGHVNVPQAAPVAPSAAFSQNSTNAPRSVHAAVTPAAGKNSTGLPSTTMGHNPYFKDASASSTSTFDARAAEMQRRIQRGLDEDEDDGWSDEDESNNRVAVDNKVEEAKIGHPDHARAPPVTAAPLPSVTPVPPAVPVPQANTSNEKSSPIPIAPIPPSVTQEPPVPLAPPLPAVDGFQEPPIPSAPAIATAVQKSGSSTPALAGGVLPPPPPLPTQQASTSEPIIAHVDNYNGAEKGTGAYGSDSDDDVLSIPESVGTDEEEEGAQPVSTAGIPSIPPAGIPPPPPLP

SEQ ID NO: 22118 - protein, 409 aa, Saccharomyces cerevisiae
MTNSVKTNGPSSSDMEYYYKSLYPFKHIFNWLNHSPKPSRDMINREFAMAFRSGAYKRYNSFNSVQDFKAQIEKANPDRFEIGAIYNKPPRERDTLLKSELKALEKELVFDIDMDDYDAFRTCCSGAQVCSKCWKFISLAMKITNTALREDFGYKDFIWVFSGRRGAHCWVSDKRARALTDVQRRNVLDYVNVIRDRNTDKRLALKRPYHPHLARSLEQLKPFFVSIMLEEQNPWEDDQHAIQTLLPALYDKQLIDSLKKYWLDNPRRSSKEKWNDIDQIATSLFKGPKQDSHIIKLRECKEDLVLMTLYPKLDVEVTKQTIHLLKAPFCIHPATGNVCVPIDESFAPEKAPKLIDLQTEMEKNNDVSLTALQPFINQFQAYVSSLLKNELGSVKREREDDDEPASLDF

SEQ ID NO: 22119 - protein, 187 aa, Saccharomyces cerevisiae
MSAKQGWEKKSTNIDIASRKGMNVNNLSEHLQNLISSDSELGSRLLSLLLVSSGNAEELISMINNGQDVSQFKKLREPRKGKVAATTAVVVKEEEAPVSTSNELDKIKQERRRKNTEASQRFRIRKKQKNFENMNKLQNLNTQINKLRDRIEQLNKENEFWKAKLNDINEIKSLKLLNDIKRRNMGR

SEQ ID NO: 22120 - protein, 364 aa, Saccharomyces cerevisiae
MAGNANSVDEEVTRILGGIYLGGIRPIIDHRPLGAEFNITHILSVIKFQVIPEYLIRKGYTLKNIPIDDDDVTDVLQYFDETNRFIDQCLFPNEVEYSPRLVDFKKKPQRGAVFAHCQAGLSRSVTFIVAYLMYRYGLSLSMAMHAVKRKKPSVEPNENFMEQLHLFEKMGGDFVDFDNPAYKQWKLKQSIKLDPSGSELVSNSGMFKDSESSQDLDKLTEAEKSKVTAVRCKKCRTKLALSTSFIAHDPPSKESSEGHFIKRAANSHRIIDIQESQANCSHFFIEPLKWMQPELQGKQELEGKFSCPGCSSKVGGYNWKGSRCSCGKWVIPAIHLQTSKVDQFPLQSTALPNMVNFESEKVNR

SEQ ID NO: 22121 - protein, 254 aa, Saccharomyces cerevisiae
MGKVILVTGVSRGIGKSIVDVLFSLDKDTVVYGVARSEAPLKKLKEKYGDRFFYVVGDITEDSVLKQLVNAAVKGHGKIDSLVANAGVLEPVQNVNEIDVNAWKKLYDINFFSIVSLVGIALPELKKTNGNVVFVSSDACNMYFSSWGAYGSSKAALNHFAMTLANEERQVKAIAVAPGIVDTDMQVNIRENVGPSSMSAEQLKMFRGLKENNQLLDSSVPATVYAKLALHGIPDGVNGQYLSYNDPALADFMP

SEQ ID NO: 22122 - protein, 263 aa, Saccharomyces cerevisiae
MGKVILITGASRGIGLQLVKTVIEEDDECIVYGVARTEAGLQSLQREYGADKFVYRVLDITDRSRMEALVEEIRQKHGKLDGIVANAGMLEPVKSISQSNSEHDIKQWERLFDVNFFSIVSLVALCLPLLKSSPFVGNIVFVSSGASVKPYNGWSAYGCSKAALNHFAMDIASEEPSDKVRAVCIAPGVVDTQMQKDIRETLGPQGMTPKALERFTQLYKTSSLLDPKVPAAVLAQLVLKGIPDSLNGQYLRYNDERLGPVQG

SEQ ID NO: 22123 - protein, 392 aa, Saccharomyces cerevisiae
MQLISILSLLSSLMCSLTVLGSSASSYVKFPVQKLADIINICTQDVSTVFKRNEVLNTTVINGIGVYVVKMEIGTPPQTLYLQLDTGSSDMIVNNADIAYCKSMSDGSDYASTDNYELTATFNGLPSTTISSEAYNTLCSYWGTFDASNSSTFENNATFFNNTYGDGTYYAGTYGTDVVSFENITLNDFTFGVSNDTIGNPSGILGISLPIAEFTDGIEYALALNRTPFIYDNFPMELKNQGKINKIAYSLFLNGPDAHFGSILFGAVDKSKYTGQLYTLPMLQAFNTLGSNPGMIITAQSVAILDSESGNKTVSDIQFPVMLDSGTTFSYLPTEIAEAIGKSFDGEYSSDDQGYIFDCSKVNDTLLSVDFGGFNISANISNFVTSAKDRCV

SEQ ID NO: 22124 - protein, 589 aa, Saccharomyces cerevisiae; identical to SEQ ID NO: 22071

SEQ ID NO: 22125 - protein, 567 aa, Saccharomyces cerevisiae
MSGVNNTSANDLSTTESNSNSVANAPSVKTEHNDSKNSLNLDATEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKQIRGTLVQLYQLMCTMGIFLGYCTNYGTKNYHNATQWRVGLGLCFAWTTFMVSGMMFVPESPRYLIEVGKDEEAKRSLSKSNKVSVDDPALLAEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDDRPIYKRFFSS

SEQ ID NO: 22126 - protein, 581 aa, Saccharomyces cerevisiae
MTIIHNPKWWKEATVYQIYPASFKDSNNDGWGDLAGITSKLDYVKELGVDAIWVCPFYDSPQEDMGYDIANYEKVWPRYGTNEDCFQMIEEAHKRGIKVIVDLVINHCSEEHEWFKESRSSKANPKRDWFFWRPPKGYDEKGNPIPPNNWRSFFGGSAWRYDEKTGEFFLHVFALGQPDFNWENEECRKAIYDSSVGYWLRHNVDGFRIDVGSMYSKVEGLPDAPITDPTVPYQKGTEFFINGPRIHEYHKEMHNYMLSQVPEGKEIMTVGEVGIGNEDDFRVYTSAKEGELNMMFNFKHTSVGENPKCKYELIPFTLKDFKLALAESFLFIENTDCWSTIYLENHDQPRSVSRFGSDSPKWREISSKMLATLIISLTGTVFIYQGQELGMPNFKNRKIEQIKCVEGTGTYAAIKRDYGEDSEKMKKFFEALALISRDHGRTPFPWSADEPSAGFSKDAKPWIDMNESFRDGINAEAELKDKNSVFFFWKKALQVRKEHKDILVYGHNFQFIDLDNDKLFMFTKDTDNKKMFAVFNFSSDNTDFSVPDNEASYTMFFGNYANSNGDSRTLQPWEGRLYLLK

SEQ ID NO: 22127 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 22128 - protein, 799 aa, Saccharomyces cerevisiae
MSTIYRESDSLESEPSPTPTTIPIQINMEEEKKDAFVKNIDEDVNNLTATTDEEDRDPESQKFDRHSIQEEGLVWKGDPTYLPNSPYPEVRSAVSIEDDPTIRLNHWRTWFLTTVFVVVFAGVNQFFSLRYPSLEINFLVAQVVCYPIGRILALLPDWKCSKVPFFDLNPGPFTKKEHAVVTIAVALTSSTAYAMYILNAQGSFYNMKLNVGYQFLLVWTSQMIGYGAAGLTRRWVVNPASSIWPQTLISVSLFDSLHSRKVEKTVANGWTMPRYRFFLIVLIGSFIWYWVPGFLFTGLSYFNVILWGSKTRHNFIANTIFGTQSGLGALPITFDYTQVSQAMSGSVFATPFYVSANTYASVLIFFVIVLPCLYFTNTWYAKYMPVISGSTYDNTQNKYNVTKILNEDYSINLEKYKEYSPVFVPFSYLLSYALNFAAVIAVFVHCILYHGKDIVAKFKDRKNGGTDIHMRIYSKNYKDCPDWWYLLLQIVMIGLGFVAVCCFDTKFPAWAFVIAILISLVNFIPQGILEAMTNQHVGLNIITELICGYMLPLRPMANLLFKLYGFIVMRQGLNLSRDLKLAMYMKVSPRLIFAVQIYATIISGMVNVGVQEWMMHNIDGLCTTDQPNGFTCANGRTVFNASIIWSLPKYLFSSGRIYNPLMWFFLIGLLFPLAVYAVQWKFPKFKFAKHIHTPVFFTGPGNIPPSTPYNYSLFFAMSFCLNLIRKRWRAWFNKYNFVMGAGVEAGVAISVVIIFLCVQYPGGKLSWWGNNVWKRTYDNDYKKFYTLKKGETFGYDKWW

SEQ ID NO: 22129 - protein, 329 aa, Saccharomyces cerevisiae
MCSRILLSGLVGLGAGTGLTYLLLNKHSPTQIIETPYPPTQKPNSNIQSHSFNVDPSGFFKYGFPGPIHDLQNREEFISCYNRQTQNPYWVLEHITPESLAARNADRKNSFFKEDEVIPEKFRGKLRDYFRSGYDRGHQAPAADAKFSQQAMDDTFYLSNMCPQVGEGFNRDYWAHLEYFCRGLTKKYKSVRIVTGPLYLPKKDPIDNKFRVNYEVIGNPPSIAVPTHFFKLIVAEAPTANPAREDIAVAAFVLPNEPISNETKLTDFEVPIDALERSTGLELLQKVPPSKKKALCKEVNCQIVVRDFSNAAIKQSKDVKLLPPPKKRN

SEQ ID NO: 22130 - protein, 789 aa, Saccharomyces cerevisiae
MLSSANRFYIKRHLATHANMFPSVSKNFQTKVPPYAKLLTNLDKIKQITNNAPLTLAEKILYSHLCDPEESITSSDLSTIRGNKYLKLNPDRVAMQDASAQMALLQFMTTGLNQTSVPASIHCDHLIVGKDGETKDLPSSIATNQEVFDFLESCAKRYGIQFWGPGSGIIHQIVLENFSAPGLMMLGTDSHTPNAGGLGAIAIGVGGADAVDALTGTPWELKAPKILGVKLTGKLNGWSTPKDVITKLAGLLTVRGGTGYIVEYFGEGVSTLSCTGMATICNMGAEIGATTSTFPYQEAHKRYLQATNRAEVAEAADVALNKFNFLRADKDAQYDKVIEIDLSAIEPHVNGPFTPDLSTPISQYAEKSLKENWPQKVSAGLIGSCTNSSYQDMSRVVDLVKQASKAGLKPRIPFFVTPGSEQIRATLERDGIIDIFQENGAKVLANACGPCIGQWNREDVSKTSKETNTIFTSFNRNFRARNDGNRNTMNFLTSPEIVTAMSYSGDAQFNPLTDSIKLPNGKDFKFQPPKGDELPKRGFEHGRDKFYPEMDPKPDSNVEIKVDPNSDRLQLLEPFKPWNGKELKTNVLLKVEGKCTTDHISAAGVWLKYKGHLENISYNTLIGAQNKETGEVNKAYDLDGTEYDIPGLMMKWKSDGRPWTVIAEHNYGEGSAREHAALSPRFLGGEILLVKSFARIHETNLKKQGVLPLTFANESDYDKISSGDVLETLNLVDMIAKDGNNGGEIDVKITKPNGESFTIKAKHTMSKDQIDFFKAGSAINYIGNIRRNE

SEQ ID NO: 22131 - protein, 1254 aa, Saccharomyces cerevisiae
MGSSDVSSRECSLVYNEDPDFTDGTTPCDRLGVDLMNVLDDKDEIKQESVPVSDREIEDTESDASAVSSFASANELIAEPHAASETNLGTNGQDGRNVLEQQRDVVARLIEENKETQKEGDKVCIVPKVWYDKFFDPDVTDPEDIGPINTRMICRDFENFVLEDYNRCPYLSIAEPVFNFLSEIYGMTSGSYPVVTNLVINQTTGELETEYNKWFFRLHYLTEKQDGRKRRHGQDDSIMYLSMSALNLVRDLVEKSMNLFFEKADHLDVNAVDFKIWFVSEGSDIATDSNVSTFLNSSYEITPLQFLELPIKKLLIPDMFENRLDKITSNPSDLVIEIKPIEGNHHWPSNYFAYNKLEPASGTTGLVNLGNTCYMNSALQCLVHIPQLRDYFLYDGYEDEINEENPLGYHGYVARAFSDLVQKLFQNRMSIMQRNAAFPPSMFKSTIGHFNSMFSGYMQQDSQEFLAFLLDSLHEDLNRIIKKEYTEKPSLSPGDDVNDWNVVKKLADDTWEMHLKRNCSVITDLFVGMYKSTLYCPECQNVSITFDPYNDVTLPLPVDTVWDKTIKIFPMNSPPLLLEVELSKSSTYMDLKNYVGKMSGLDPNTLFGCEIFSNQIYVNYESTESNAQFLTLQELIKPADDVIFYELPVTNDNEVIVPVLNTRIEKGYKNAMLFGVPFFITLKEDELNNPGAIRMKLQNRFVHLSGGYIPFPEPVGNRTDFADAFPLLVEKYPDVEFEQYKDILQYTSIKVTDKDKSFFSIKILSVEKEQQFASNNRTGPNFWTPISQLNLDKATDIDDKLEDVVKDIYNYSSLVDCAEGVLMQVDDEGDTEGSEAKNFSKPFQSGDDEENKETVTNNENVNNTNDRDEDMELTDDVEEDASTEPELTDKPEALDKIKDSLTSTPFAILSMNDIIVCEWSELGSNEAFSDDKIYNWENPATLPNKELENAKLERSNAKERTITLDDCLQLFSKPEILGLTDSWYCPTCKEHRQATKQIQLWNTPDILLIHLKRFESQRSFSDKIDATVNFPITDLDLSRYVVYKDDPRGLIYDLYAVDNHYGGLGGGHYTAYVKNFADNKWYYFDDSRVTETAPENSIAGSAYLLFYIRRHKDGNGLGSSKLQEIIQKSRHGYDERIKKIYDEQMKLYEFNKTDEEEDVSDDMIECNEDVQAPEYSNRSLEVGHIETQDCNDEDDNDDGERTNSGRRKLRLLKKVYKNNSGLGSSSTSEISEGCPENEVADLNLKNGVTLESPE

SEQ ID NO: 22132 - protein, 310 aa, Saccharomyces cerevisiae
MVSDWKNFCLEKASRFRPTIDRPFFNIYLWDYFNRAVGWATAGRFQPKDFEFTVGKQPLSEPRPVLLFIAMYYVVIFGGRSLVKSCKPLKLRFISQVHNLMLTSVSFLWLILMVEQMLPIVYRHGLYFAVCNVESWTQPMETLYYLNYMTKFVEFADTVLMVLKHRKLTFLHTYHHGATALLCYNQLVGYTAVTWVPVTLNLAVHVLMYWYYFLSASGIRVWWKAWVTRLQIVQFMLDLIVVYYVLYQKIVAAYFKNACTPQCEDCLGSMTAIAAGAAILTSYLFLFISFYIEVYKRGSASGKKKINKNN

SEQ ID NO: 22133 - protein, 513 aa, Saccharomyces cerevisiae
MSAIPITPTKRIRRNLFDDAPATPPRPLKRKKLQFTDVTPESSPEKLQFGSQSIFLRTKALLQKSSELVNLNSSDGALPARTAEYEQVMNFLAKAISEHRSDSLYITGPPGTGKTAQLDMIIRQKFQSLPLSLSTPRSKDVLRHTNPNLQNLSWFELPDGRLESVAVTSINCISLGEPSSIFQKIFDSFQDLNGPTLQIKNMQHLQKFLEPYHKKTTFVVVLDEMDRLLHANTSETQSVRTILELFLLAKLPTVSFVLIGMANSLDMKDRFLSRLNLDRGLLPQTIVFQPYTAEQMYEIVIQKMSSLPTIIFQPMAIKFAAKKCAGNTGDLRKLFDVLRGSIEIYELEKRFLLSPTRGSLNSAQVPLTPTTSPVKKSYPEPQGKIGLNYIAKVFSKFVNNNSTRTRIAKLNIQQKLILCTIIQSLKLNSDATIDESFDHYIKAITKTDTLAPLQRNEFLEICTILETCGLVSIKKTKCKGKTKRFVDKIDVDLDMREFYDEMTKISILKPFLH

SEQ ID NO: 22134 - protein, 402 aa, Saccharomyces cerevisiae
MFQQLSASIRHNAHIIFLCISWYFISSLASQVTKQVLTVCPLPLFLGEFQFIYTAVLAWFTCYIAYSFPGFYRIFPNGTFPEYYIDDRETSRAARKESKLSSLIIPPSKPILQTVLPLGLFQFVGKYFGHTATSLVPVSTVASIKTLSPMFILLLQKILKISTLKITLTLIFSLCTLVLGVWIIVQEDNRSPASSNELREFSKYGVICAMISMFIFVLQNIYGKTVFTYRSQTDESQSNSGFSRQESPLPLYEKLDEKLVAKKKPKSYDKLTLMIYISLVGFCLSFGWFITLEFPVLFRYFFQINSSSTVIKAFPVSLFLLNGTFHFIQAMITFHLLGEVSTLTYSIANLMKRFAIIAVSWVFIGRRITWLQVFGLVLNTLGLFLYERCTSQSKIKAKIRPE

SEQ ID NO: 22135 - protein, 276 aa, Saccharomyces cerevisiae
MRLQRNSIICALVFLVSFVLGDVNIVSPSSKATFSPSGGTVSVPVEWMDNGAYPSLSKISTFTFSLCTGPNNNIDCVAVLASKITPSELTQDDKVYSYTAEFASTLTGNGQYYIQVFAQVDGQGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 22136 - protein, 122 aa, Saccharomyces cerevisiae
MASETPRVDPTEISNVNAPVFRIIAQIKSQPTESQLILQSPTISSKNGSEVEMITLNNIRVSMNKTFEIDSWYEFVCRNNDDGELGFLILDAVLCKFKENEDLSLNGVVALQRLCKKYPEIY

SEQ ID NO: 22137 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 22138 - protein, 397 aa, Saccharomyces cerevisiae
MSTEEQNGGGQKSLDDRQGEESQKGETSERETTATESGNESKSVEKEGGETQEKPKQPHVTYYNEEQYKQFIAQARVTVGSIVYKNFQILRTLGTGSFGRVHLIRSRHNGRYYAMKVLKKEIVVRLKQVEHTNDERLMLSIVTHPFIIRMWGTFQDAQQIFMIMDYIEGGELFSLLRKSQRFPNPVAKFYAAEVCLALEYLHSKDIIYRDLKPENILLDKNGHIKITDFGFAKYVPDVTYTLCGTPDYIAPEVVSTKPYNKSIDWWSFGILIYEMLAGYTPFYDSNTMKTYEKILNAELRFPPFFNEDVKDLLSRLITRDLSQRLGNLQNGTEDVKNHPWFKEVVWEKLLSRNIETPYEPPIQQGQGDTSQFDKYPEEDINYGVQGEDPYADLFRDF

SEQ ID NO: 22139 - protein, 180 aa, Saccharomyces cerevisiae
MHYKKAFLASLLSSIALTAYAPPEPWATLTPSSKMDGGTTEYRTSFGLAVIPFTVTESKVKRNVISQINDGQVQVTTQKLPHPVSQIGDGQIQVTTQKVPPVVSHIVSQIGDGQLQITTAKNVVTKSTIAVPSKTVTATATSTATAVSQIHDGQVQVTISSASSSSVLSKSKLRANKETK

SEQ ID NO: 22140 - protein, 310 aa, Saccharomyces cerevisiae
MQYKKTLVASALAATTLAAYAPSEPWSTLTPTATYSGGVTDYASTFGIAVQPISTTSSASSAATTASSKAKRAASQIGDGQVQAATTTASVSTKSTAAAVSQIGDGQIQATTKTTAAAVSRDGQIQATTKTTSAKTTAAAVSQISDGQIQATTTTLAPKSTAAAVSQIGDGQVQATTKTTAAAVSQIGDGQVQATTKTTAAAVSQIGDGQVQATTKTTAAAVSQIGDGQVQATTKTTAAAVSQITDGQVQATTKTTQAASQVSDGQVQATTAWLLVTMMSSTNVCPVLSTTCTTNTLVVNVLQSTWKLSI

SEQ ID NO: 22141 - protein, 227 aa, Saccharomyces cerevisiae
MQFKNVALAASVAALSATASAEGYTPGEPWSTLTPTGSISCGAAEYTTTFGIAVQAITSSKAKRDVISQIGDGQVQATSAATAQATDSQAQATTTATPTSSEKISSSASKTSTNATSSSCATPSLKDSSCKNSGTLELTLKDGVLTDAKGRIGSIVANRQFQFDGPPPQAGAIYAAGWSITEDGYLALGDSDVFYQCLSGNFYNLYDQNVAEQCSAIHLEAVSLVDC

SEQ ID NO: 22142 - protein, 830 aa, Saccharomyces cerevisiae
MKTPTRVSFEKKIHTPPSGDRDAERSPPKKFLRGLSGKVFRKTPEFKKQQMPTFGYIEESQFTPNLGLMMSKRGNIPKPLNLSKPISPPPSLKKTAGSVASGFSKTGQLSALQSPVNITSSNKYNIKATNLTTSLLRESISDSTTMCDTLSDINLTVMDEDYRIDGDSYYEEDSPTFMISLERNIKKCNSQFSPKRYIGEKCLICEESISSTFTGEKVVESTCSHTSHYNCYLMLFETLYFQGKFPECKICGEVSKPKDKDIVPEMVSKLLTGAGAHDDGPSSNMQQQWIDLKTARSFTGEFPQFTPQEQLIRTADISCDGFRTPRLSNSNQFEAVSYLDSPFLNSPFVNKMATTDPFDLSDDEKLDCDDEIDESAAEVWFSKTGGEHVMVSVKFQEMRTSDDLGVLQDVNHVDHEELEEREKEWKKKIDQYIETNVDKDSEFGSLILFDKLMYSDDGEQWVDNNLVILFSKFLVLFDFEEMKILGKIPRDQFYQVIKFNEDVLLCSLKSTNIPEIYLRFNENCEKWLLPKWKYCLENSSLETLPLSEIVSTVKELSHVNIIGALGAPPDVISAQSHDSRLPWKRLHSDTPLKLIVCLNLSHADGELYRKRVLKSVHQILDGLNTDDLLGIVVVGRDGSGVVGPFGTFIGMINKNWDGWTTFLDNLEVVNPNVFRDEKQQYKVTLQTCERLASTSAYVDTDDHIATGYAKQILVLNGSDVVDIEHDQKLKKAFDQLSYHWRYEISQRRMTPLNASIKQFLEELHTKRYLDVTLRLPQATFEQVYLGDMAAGEQKTRLIMDEHPHSSLIEIEYFDLVKQQRIHQTLEVPNL

SEQ ID NO: 22143 - protein, 807 aa, Saccharomyces cerevisiae
MNSSNNNDSSSSNSNMNNSLSPTLVTHSDASMGSGRASPDNSHMGRGIWNPSYVNQGSQRSPQQQHQNHHQQQQQQQQQQQQNSQFCFVNPWNEEKVTNSQQNLVYPPQYDDLNSNESLDAYRRRKSSLVVPPARAPAPNPFQYDSYPAYTSSNTSLAGNSSGQYPSGYQQQQQQVYQQGAIHPSQFGSRFVPSLYDRQDFQRRQSLAATNYSSNFSSLNSNTNQGTNSIPVMSPYRRLSAYPPSTSPPLQPPFKQLRRDEVQGQKLSIPQMQLCNSKNDLQPVLNATPKFRRASLNSKTISPLVSVTKSLITTYSLCSPEFTYQTSKNPKRVLTKPSEGKCNNGFDNINSDYILYVNDVLGVEQNRKYLVLDILGQGTFGQVVKCQNLLTKEILAVKVVKSRTEYLTQSITEAKILELLNQKIDPTNKHHFLRMYDSFVHKNHLCLVFELLSNNLYELLKQNKFHGLSIQLIRTFTTQILDSLCVLKESKLIHCDLKPENILLCAPDKPELKIIDFGSSCEEARTVYTYIQSRFYRAPEIILGIPYSTSIDMWSLGCIVAELFLGIPIFPGASEYNQLTRIIDTLGYPPSWMIDMGKNSGKFMKKLAPEESSSSTQKHRMKTIEEFCREYNIVEKPSKQYFKWRKLPDIIRNYRYPKSIQNSQELIDQEMQNRECLIHFLGGVLNLNPLERWTPQQAMLHPFITKQEFTGEWFPPGSSLPGPSEKHDDAKGQQSEYGSANDSSNNAGHNYVYNPSSATGGADSVDIGAISKRKENTSGDISNNFAVTHSVQEGPTSAFNKLHIVEE

SEQ ID NO: 22144 - protein, 428 aa, Saccharomyces cerevisiae
MAKGGSLYIVGIFLPIWTFMIYIFGKELFLIRKYQKIDSTYTALSQRVKEQYDTSRRRNYFPKVKLSRNSYDDYTLNYTRQNDSDSFHLRENATILMLVRNSELEGALDSMRSLEDRFNNKYHYDWTFLNDVPFDQDFIEATTSMASGKTQYALIPPEDWNRPQWINDTLFEERLRVMEDEGVLYGGSKSYRNMCRFNSGFFFRQSILDNYDYYFRVEPNVKYYCDFPYDPFRVMRLKGKKYGFVISLYEYEETIPTLWDAVEEYLVASEETILRKEDSAYAFLTDSGLVGKHYPVVEANSDYNLCHFWSNFEIGDLNFFRSDEYKHFFETLDAKGGFYYERWGDAPVHSIGVSLLLRPDEIIHFDELGYFHSPFGTCPASYAVRLDQRCRCKSDDESVIDITPHSCLMRWWKNGSGKYFLKEEQDEI

SEQ ID NO: 22145 - protein, 395 aa, Saccharomyces cerevisiae
MSEGITDIEESQIQTNYDKVVYKFDDMELDENLLRGVFGYGFEEPSAIQQRAIMPIIEGHDVLAQAQSGTGKTGTFSIAALQRIDTSVKAPQALMLAPTRELALQIQKVVMALAFHMDIKVHACIGGTSFVEDAEGLRDAQIVVGTPGRVFDNIQRRRFRTDKIKMFILDEADEMLSSGFKEQIYQIFTLLPPTTQVVLLSATMPNDVLEVTTKFMRNPVRILVKKDELTLEGIKQFYVNVEEEEYKYECLTDLYDSISVTQAVIFCNTRRKVEELTTKLRNDKFTVSAIYSDLPQQERDTIMKEFRSGSSRILISTDLLARGIDVQQVSLVINYDLPANKENYIHRIGRGGRFGRKGVAINFVTNEDVGAMRELEKFYSTQIEELPSDIATLLN

SEQ ID NO: 22146 - protein, 314 aa, Saccharomyces cerevisiae
MVENSSSNNSTRPIPAIPMDLPDYEALPTHAPLYHQLIAGAFAGIMEHSVMFPIDALKTRIQSANAKSLSAKNMLSQISHISTSEGTLALWKGVQSVILGAGPAHAVYFGTYEFCKKNLIDSSDTQTHHPFKTAISGACATTASDALMNPFDTIKQRIQLNTSASVWQTTKQIYQSEGLAAFYYSYPTTLVMNIPFAAFNFVIYESSTKFLNPSNEYNPLIHCLCGSISGSTCAAITTPLDCIKTVLQIRGSQTVSLEIMRKADTFSKAASAIYQVYGWKGFWRGWKPRIVANMPATAISWTAYECAKHFLMTY

SEQ ID NO: 22147 - protein, 2214 aa, Saccharomyces cerevisiae
MATIAPTAPITPPMESTGDRLVTLELKDGTVLQGYSFGAEKSVAGELVFQTGMVGYPESVTDPSYEGQILVITYPLVGNYGVPDMHLRDELVEELPRYFESNRIHIAGLVISHYTDEYSHYLRKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRAAVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 22148 - protein, 668 aa, Saccharomyces cerevisiae
MEDKFANLSLHEKTGKSSIQLNEQTGSDNGSAVKRTSSTSSHYNNINADLHARVKAFQEQRALKRSASVGSNQSEQDKGSSQSPKHIQQIVNKPLPPLPVAGSSKVSQRMSSQVVQASSKSTLKNVLDNQETQNITDVNINIDTTKITATTIGVNTGLPATDITPSVSNTASATHKAQLLNPNRRAPRRPLSTQHPTRPNVAPHKAPAIINTPKQSLSARRAVKLPPGGMSLKMPTKTAQQPQQFAPSPSNKKHIETLSNSKVVEGKRSNPGSLINGVQSTSTSSSTEGPHDTVGTTPRTGNSNNSSNSGSSGGGGLFANFSKYVDIKSGSLNFAGKLSLSSKGIDFSNGSSSRITLDELEFLDELGHGNYGNVSKVLHKPTNVIMATKEVRLELDEAKFRQILMELEVLHKCNSPYIVDFYGAFFIEGAVYMCMEYMDGGSLDKIYDESSEIGGIDEPQLAFIANAVIHGLKELKEQHNIIHRDVKPTNILCSANQGTVKLCDFGVSGNLVASLAKTNIGCQSYMAPERIKSLNPDRATYTVQSDIWSLGLSILEMALGRYPYPPETYDNIFSQLSAIVDGPPPRLPSDKFSSDAQDFVSLCLQKIPERRPTYAALTEHPWLVKYRNQDVHMSEYITERLERRNKILRERGENGLSKNVPALHMGGL

SEQ ID NO: 22149 - protein, 337 aa, Saccharomyces cerevisiae
MKISAALILSSLSSVAFSAPAPAPADSHHEDHHKDEKPAVVTVTQYIDSNAATSTVESAATTTTLSSSEKDTSEQKRDGGFQDGTVKCSDFPSVNGIVSLDWLGFGGWASVMDMDANTSSECKDGYYCSYACEPGMSKTQWPSDQPSDGKSVGGLYCKNGYLYRTNTDTSDLCSTDETSAKAINKKSDSIALCRTDYPGSENMVIPTVVDGGDSQPISVVDEDTYYQWQGKKTSAQYYINNAGVSAEDGCIWGTSGSDVGNWAPLVLGAGSTNGETYLSLIPNPNSNQAANFNVKIVASDGANVQGSCAYEDGSFTGDGSDGCTVSVLSGSAEFVFY

SEQ ID NO: 22150 - protein, 550 aa, Saccharomyces cerevisiae
MNFGSQTPTIVVLKEGTDASQGKGQIISNINACVAVQEALKPTLGPLGSDILIVTSNQKTTISNDGATILKLLDVVHPAAKTLVDISRAQDAEVGDGTTSVTILAGELMKEAKPFLEEGISSHLIMKGYRKAVSLAVEKINELAVDITSEKSSGRELLERCARTAMSSKLIHNNADFFVKMCVDAVLSLDRNDLDDKLIGIKKIPGGAMEESLFINGVAFKKTFSYAGFEQQPKKFNNPKILSLNVELELKAEKDNAEVRVEHVEDYQAIVDAEWQLIFEKLRQVEETGANIVLSKLPIGDLATQFFADRNIFCAGRVSADDMNRVIQAVGGSIQSTTSDIKPEHLGTCALFEEMQIGSERYNLFQGCPQAKTCTLLLRGGAEQVIAEVERSLHDAIMIVKRALQNKLIVAGGGATEMEVSKCLRDYSKTIAGKQQMIINAFAKALEVIPRQLCENAGFDAIEILNKLRLAHSKGEKWYGVVFETENIGDNFAKFVWEPALVKINALNSATEATNLILSVDETITNKGSESANAGMMPPQGAGRGRGMPM

SEQ ID NO: 22151 - protein, 645 aa, Saccharomyces cerevisiae
MVEKRSRQSSSSGSEFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVREIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVASQVDARGNVTNTEQALIFAGINPVATNTKPIYFNSSTKLPAETESNDIDISNNDHDSHAMCSPTLNQEKLTLVEFLNEFVEEDNDDHSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYVNNSNYTHTDRSHHRGDNVLGDASLGDSFNSMPDFTPRNFLIPTLKKSREKFEPHLSNSNQHFGNVTF

SEQ ID NO: 22152 - protein, 678 aa, Saccharomyces cerevisiae
MGLLALGTPLQWFESRTYNEHIRDEGIEQLLYIFQAAGKRDNDPLFWGDELEYMVVDFDDKERNSMLDVCHDKILTELNMEDSSLCEANDVSFHPEYGRYMLEATPASPYLNYVGSYVEVNMQKRRAIAEYKLSEYARQDSKNNLHVGSRSVPLTLTVFPRMGCPDFINIKDPWNHKNAASRSLFLPDEVINRHVRFPNLTASIRTRRGEKVCMNVPMYKDIATPETDDSIYDRDWFLPEDKEAKLASKPGFIYMDSMGFGMGCSCLQVTFQAPNINKARYLYDALVNFAPIMLAFSAAAPAFKGWLADQDVRWNVISGAVDDRTPKERGVAPLLPKYNKNGFGGIAKDVQDKVLEIPKSRYSSVDLFLGGSKFFNRTYNDTNVPINEKVLGRLLENDKAPLDYDLAKHFAHLYIRDPVSTFEELLNQDNKTSSNHFENIQSTNWQTLRFKPPTQQATPDKKDSPGWRVEFRPFEVQLLDFENAAYSVLIYLIVDSILTFSDNINAYIHMSKVWENMKIAHHRDAILFEKFHWKKSFRNDTDVETEDYSISEIFHNPENGIFPQFVTPILCQKGFVTKDWKELKHSSKHERLYYYLKLISDRASGELPTTAKFFRNFVLQHPDYKHDSKISKSINYDLLSTCDRLTHLDDSKGELTSFLGAEIAEYVKKNKPSIESKC

SEQ ID NO: 22153 - protein, 1058 aa, Saccharomyces cerevisiae
MSGSFWKFGQDFGSQSPLAKLLNRAFIKIDDKPTSTEAGKIDSNSTDESLESNSFKSEDEEEEYELPNREEDYKAYKPNLSLLNDLLDDEELYTELMCSNFKLLVYLKYPEVLSKLIDYVRNSTILESNIDRVTSEDRDLVRGEDKDTTEDFENAKADKKNIDGTFEEKERTRSGEEEELENEENDSASEDTRVTLPHELEEHDDTRRARIAAEILSADVWPISSALIENEGLLAKLWSILRLPSPLSIEASTYFMKINERLLDMNMDGIIEFILKKEHIVDDFLAHIDNPPLMDFLLKVISTDKPEISNGVIQLFKKQNLVPKLIHLLDPVFDSCTQSAAGDFLKALVTISGNCPNEITSSIGPNELTRQLVSPNMMKQLMDIMLKGGNSLNNGVGIIIELIRKNNSDYDTIQTNYTTIESHPPTDRDPIYLGYLVKMFSEHMADFNKILTEKKIPLLQTSYGTIEPLGFERFKICELIAELLHCSNMTLLNEPSAYDIVRERDAERERIFNSQNYVDSNDRSELKENEDDNTGDADDEVEDDTNQVESANTSIDGEEVIDKLNSLQIETNKVNQNMNNEEQHSLMPDFNNGDFKDEEDENPFEPQYSDVILDSSDIEKNFRVSPNVGDQLKISLQDTRVIDTMLEMFFHFQWNNFLHNVVYDVVQQIFNGPLKIGYNRFLLDDLLINIRLTDMIINGNNECIEYEKGHDTRLGYMGHLTLIAEEVTKFTAYIEEMNITFENTEVMSSLFESKWIAYTEDVLEDLKEKYNAILGDIAEEGDMLQDEEEDAVYDKGERTMGTVDDYINDIMQMDNVRCQEEEEDEGEGYVSFDEDEPQEYRNGDSVRSKESNSSEGKRDQEQLYYEYVNEDGTKTRLNFNPDSDATEQVPGEVNRDHKIPLKLKRSFTDACKSETIPNNTVNAKEESVFQFSNELSDGWESSPSNSIPKRASPSKNGMNSPMFQHQFELHSPTDEFGGHKDEILSAEGHDYDIDEYDELSDDSDEEYDNCEDEDSLDYADSAAYALCRSKSKDKISWDEEEQARLMGVVKFNSEHYRD

SEQ ID NO: 22154 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 22155 - protein, 1174 aa, Saccharomyces cerevisiae
MSSNNDLWLHLVSQLNTQQRAAALFDYTRGLQVIAGPGTGKTKVLTSRVAYLILHHHIHPRDIIVTTFTNKAANEMKERLQEMLRGAGVNISELLIGTFHSICLKILYRFGHLVDLQKDWRIIDEKEIDVILDDMIEKVPDQIRDYASSITRKVNLCMPSKNGDEWTIHPKLIKKQISKLKSNAILPEEYILDSNHDAALGYFYQIYQSELSKKNTLDFDDLLMYTFRLLTRVRVLSNIKHVLVDEFQDTNGIQLDLMFLFAKGNHHLSRGMTIVGDPDQSIYAFRNALAHNFLEMGRKCPIEYSTIILVENYRSSQKILNTSEILITQQNKGRQNRAPLRAQFDLDFPPVYMNFPAYFLEAPSLVRELLYLKALPNLFTFNDFAILVRQRRQIKRIESALIEHRIPYKIIRGHSFWDSKETRAMLNLLKLIFSPNDKHAILASLLYPARGLGPATGEKIKNALDTLATDVSCFQILKDISSKKIMLDIPTKGRSVIADFISMIENCQLLLQSTLLGGLSDLFDKLYELSGLKYEYLYKDGKKKNDQLEKSEPNLLNARHKNIELLKNYFLALLSKSESSDKEKNEAIKAATDEAEPIENKVITPKEYLRNFFNSLSLHSDAAEEEESESNKDAKIKREKNGFVTISTIHGAKGLEWPVVFIPGCEEGIIPCVFNDDKKDESEEDEEEDQENSKKDASPKKTRVLSVEDSIDEERRMFFVAQTRAKYLLYLSNTVTVEDVDRPRIASRFLTTDLIKAMSDSQKLFESTNSIKKLYRILNKKPPAEDDKLFSLDQLRKDYNQFIENRRERMIWQGIQMNDVYGIQLSRNKLLGSVSDFTSAADQLRLETQNSIFPQKKLIEKSRPSKINGNYAPKSRVKSPEKRYAPETTSFHSPTKKKVYAPQYVSTTNVPSRQEFHSSTGKNIPFLRREDRSITDISPRSSTRSLKGASPNKTSHMSDDLMRPSPTRKDKVTRNIHFATAGTFRIETQSNVDELHPPEYSNKSGQSLTSSEFSGFSSACSNSDQPTNLIEDINNELDLSDEELLNDISIERRRELLGSKKTKKIKPKTRNRKSKRGDKVKVEEVIDLKSEFEEDDSRNTTAAELLHNPDDTTVDNRPIISNAKFLADAAMKKTQKFSKKVKNEPASSQMDIFSQLSRAKKKSKLNNGEIIVID

SEQ ID NO: 22156 - protein, 440 aa, Saccharomyces cerevisiae
MLSCSVSFRDDKKLVIFSVKCNSQQYRPLRNARTNFFEPDWSPFLSSARLPIPVHPKKSTYINRLFTSKGSLFLVCPLSTVNNEQFFFFFLAIYPSTCTLVTMSTTASTPSSLRHLISIKDLSDEEFRILVQRAQHFKNVFKANKTNDFQSNHLKLLGRTIALIFTKRSTRTRISTEGAATFFGAQPMFLGKEDIQLGVNESFYDTTKVVSSMVSCIFARVNKHEDILAFCKDSSVPIINSLCDKFHPLQAICDLLTIIENFNISLDEVNKGINSKLKMAWIGDANNVINDMCIACLKFGISVSISTPPGIEMDSDIVDEAKKVAERNGATFELTHDSLKASTNANILVTDTFVSMGEEFAKQAKLKQFKGFQINQELVSVADPNYKFMHCLPRHQEEVSDDVFYGEHSIVFEEAENRLYAAMSAIDIFVNNKGNFKDLK

SEQ ID NO: 22157 - protein, 623 aa, Saccharomyces cerevisiae
MPAEIDIDEADVLVLSQELQKTSKLTFEINKSLKKIAATSNQSSQLFTPILARNNVLTTLQRNIESTLNSVASVKDLANEASKYEIILQKGINQVGLKQYTQVVHKLDDMLEDIQSGQANREENSEFHGILTHLEQLIKRSEAQLRVYFISILNSIKPFDPQINITKKMPFPYYEDQQLGALSWILDYFHGNSEGSIIQDILVGERSKLILKCMAFLEPFAKEISTAKNAPYEKGSSGMNSYTEALLGFIANEKSLVDDLYSQYTESKPHVLSQILSPLISAYAKLFGANLKIVRSNLENFGFFSFELVESINDVKKSLRGKELQNYNLLQDCTQEVRQVTQSLFRDAIDRIIKKANSISTIPSNNGVTEATVDTMSRLRKFSEYKNGCLGAMDNITRENWLPSNYKEKEYTLQNEALNWEDHNVLLSCFISDCIDTLAVNLERKAQIALMPNQEPDVANPNSSKNKHKQRIGFFILMNLTLVEQIVEKSELNLMLAGEGHSRLERLKKRYISYMVSDWRDLTANLMDSVFIDSSGKKSKDKEQIKEKFRKFNEGFEDLVSKTKQYKLSDPSLKVTLKSEIISLVMPMYERFYSRYKDSFKNPRKHIKYTPDELTTVLNQLVR

SEQ ID NO: 22158 - protein, 489 aa, Saccharomyces cerevisiae
MSNAALQVYGGDEVSAVVIDPGSYTTNIGYSGSDFPQSILPSVYGKYTADEGNKKIFSEQSIGIPRKDYELKPIIENGLVIDWDTAQEQWQWALQNELYLNSNSGIPALLTEPVWNSTENRKKSLEVLLEGMQFEACYLAPTSTCVSFAAGRPNCLVVDIGHDTCSVSPIVDGMTLSKSTRRNFIAGKFINHLIKKALEPKEIIPLFAIKQRKPEFIKKTFDYEVDKSLYDYANNRGFFQECKETLCHICPTKTLEETKTELSSTAKRSIESPWNEEIVFDNETRYGFAEELFLPKEDDIPANWPRSNSGVVKTWRNDYVPLKRTKPSGVNKSDKKVTPTEEKEQEAVSKSTSPAANSADTPNETGKRPLEEEKPPKENNELIGLADLVYSSIMSSDVDLRATLAHNVVLTGGTSSIPGLSDRLMTELNKILPSLKFRILTTGHTIERQYQSWLGGSILTSLGTFHQLWVGKKEYEEVGVERLLNDRFR

SEQ ID NO: 22159 - protein, 1189 aa, Saccharomyces cerevisiae
MYKLQVVLVPPSLQATMPIQFGYGPTIAESSQLLPNRTNMAQSAGDASLQYANLRSANVSFTPSYFNQSRFRKFLLFTKPTNTLLNLSDEIIDKCEKMYPSLQEDIEILSLQDNSGCDLDPDFLVKDVFNVNNIVRVILKNEIDLDDSAPVSLYKSVKRSKLNNGSPQSVQPQQQIPSSSGVLRIAKKRPPTGTTTTTTIRSATNGSMRVSTPLARQIYPPPSSKIVSNNSDDEDEDIGERSFLPPPTQPQSPPIRISSGIDAGKKIKSSIVEEDIVSRSATVDPDKTKQQRLLSGTPIMSTMTPNRVTLTGQRVVSEHAHKNELVFSASASSSSFANGGTAAVTAQDINRKPPVTTPRITSGMLKIPEPRISEIEKELKEGPSSPASILPAKAAKIPMKKPYLENGENYESDDSSSSENQETPETEPHSKASLQRSQSSIADNNGSPVKNSPLGDAMPHNVHLAELPKASNTSITKSSNGESWGKQQEHQPPRKSSLETIVEKKSQAEPSGIVEPKRMTNFLDDNQVREKEDTNDKLLEKEILPTIPHNDQPILASSDKSNGTLKSLAGKVSSNNNASKEDGTIINGTIEDDGNDNDEVDTTVRIVPQDSDSSSFPKSDLFKMIEGDDTDLPQWFKGKNSRTSGNSKNSKPYTTVLNKDIDNSKPDPRNILPQRTPRSAAKRAAQLLAGAKKNEVPQKSTEDSSSAASTDDESESGIETDFSSDDDFKRKNMSVPNNGPKDISLHSLKGSVVPVKDSKIINKEVDEERNDKRDSQKKSAVSESSVTNSKISEQMAKSFYPNSNKKQNEATKVETKPATQASSFPVVGGSPSVATKGTTSFNEEGNRKNVKTKAKNESAQIDRQQKETTSRVADLKSANIGGEDLNKKAEGSKEPEKASANIQDANDKNNSKEKEDSKSKQVSQKKLKMTDHLKEGNVQLPKPSANDKLKDLKAKFTNSKTLVPPGIISNEKNNSSANDDDSSSSGSSTEDESSSSSSSSDEETSTSRKARRVVVNTPREPVRSSSKIEAPSPSVNKKINATPDKIPVTQLMDMSSPPSVKSKTTSNPSSILHDLPRKVRPSLSSLSDLVSRGIPDVKEKTSKSNEKSQTKAPSSSDDESSSDSDSNSSSDSVSDSSSDSKSESDSDDSGDSSDDGKSFISAKSASAALGKKKKPSGGFASLIKDFKKK

SEQ ID NO: 22160 - protein, 1230 aa, Saccharomyces cerevisiae
MYIKRVIIKGFKTYRNETIIDNFSPHQNVIIGSNGSGKSNFFAAIRFVLSDDYSNLKREERQGLIHQGSGGSVMSASVEIVFHDPDHSMILPSGVLSRGDDEVTIRRTVGLKKDDYQLNDRNVTKGDIVRMLETAGFSMNNPYNIVPQGKIVALTNAKDKERLQLLEDVVGAKSFEVKLKASLKKMEETEQKKIQINKEMGELNSKLSEMEQERKELEKYNELERNRKIYQFTLYDRELNEVINQMERLDGDYNNTVYSSEQYIQELDKREDMIDQVSKKLSSIEASLKIKNATDLQQAKLRESEISQKLTNVNVKIKDVQQQIESNEEQRNLDSATLKEIKSIIEQRKQKLSKILPRYQELTKEEAMYKLQLASLQQKQRDLILKKGEYARFKSKDERDTWIHSEIEELKSSIQNLNELESQLQMDRTSLRKQYSAIDEEIEELIDSINGPDTKGQLEDFDSELIHLKQKLSESLDTRKELWRKEQKLQTVLETLLSDVNQNQRNVNETMSRSLANGIINVKEITEKLKISPESVFGTLGELIKVNDKYKTCAEVIGGNSLFHIVVDTEETATLIMNELYRMKGGRVTFIPLNRLSLDSDVKFPSNTTTQIQFTPLIKKIKYEPRFEKAVKHVFGKTIVVKDLGQGLKLAKKHKLNAITLDGDRADKRGVLTGGYLDQHKRTRLESLKNLNESRSQHKKILEELDFVRNELNDIDTKIDQVNGNIRKVSNDRESVLTNIEVYRTSLNTKKNEKLILEESLNAIILKLEKLNTNRTFAQEKLNTFENDLLQEFDSELSKEEKERLESLTKEISAAHNKLNITSDALEGITTTIDSLNAELESKLIPQENDLESKMSEVGDAFIFGLQDELKELQLEKESVEKQHENAVLELGTVQREIESLIAEETNNKKLLEKANNQQRLLLKKLDNFQKSVEKTMIKKTTLVTRREELQQRIREIGLLPEDALVNDFSDITSDQLLQRLNDMNTEISGLKNVNKRAFENFKKFNERRKDLAERASELDESKDSIQDLIVKLKQQKVNAVDSTFQKVSENFEAVFERLVPRGTAKLIIHRKNDNANDHDESIDVDMDAESNESQNGKDSEIMYTGVSISVSFNSKQNEQLHVEQLSGGQKTVCAIALILAIQMVDPASFYLFDEIDAALDKQYRTAVATLLKELSKNAQFICTTFRTDMLQVADKFFRVKYENKISTVIEVNREEAIGFIRGSNKFAEV

SEQ ID NO: 22161 - protein, 574 aa, Saccharomyces cerevisiae
MWRRIFAHELKYDQPNASSKNLILSVLNTTATKREAKDYLSKYTNDSGQHNHCLFFIRDLHKVAPAILSQFSSVIKRLGMLGLRPMFVIPPSPTHVNIQAELLDSIVTEADLKPLHLKEGLTKSRTGLYHSVFSQESRFFDIGNSNFIPIVKPYVYNEETASEFMTKDVVKFMDCLCQGNIPHIDKFFILNNAGGIPSGERNDNAHVFINLSQELEHLSSSLSHNISTLTKREPRSQNLLHRMEVYVKKDEISSLECEYHDHLENLLLMDKVLSNLAATATGLITTVKAAALSSDRKNPLVYNLLTDRSLISSSLPRFKKKDGEIDSPANMFDDHAWYELPSQQVNAAPSNSDAVLVTTVLKKGVHIKTYDYKTLTQFNSIGLPKKFHVPEKGAKPSSNSPKLDINKFKSIIDQSFKRSLDLHDYIKRINGKIATIIVIGDYEGIAILTYEGSEENSFVYLDKFAVLPHLKGSLGISDIIFNLMFKKFPNEILWRSRKDNVVNKWYFQRSVAVLDLSIDLDPEHCDEKQSQFKLFYYGNPQYAKRALRDKKRLREFMRSVRDIKPSWENEKNIS

SEQ ID NO: 22162 - protein, 444 aa, Saccharomyces cerevisiae
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 22163 - protein, 332 aa, Saccharomyces cerevisiae
MIRIAINGFGRIGRLVLRLALQRKDIEVVAVNDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLEKEATYDQIKKAVKAAAEGPMKGVLGYTEDAVVSSDFLGDTHASIFDASAGIQLSPKFVKLISWYDNEYGYSARVVDLIEYVAKA

SEQ ID NO: 22164 - protein, 1073 aa, Saccharomyces cerevisiae
MDSTDLFDVFEETPVELPTDSNGEKNADTNVGDTPDHTQDKKHGLEEEKEEHEENNSENKKIKSNKSKTEDKNKKVVVPVLADSFEQEASREVDASKGLTNSETLQVEQDGKVRLSHQVRHQVALPPNYDYTPIAEHKRVNEARTYPFTLDPFQDTAISCIDRGESVLVSAHTSAGKTVVAEYAIAQSLKNKQRVIYTSPIKALSNQKYRELLAEFGDVGLMTGDITINPDAGCLVMTTEILRSMLYRGSEVMREVAWVIFDEVHYMRDKERGVVWEETIILLPDKVRYVFLSATIPNAMEFAEWICKIHSQPCHIVYTNFRPTPLQHYLFPAHGDGIYLVVDEKSTFREENFQKAMASISNQIGDDPNSTDSRGKKGQTYKGGSAKGDAKGDIYKIVKMIWKKKYNPVIVFSFSKRDCEELALKMSKLDFNSDDEKEALTKIFNNAIALLPETDRELPQIKHILPLLRRGIGIHHSGLLPILKEVIEILFQEGFLKVLFATETFSIGLNMPAKTVVFTSVRKWDGQQFRWVSGGEYIQMSGRAGRRGLDDRGIVIMMIDEKMEPQVAKGMVKGQADRLDSAFHLGYNMILNLMRVEGISPEFMLEHSFFQFQNVISVPVMEKKLAELKKDFDGIEVEDEENVKEYHEIEQAIKGYREDVRQVVTHPANALSFLQPGRLVEISVNGKDNYGWGAVVDFAKRINKRNPSAVYTDHESYIVNVVVNTMYIDSPVNLLKPFNPTLPEGIRPAEEGEKSICAVIPITLDSIKSIGNLRLYMPKDIRASGQKETVGKSLREVNRRFPDGIPVLDPVKNMKIEDEDFLKLMKKIDVLNTKLSSNPLTNSMRLEELYGKYSRKHDLHEDMKQLKRKISESQAVIQLDDLRRRKRVLRRLGFCTPNDIIELKGRVACEISSGDELLLTELIFNGNFNELKPEQAAALLSCFAFQERCKEAPRLKPELAEPLKAMREIAAKIAKIMKDSKIEVVEKDYVESFRHELMEVVYEWCRGATFTQICKMTDVYEGSLIRMFKRLEELVKELVDVANTIGNSSLKEKMEAVLKLIHRDIVSAGSLYL

SEQ ID NO: 22165 - protein, 634 aa, Saccharomyces cerevisiae
MLSLKKGITKSYILQRTFTSSSVVRQIGEVKSESKPPAKYHIIDHEYDCVVVGAGGAGLRAAFGLAEAGYKTACLSKLFPTRSHTVAAQGGINAALGNMHPDDWKSHMYDTVKGSDWLGDQDAIHYMTREAPKSVIELEHYGMPFSRTEDGRIYQRAFGGQSKDFGKGGQAYRTCAVADRTGHAMLHTLYGQALKNNTHFFIEYFAMDLLTHNGEVVGVIAYNQEDGTIHRFRAHKTVIATGGYGRAYFSCTSAHTCTGDGNAMVSRAGFPLEDLEFVQFHPSGIYGSGCLITEGARGEGGFLLNSEGERFMERYAPTAKDLASRDVVSRAITMEIRAGRGVGKNKDHILLQLSHLPPEVLKERLPGISETAAVFAGVDVTQEPIPVLPTVHYNMGGIPTKWTGEALTIDEETGEDKVIPGLMACGEAACVSVHGANRLGANSLLDLVVFGRAVANTIADTLQPGLPHKPLASNIGHESIANLDKVRNARGSLKTSQIRLNMQRTMQKDVSVFRTQDTLDEGVRNITEVDKTFEDVHVSDKSMIWNSDLVETLELQNLLTCATQTAVSASKRKESRGAHAREDYAKRDDVNWRKHTLSWQKGTSTPVKIKYRNVIAHTLDENECAPVPPAVRSY

SEQ ID NO: 22166 - protein, 1398 aa, Saccharomyces cerevisiae
MDSKDTQKLLKEHRIPCIDVGWLVRPSASTSKSSRPGKSESKANSVAPDIQMDTARPPVFETSVDSSSSILSSNDKGRRHSVAASLLMDNQRANAGSTSVPTNIPPPRGRSKSVVETNLSNVEADSGHHHHHRHHHHTEDAPAPKKVGFFKSLFGHRKKDQEQQEKERERKERSPSPTHVDRGAAIRRERTATISAESPPPLQYNAPPSYNDTVVPLTRSKTESEVYYENHPQSYYHGRMRTYHSPEEGKVDGTSPADDHNYGGSRPDPRLMDFLRYYKSKDYKLAAFKEGNFIKSSASPTTKKNRRASFSLHNDKPQPAKSLAHQKFDAKGRPIPPHPDAPKLPSAFRKKHPSNASIVDTVDSNSDVSSSAQNNNQTPSSHKFGAFLRKVTSYGNNNNNSTNASSLSANVNNPDTSSTSLWSSSSMEFDPSKITTVPGLENIRPLKHVSFATNTYFNDPPQQICSKNPRKGEVEVKPNGSVVIHRLTPQERKKIMESTSLGVVVGGTGQLKLLNPEEDDANAKSKEEMAPQKQNEVEAHDEEDNNSQRRNIVMAAAEAAAEARAKEAPNELKRIVTNNEEEVTVSKTASHLTIDKPMISRRGASTSSLASMVSSDTNGTNADDEGEILPPPSLKIPHDIVYTRCCHLREILPIPATLKQLKKGSTDPIPILQLRNPRPSMVEIWSFSDFLSIAPVLCLSLDGVQLTVQMLRIILSSLVYKQHFQKLSLRNTPLDEEGWKVLCYFVSKAKSLHSIDLTMVPSIKTNVQKPSKSSLKSKILRMQCNLENRSDMNWDLLTASIALMGGLEEIVISGAKMNSAQFKNFILVACIATERLGLAYNGLSKSQCDDLAKWMVQSKVTGLDVGFNDLNGKLSSFTDAVLGKIQKANEKNVFKFLSLNGTNLRVNEHDTFENNEVLKLISVLCYLENLKFLDISNNPAIFPHCVPTLIDFLPVFVNLVRLHIDYNNLSSTSVVMLAEILPMCSRLNYFSMLGTELDLASSKALAEAVRKSSSLMTLDVDYVYMPENIKEKISLYALRNIQGELKRVNSDDKDIKDSQFSSLQDQLSLLLTEKADNSEHYNKMVENFMAKIALARIKISKVVHDLFDLKLNGQLNLEGKEALIRLCFIEASLERGCDLLKQRHNNTLKSPEAVSKSRKGGNQAQPNSESCQRMLLSSSILQNSDHIALMPFGSAIVEKSSPDAEDAVEFREGDDSNVNHEDVPANDQQFRDEVDIKNKYSIIKRELEHEKLVGGGDLPVDKEILNRAAQSLDSDQIKEFLLKNDVSTILGVIDELHSQGYHLHHIFKKQGNQEETAFRTKDEQQSSQSNDSSANASPTTDPISTGSNTSRTNDNAHIPPTDAPGFDKFMNNAEENAIDAAYDDVLDKIQDARNSSTK

SEQ ID NO: 22167 - protein, 682 aa, Saccharomyces cerevisiae
MFFNRLSAGKLLVPLSVVLYALFVVILPLQNSFHSSNVLVRGADDVENYGTVIGIDLGTTYSCVAVMKNGKTEILANEQGNRITPSYVAFTDDERLIGDAAKNQVAANPQNTIFDIKRLIGLKYNDRSVQKDIKHLPFNVVNKDGKPAVEVSVKGEKKVFTPEEISGMILGKMKQIAEDYLGTKVTHAVVTVPAYFNDAQRQATKDAGTIAGLNVLRIVNEPTAAAIAYGLDKSDKEHQIIVYDLGGGTFDVSLLSIENGVFEVQATSGDTHLGGEDFDYKIVRQLIKAFKKKHGIDVSDNNKALAKLKREAEKAKRALSSQMSTRIEIDSFVDGIDLSETLTRAKFEELNLDLFKKTLKPVEKVLQDSGLEKKDVDDIVLVGGSTRIPKVQQLLESYFDGKKASKGINPDEAVAYGAAVQAGVLSGEEGVEDIVLLDVNALTLGIETTGGVMTPLIKRNTAIPTKKSQIFSTAVDNQPTVMIKVYEGERAMSKDNNLLGKFELTGIPPAPRGVPQIEVTFALDANGILKVSATDKGTGKSESITITNDKGRLTQEEIDRMVEEAEKFASEDASIKAKVESRNKLENYAHSLKNQVNGDLGEKLEEEDKETLLDAANDVLEWLDDNFETAIAEDFDEKFESLSKVAYPITSKLYGGADGSGAADYDDEDEDDDGDYFEHDEL

SEQ ID NO: 22168 - protein, 770 aa, Saccharomyces cerevisiae
MAKKNRLNTTQRKTLRQKEDEYIENLKTKIDEYDPKITKAKFFKDLPISDPTLKGLRESSFIKLTEIQADSIPVSLQGHDVLAAAKTGSGKTLAFLVPVIEKLYREKWTEFDGLGALIISPTRELAMQIYEVLTKIGSHTSFSAGLVIGGKDVKFELERISRINILIGTPGRILQHLDQAVGLNTSNLQMLVLDEADRCLDMGFKKTLDAIVSTLSPSRQTLLFSATQSQSVADLARLSLTDYKTVGTHDVMDGSVNKEASTPETLQQFYIEVPLADKLDILFSFIKSHLKCKMIVFLSSSKQVHFVYETFRKMQPGISLMHLHGRQKQRARTETLDKFNRAQQVCLFATDVVARGIDFPAVDWVVQVDCPEDVDTYIHRVGRCARYGKKGKSLIMLTPQEQEAFLKRLNARKIEPGKLNIKQSKKKSIKPQLQSLLFKDPELKYLGQKAFISYVRSIYVQKDKQVFKFDELPTEEFAYSLGLPGAPKIKMKGMKTIEQAKERKNAPRQLAFLSKANEDGEVIEDKSKQPRTKYDKMFERKNQTILSEHYLNITKAQAQEDEDDDFISVKRKDHEINEAELPALTLPTSRRAQKKALSKKASLASKGNASKLIFDDEGEAHPVYELEDEEEFHKRGDAEVQKTEFLTKESAVMADIDNIDKQVAKEKKQEKKRKRLEAMRREMEAAMEEEISGDEEEGKTVAYLGTGNLSDDMSDGDMPDSEGHLKKKARTVDYSHGHNPSNSVDDDIIEVEEPQTLEDLESLTAKLIQG

SEQ ID NO: 22169 - protein, 196 aa, Saccharomyces cerevisiae
MSQSISLKGSTRTVTEFFEYSINSILYQRGVYPAEDFVTVKKYDLTLLKTHDDELKDYIRKILLQVHRWLLGGKCNQLVLCIVDKDEGEVVERWSFNVQHISGNSNGQDDVVDLNTTQSQIRALIRQITSSVTFLPELTKEGGYTFTVLAYTDADAKVPLEWADSNSKEIPDGEVVQFKTFSTNDHKVGAQVSYKY

SEQ ID NO: 22170 - protein, 399 aa, Saccharomyces cerevisiae
MPKETPSKAAADALSDLEIKDSKSNLNKELETLREENRVKSDMLKEKLSKDAENHKAYLKSHQVHRHKLKEMEKEEPLLNEDKERTVLFPIKYHEIWQAYKRAEASFWTAEEIDLSKDIHDWNNRMNENERFFISRVLAFFAASDGIVNENLVENFSTEVQIPEAKSFYGFQIMIENIHSETYSLLIDTYIKDPKESEFLFNAIHTIPEIGEKAEWALRWIQDADALFGERLVAFASIEGVFFSGSFASIFWLKKRGMMPGLTFSNELICRDEGLHTDFACLLFAHLKNKPDPAIVEKIVTEAVEIEQRYFLDALPVALLGMNADLMNQYVEFVADRLLVAFGNKKYYKVENPFDFMENISLAGKTNFFEKRVSDYQKAGVMSKSTKQEAGAFTFNEDF

SEQ ID NO: 22171 - protein, 534 aa, Saccharomyces cerevisiae
MQAPVVFMNASQERTTGRQAQISNITAAKAVADVIRTCLGPKAMLKMLLDPMGGLVLTNDGHAILREIDVAHPAAKSMLELSRTQDEEVGDGTTTVIILAGEILAQCAPYLIEKNIHPVIIIQALKKALTDALEVIKQVSKPVDVENDAAMKKLIQASIGTKYVIHWSEKMCELALDAVKTVRKDLGQTVEGEPNFEIDIKRYVRVEKIPGGDVLDSRVLKGVLLNKDVVHPKMSRHIENPRVVLLDCPLEYKKGESQTNIEIEKEEDWNRILQIEEEQVQLMCEQILAVRPTLVITEKGVSDLAQHYLLKGGCSVLRRVKKSDNNRIARVTGATIVNRVEDLKESDVGTNCGLFKVEMIGDEYFSFLDNCKEPKACTIMLRGGSKDILNEIDRNLQDAMAVARNVMLSPSLSPGGGATEMAVSVKLAEKAKQLEGIQQWPYQAVADAMECIPRTLIQNAGGDPIRLLSQLRAKHAQGNFTTGIDGDKGKIVDMVSYGIWEPEVIKQQSVKTAIESACLLLRVDDIVSGVRKQE

SEQ ID NO: 22172 - protein, 515 aa, Saccharomyces cerevisiae
MKAYAKKRISYMPSSPSQNVINFEEIETQKENILPLKEGRSAAALSKAIHQPLVEINQVKSSFEQRLIDELPALSDPITLYLEYIKWLNNAYPQGGNSKQSGMLTLLERCLSHLKDLERYRNDVRFLKIWFWYIELFTRNSFMESRDIFMYMLRNGIGSELASFYEEFTNLLIQKEKFQYAVKILQLGIKNKARPNKVLEDRLNHLLRELGENNIQLGNEISMDSLESTVLGKTRSEFVNRLELANQNGTSSDVNLTKNNVFVDGEESDVELFETPNRGVYRDGWENFDLKAERNKENNLRISLLEANTNLGELKQHEMLSQKKRPYDEKLPIFRDSIGRSDPVYQMINTKDQKPEKIDCNFKLIYCEDEESKGGRLEFSLEEVLAISRNVYKRVRTNRKHPREANLGQEESANQKEAEAQSKRPKISRKALVSKSLTPSNQGRMFSGEEYINCPMTPKGRSTETSDIISAVKPRQLTPILEMRESNSFSQSKNSEIISDDDKSSSSFISYPPQR

SEQ ID NO: 22173 - protein, 568 aa, Saccharomyces cerevisiae
MSLRLPQNPNAGLFKQGYNSYSNADGQIIKSIAAIRELHQMCLTSMGPCGRNKIIVNHLGKIIITNDAATMLRELDIVHPAVKVLVMATEQQKIDMGDGTNLVMILAGELLNVSEKLISMGLSAVEIIQGYNMARKFTLKELDEMVVGEITDKNDKNELLKMIKPVISSKKYGSEDILSELVSEAVSHVLPVAQQAGEIPYFNVDSIRVVKIMGGSLSNSTVIKGMVFNREPEGHVKSLSEDKKHKVAVFTCPLDIANTETKGTVLLHNAQEMLDFSKGEEKQIDAMMKEIADMGVECIVAGAGVGELALHYLNRYGILVLKVPSKFELRRLCRVCGATPLPRLGAPTPEELGLVETVKTMEIGGDRVTVFKQEQGEISRTSTIILRGATQNNLDDIERAIDDGVAAVKGLMKPSGGKLLPGAGATEIELISRITKYGERTPGLLQLAIKQFAVAFEVVPRTLAETAGLDVNEVLPNLYAAHNVTEPGAVKTDHLYKGVDIDGESDEGVKDIREENIYDMLATKKFAINVATEAATTVLSIDQIIMAKKAGGPRAPQGPRPGNWDQED

SEQ ID NO: 22174 - protein, 323 aa, Saccharomyces cerevisiae
MPSTFESQLFFSRPFLSKRQIQRAQKNTISDYRNYNQKKLAVFKFLSDLCVQLKFPRKTLETAVYFYQRYHLFNRFETEVCYTVATSCLTLGCKEVETIKKTNDICTLSLRLRNVVKINTDILENFKKRVFQIELRILESCSFDYRVNNYVHIDEYVIKIGRELSFDYKLCNLAWVIAYDALKLETILVIPQHSIALAILKIAYELLDNKNWSSKRYSLFETDEKSVNEAYFDIVNFYINSFDMCDLQRHLPADLLPIGVERFMELKKNAGPESGLPQIPDHLLNADPYITITRDNNVQERRYVLSLELINGESSINSSTRHA

SEQ ID NO: 22175 - protein, 2026 aa, Saccharomyces cerevisiae
MSSKPDTGSEISGPQRQEEQEQQIEQSSPTEANDRSIHDEVPKVKKRHEQNSGHKSRRNSAYSYYSPRSLSMTKSRESITPNGMDDVSISNVEHPRPTEPKIKRGPYLLKKTLSSLSMTSANSTHDDNKDHGYALNSSKTHNYTSTHNHHDGHHDHHHVQFFPNRKPSLAETLFKRFSGSNSHDGNKSGKESKVANLSLSTVNPAPANRKPSKDSTLSNHLADNVPSTLRRKVSSLVRGSSVHDINNGIADKQIRPKAVAQSENTLHSSDVPNSKRSHRKSFLLGSTSSSSSRRGSNVSSMTNSDSASMATSGSHVLQHNVSNVSPTTKSKDSVNSESADHTNNKSEKVTPEYNENIPENSNSDNKREATTPTIETPISCKPSLFRLDTNLEDVTDITKTVPPTAVNSTLNSTHGTETASPKTVIMPEGPRKSVSMADLSVAAAAPNGEFTSTSNDRSQWVAPQSWDVETKRKKTKPKGRSKSRRSSIDADELDPMSPGPPSKKDSRHHHDRKDNESMVTAGDSNSSFVDICKENVPNDSKTALDTKSVNRLKSNLAMSPPSIRYAPSNLDGDYDTSSTSSSLPSSSISSEDTSSCSDSSSYTNAYMEANREQDNKTPILNKTKSYTKKFTSSSVNMNSPDGAQSSGLLLQDEKDDEVECQLEHYYKDFSDLDPKRHYAIRIFNTDDTFTTLSCTPATTVEEIIPALKRKFNITAQGNFQISLKVGKLSKILRPTSKPILIERKLLLLNGYRKSDPLHIMGIEDLSFVFKFLFHPVTPSHFTPEQEQRIMRSEFVHVDLRNMDLTTPPIIFYQHTSEIESLDVSNNANIFLPLEFIESSIKLLSLRMVNIRASKFPSNITKAYKLVSLELQRNFIRKVPNSIMKLSNLTILNLQCNELESLPAGFVELKNLQLLDLSSNKFMHYPEVINYCTNLLQIDLSYNKIQSLPQSTKYLVKLAKMNLSHNKLNFIGDLSEMTDLRTLNLRYNRISSIKTNASNLQNLFLTDNRISNFEDTLPKLRALEIQENPITSISFKDFYPKNMTSLTLNKAQLSSIPGELLTKLSFLEKLELNQNNLTRLPQEISKLTKLVFLSVARNKLEYIPPELSQLKSLRTLDLHSNNIRDFVDGMENLELTSLNISSNAFGNSSLENSFYHNMSYGSKLSKSLMFFIAADNQFDDAMWPLFNCFVNLKVLNLSYNNFSDVSHMKLESITELYLSGNKLTTLSGDTVLKWSSLKTLMLNSNQMLSLPAELSNLSQLSVFDVGANQLKYNISNYHYDWNWRNNKELKYLNFSGNRRFEIKSFISHDIDADLSDLTVLPQLKVLGLMDVTLNTTKVPDENVNFRLRTTASIINGMRYGVADTLGQRDYVSSRDVTFERFRGNDDECLLCLHDSKNQNADYGHNISRIVRDIYDKILIRQLERYGDETDDNIKTALRFSFLQLNKEINGMLNSVDNGADVANLSYADLLSGACSTVIYIRGKKLFAANLGDCMAILSKNNGDYQTLTKQHLPTKREEYERIRISGGYVNNGKLDGVVDVSRAVGFFDLLPHIHASPDISVVTLTKADEMLIVATHKLWEYMDVDTVCDIARENSTDPLRAAAELKDHAMAYGCTENITILCLALYENIQQQNRFTLNKNSLMTRRSTFEDTTLRRLQPEISPPTGNLAMVFTDIKSSTFLWELFPNAMRTAIKTHNDIMRRQLRIYGGYEVKTEGDAFMVAFPTPTSGLTWCLSVQLKLLDAQWPEEITSVQDGCQVTDRNGNIIYQGLSVRMGIHWGCPVPELDLVTQRMDYLGPMVNKAARVQGVADGGQIAMSSDFYSEFNKIMKYHERVVKGKESLKEVYGEEIIGEVLEREIAMLESIGWAFFDFGEHKLKGLETKELVTIAYPKILASRHEFASEDEQSKLINETMLFRLRVISNRLESIMSALSGGFIELDSRTEGSYIKFNPKVENGIMQSISEKDALLFFDHVITRIESSVALLHLRQQRCSGLEICRNDKTSARSNIFNVVDELLQMVKNAKDLST

SEQ ID NO: 22176 - protein, 193 aa, Saccharomyces cerevisiae
MAVTFKDGVILGADSRTTTGAYIANRVTDKLTRVHDKIWCCRSGSAADTQAIADIVQYHLELYTSQYGTPSTETAASVFKELCYENKDNLTAGIIVAGYDDKNKGEVYTIPLGGSVHKLPYAIAGSGSTFIYGYCDKNFRENMSKEETVDFIKHSLSQAIKWDGSSGGVIRMVVLTAAGVERLIFYPDEYEQL

SEQ ID NO: 22177 - protein, 650 aa, Saccharomyces cerevisiae
MFTFLKIILWLFSLALASAININDITFSNLEITPLTANKQPDQGWTATFDFSIADASSIREGDEFTLSMPHVYRIKLLNSSQTATISLADGTEAFKCYVSQQAAYLYENTTFTCTAQNDLSSYNTIDGSITFSLNFSDGGSSYEYELENAKFFKSGPMLVKLGNQMSDVVNFDPAAFTENVFHSGRSTGYGSFESYHLGMYCPNGYFLGGTEKIDYDSSNNNVDLDCSSVQVYSSNDFNDWWFPQSYNDTNADVTCFGSNLWITLDEKLYDGEMLWVNALQSLPANVNTIDHALEFQYTCLDTIANTTYATQFSTTREFIVYQGRNLGTASAKSSFISTTTTDLTSINTSAYSTGSISTVETGNRTTSEVISHVVTTSTKLSPTATTSLTIAQTSIYSTDSNITVGTDIHTTSEVISDVETISRETASTVVAAPTSTTGWTGAMNTYISQFTSSSFATINSTPIISSSAVFETSDASIVNVHTENITNTAAVPSEEPTFVNATRNSLNSFCSSKQPSSPSSYTSSPLVSSLSVSKTLLSTSFTPSVPTSNTYIKTKNTGYFEHTALTTSSVGLNSFSETAVSSQGTKIDTFLVSSLIAYPSSASGSQLSGIQQNFTSTSLMISTYEGKASIFFSAELGSIIFLLLSYLLF

SEQ ID NO: 22178 - protein, 487 aa, Saccharomyces cerevisiae
MDALLTKFNEDRSLQDENLSQPRTRVRIVDDNLYNKSNPFQLCYKKRDYGSQYYHIYQYRLKTFRERVLKECDKRWDAGFTLNGQLVLKKDKVLDIQGNQPCWCVGSIYCEMKYKPNVLDEVINDTYGAPDLTKSYTDKEGGSDEIMLEDESGRVLLVGDFIRSTPFITGVVVGILGMEAEAGTFQVLDICYPTPLPQNPFPAPIATCPTRGKIALVSGLNLNNTSPDRLLRLEILREFLMGRINNKIDDISLIGRLLICGNSVDFDIKSVNKDELMISLTEFSKFLHNILPSISVDIMPGTNDPSDKSLPQQPFHKSLFDKSLESYFNGSNKEILNLVTNPYEFSYNGVDVLAVSGKNINDICKYVIPSNDNGESENKVEEGESNDFKDDIEHRLDLMECTMKWQNIAPTAPDTLWCYPYTDKDPFVLDKWPHVYIVANQPYFGTRVVEIGGKNIKIISVPEFSSTGMIILLDLETLEAETVKIDI

SEQ ID NO: 22179 - protein, 304 aa, Saccharomyces cerevisiae
MSTSHCRFYENKYPEIDDIVMVNVQQIAEMGAYVKLLEYDNIEGMILLSELSRRRIRSIQKLIRVGKNDVAVVLRVDKEKGYIDLSKRRVSSEDIIKCEEKYQKSKTVHSILRYCAEKFQIPLEELYKTIAWPLSRKFGHAYEAFKLSIIDETVWEGIEPPSKDVLDELKNYISKRLTPQAVKIRADVEVSCFSYEGIDAIKDALKSAEDMSTEQMQVKVKLVAAPLYVLTTQALDKQKGIEQLESAIEKITEVITKYGGVCNITMPPKAVTATEDAELQALLESKELDNRSDSEDDEDESDDE

SEQ ID NO: 22180 - protein, 332 aa, Saccharomyces cerevisiae
MVRVAINGFGRIGRLVMRIALQRKNVEVVALNDPFISNDYSAYMFKYDSTHGRYAGEVSHDDKHIIVDGHKIATFQERDPANLPWASLNIDIAIDSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSNSSIFDAAAGIQLSPKFVKLVSWYDNEYGYSTRVVDLVEHVAKA

SEQ ID NO: 22181 - protein, 511 aa, Saccharomyces cerevisiae
MPAPHGGILQDLIARDALKKNELLSEAQSSDILVWNLTPRQLCDIELILNGGFSPLTGFLNENDYSSVVTDSRLADGTLWTIPITLDVDEAFANQIKPDTRIALFQDDEIPIAILTVQDVYKPNKTIEAEKVFRGDPEHPAISYLFNVAGDYYVGGSLEAIQLPQHYDYPGLRKTPAQLRLEFQSRQWDRVVAFQTRNPMHRAHRELTVRAAREANAKVLIHPVVGLTKPGDIDHHTRVRVYQEIIKRYPNGIAFLSLLPLAMRMSGDREAVWHAIIRKNYGASHFIVGRDHAGPGKNSKGVDFYGPYDAQELVESYKHELDIEVVPFRMVTYLPDEDRYAPIDQIDTTKTRTLNISGTELRRRLRVGGEIPEWFSYPEVVKILRESNPPRPKQGFSIVLGNSLTVSREQLSIALLSTFLQFGGGRYYKIFEHNNKTELLSLIQDFIGSGSGLIIPNQWEDDKDSVVGKQNVYLLDTSSSADIQLESADEPISHIVQKVVLFLEDNGFFVF

SEQ ID NO: 22182 - protein, 314 aa, Saccharomyces cerevisiae
MVARGRTDEISTDVSEANSEHSLMITETSSPFRSIFSHSGKVANAGALEESDKQILEWAGKLELESMELRENSDKLIKVLNENSKTLCKSLNKFNQLLEQDAATNGNVKTLIKDLASQIENQLDKVSTAMLSKGDEKKTKSDSSYRQVLVEEISRYNSKITRHVTNKQHETEKSMRCTQEMLFNVGSQLEDVHKVLLSLSKDMHSLQTRQTALEMAFREKADHAYDRPDVSLNGTTLLHDMDEAHDKQRKKSVPPPRMMVTRSMKRRRSSSPTLSTSQNHNSEDNDDASHRLKRAARTIIPWEELRPDTLESEL

SEQ ID NO: 22183 - protein, 1408 aa, Saccharomyces cerevisiae
MHDVPMETVLAVNPATMIVKECINLCSAMNKQSRDKSQTSVAALLGGGSDIFLSQSDSFVDSFHNLPTSSYHDPLISGLVQLRLKINDLKGLDSLNALELLKPFLEIVSASSVSGYTTSLALDSLQKVFTLKIINKTFNDIQIAVRETVVALTHCRFEASKQISDDSVLLKVVTLLRDIITSSFGDYLSDTIIYDVLQTTLSLACNTQRSEVLRKTAEVTIAGITVKLFTKLKLLDPPTKTEKYINDESYTDNNLKDDIIGTTTSDNDLSSTDDDSAVADDNKNEKPVQQVIREQENDEETAEKAENVEPNYGITVIKDYLGLLLSLVMPENRMKHTTSAMKLSLQLINAAIEISGDKFPLYPRLFSLISDPIFKSVLFIIQSSTQYSLLQATLQLFTSLVVILGDYLPMQIELTLRRIFEILEDTTISGDVSKQKPPAIRELIIEQLSILWIHSPAFFLQLFVNFDCNLDRSDLSIDFIKELTKFSLPAAAVNTSNNIPPICLEGVLSLIENIYNDLQRFDRAEFVKNQKEIDILKQRDRKTEFILCVETFNEKAKKGIQMLIEKGFIDSDSNRDIASFLFLNNGRLNKKTIGLLLCDPKKTSLLKEFIDLFDFKGLRVDEAIRILLTKFRLPGESQQIERIVEAFSSKYSADQSNDKVELEDKKAGKNGSESMTEDDIIHVQPDADSVFVLSYSIIMLNTDSHNPQVKDHMTFDDYSNNLRGCYNGKDFPRWYLHKIYTSIKVKEIVMPEEHHGNERWFEDAWNNLISSTSVMTEMQRDFTNPISKLAQIDILQYEKAIFSNVRDIILKTLFKIFTVASSDQISLRILDAISKCTFINYYFSFDQSYNDTVLHLGEMTTLAQSSAKAVELDVDSIPLVEIFVEDTGSKISVSNQSIRLGQNFKAQLCTVLYFQIIKEISDPSIVSTRLWNQIVQLILKLFENLLMEPNLPFFTNFHSLLKLPELPLPDPDISIRKAKMSRSLLSTFASYLKGDEEPSEEDIDFSIKAFECVKASHPLSSVFENNQLVSPKMIETLLSSLVIEKTSENSPYFEQELLFLLEISIILISEASYGQEFGALIADHMINISNLDGLSKEAIARLASYKMFLVSRFDNPRDILSDLIEHDFLVKNEIFNTKYYESEWGKQVINDLFTHLNDVKYNERALKNVKFWNFLRILISAKDRQFAVYTFLEKYIQNGDIFVDDGNFMNILSLLDEMSCAGAVGTKWEQNYENSVEDGCEAPESNPYRSIIDLSSRSINITADLLSTVGRSNSALNKNEIIAAIQGLAHQCLNPCDELGMQALQALENILLSRASQLRTEKVAVDNLLETGLLPIFELDEIQDVKMKRITSILSVLSKIFLGQLVEGVTSNETFLRVLNVFNKYVDDPTVERQLQELIISKREIEKE

SEQ ID NO: 22184 - protein, 1085 aa, Saccharomyces cerevisiae
MEDKEQQDNAKLENNESLKDLGVNVLSQSSLEEKIANDVTNFSNLQSLQQEETRLERSKTALQRYVNKKNHLTRKLNNTTRISVKQNLRDQIKNLQSDDIERVLKDIDDIQSRIKELKEQVDQGAENKGSKEGLQRPGETEKEFLIRTGKITAFGHKAGFSLDTANREYAKNDEQKDEDFEMATEQMVENLTDEDDNLSDQDYQMSGKESEDDEEEENDDKILKELEDLRFRGQPGEAKDDGDELYYQERLKKWVKQRSCGSQRSSDLPEWRRPHPNIPDAKLNSQFKIPGEIYSLLFNYQKTCVQWLYELYQQNCGGIIGDEMGLGKTIQVIAFIAALHHSGLLTGPVLIVCPATVMKQWCNEFQHWWPPLRTVILHSMGSGMASDQKFKMDENDLENLIMNSKPSDFSYEDWKNSTRTKKALESSYHLDKLIDKVVTDGHILITTYVGLRIHSDKLLKVKWQYAVLDEGHKIRNPDSEISLTCKKLKTHNRIILSGTPIQNNLTELWSLFDFIFPGKLGTLPVFQQQFVIPINIGGYANATNIQVQTGYKCAVALRDLISPYLLRRVKADVAKDLPQKKEMVLFCKLTKYQRSKYLEFLHSSDLNQIQNGKRNVLFGIDILRKICNHPDLLDRDTKRHNPDYGDPKRSGKMQVVKQLLLLWHKQGYKALLFTQSRQMLDILEEFISTKDPDLSHLNYLRMDGTTNIKGRQSLVDRFNNESFDVFLLTTRVGGLGVNLTGANRIIIFDPDWNPSTDMQARERAWRIGQKREVSIYRLMVGGSIEEKIYHRQIFKQFLTNRILTDPKQKRFFKIHELHDLFSLGGENGYSTEELNEEVQKHTENLKNSKSEESDDFEQLVNLSGVSKLESFYNGKEKKENSKTEDDRLIEGLLGGESNLETVMSHDSVVNSHAGSSSSNIITKEASRVAIEAVNALRKSRKKITKQYEIGTPTWTGRFGKAGKIRKRDPLKNKLTGSAAILGNITKSQKEASKEARQENYDDGITFARSKEINSNTKTLENIRAYLQKQNNFFSSSVSILNSIGVSLSDKEDVIKVRALLKTIAQFDKERKGWVLDEEFRNNNAS

SEQ ID NO: 22185 - protein, 654 aa, Saccharomyces cerevisiae
MLAAKNILNRSSLSSSFRIATRLQSTKVQGSVIGIDLGTTNSAVAIMEGKVPKIIENAEGSRTTPSVVAFTKEGERLVGIPAKRQAVVNPENTLFATKRLIGRRFEDAEVQRDIKQVPYKIVKHSNGDAWVEARGQTYSPAQIGGFVLNKMKETAEAYLGKPVKNAVVTVPAYFNDSQRQATKDAGQIVGLNVLRVVNEPTAAALAYGLEKSDSKVVAVFDLGGGTFDISILDIDNGVFEVKSTNGDTHLGGEDFDIYLLREIVSRFKTETGIDLENDRMAIQRIREAAEKAKIELSSTVSTEINLPFITADASGPKHINMKFSRAQFETLTAPLVKRTVDPVKKALKDAGLSTSDISEVLLVGGMSRMPKVVETVKSLFGKDPSKAVNPDEAVAIGAAVQGAVLSGEVTDVLLLDVTPLSLGIETLGGVFTRLIPRNTTIPTKKSQIFSTAAAGQTSVEIRVFQGERELVRDNKLIGNFTLAGIPPAPKGVPQIEVTFDIDADGIINVSARDKATNKDSSITVAGSSGLSENEIEQMVNDAEKFKSQDEARKQAIETANKADQLANDTENSLKEFEGKVDKAEAQKVRDQITSLKELVARVQGGEEVNAEELKTKTEELQTSSMKLFEQLYKNDSNNNNNNNGNNAESGETKQ

SEQ ID NO: 22186 - protein, 501 aa, Saccharomyces cerevisiae
MIRSVRRVFIYVSIFVLIIVLKRTLSGTDQTSMKQPVVVIGSGLAGLTTSNRLISKYRIPVVLLDKAASIGGNSIKASSGINGAHTDTQQNLKVMDTPELFLKDTLHSAKGRGVPSLMDKLTKESKSAIRWLQTEFDLKLDLLAQLGGHSVPRTHRSSGKLPPGFEIVQALSKKLKDISSKDSNLVQIMLNSEVVDIELDNQGHVTGVVYMDENGNRKIMKSHHVVFCSGGFGYSKEMLKEYSPNLIHLPTTNGKQTTGDGQKILSKLGAELIDMDQVQVHPTGFIDPNDRENNWKFLAAEALRGLGGILLHPTTGRRFTNELSTRDTVTMEIQSKCPKNDNRALLVMSDKVYENYTNNINFYMSKNLIKKVSINDLIRQYDLQTTASELVTELKSYSDVNTKDTFDRPLIINAFDKDISTESTVYVGEVTPVVHFTMGGVKINEKSQVIKKNSESVLSNGIFAAGEVSGGVHGANRLGGSSLLECVVFGKTAADNIAKLY

SEQ ID NO: 22187 - protein, 565 aa, Saccharomyces cerevisiae
MYRSRNRPKRGGENEVKGPNSALTQFLREEGISAENIKQKWYQRQSKKQEDATDEKKGKAEDDSFTAEISRVVEDEEIDEIGTGSGTETERAQVSYDARMKLVPADSDEEEYETSHISDTPVSLSSANDRESLTKKRQNTAKIIQNRRRKRKRAADLLDRRVNKVSSLQSLCITKISENISKWQKEADESSKLVFNKLRDVLGGVSTANLNNLAKALSKNRALNDHTLQLFLKTDLKRLTFSDCSKISFDGYKTLAIFSPHLTELSLQMCGQLNHESLLYIAEKLPNLKSLNLDGPFLINEDTWEKFFVIMKGRLEEFHISNTHRFTDKSLSNLLINCGSTLVSLGLSRLDSISNYALLPQYLVNDEFHSLCIEYPFNEEDVNDEIIINLLGQIGRTLRKLVLNGCIDLTDSMIINGLTAFIPEKCPLEVLSLEESDQITTDSLSYFFSKVELNNLIECSFRRCLQLGDMAIIELLLNGARDSLRSLNLNSLKELTKEAFVALACPNLTYLDLGFVRCVDDSVIQMLGEQNPNLTVIDVFGDNLVTEKATMRPGLTLIGRQSDSI

SEQ ID NO: 22188 - protein, 216 aa, Saccharomyces cerevisiae
MMGRGKLILIEGLDRTGKTTQCNILYKKLQPNCKLLKFPERSTRIGGLINEYLTDDSFQLSDQAIHLLFSANRWEIVDKIKKDLLEGKNIVMDRYVYSGVAYSAAKGTNGMDLDWCLQPDVGLLKPDLTLFLSTQDVDNNAEKSGFGDERYETVKFQEKVKQTFMKLLDKEIRKGDESITIVDVTNKGIQEVEALIWQIVEPVLSTHIDHDKFSFF

SEQ ID NO: 22189 - protein, 562 aa, Saccharomyces cerevisiae
MAARPQQPPMEMPDLSNAIVAQDEMGRPFIIVKDQGNKKRQHGLEAKKSHILAARSVASIIKTSLGPRGLDKILISPDGEITITNDGATILSQMELDNEIAKLLVQLSKSQDDEIGDGTTGVVVLASALLDQALELIQKGIHPIKIANGFDEAAKLAISKLEETCDDISASNDELFRDFLLRAAKTSLGSKIVSKDHDRFAEMAVEAVINVMDKDRKDVDFDLIKMQGRVGGSISDSKLINGVILDKDFSHPQMPKCVLPKEGSDGVKLAILTCPFEPPKPKTKHKLDISSVEEYQKLQTYEQDKFKEMIDDVKKAGADVVICQWGFDDEANHLLLQNDLPAVRWVGGQELEHIAISTNGRIVPRFQDLSKDKLGTCSRIYEQEFGTTKDRMLIIEQSKETKTVTCFVRGSNKMIVDEAERALHDSLCVVRNLVKDSRVVYGGGAAEVTMSLAVSEEADKQRGIDQYAFRGFAQALDTIPMTLAENSGLDPIGTLSTLKSKQLKEKISNIGVDCLGYGSNDMKELFVVDPFIGKKQQILLATQLCRMILKIDNVIISGKDEY

SEQ ID NO: 22190 - protein, 449 aa, Saccharomyces cerevisiae
MSYLNNPAVVMDNGTGLTKLGFAGNDSPSWVFPTAIATAAPSNTKKSSGVGAPSAVSNEASYFGNSTSATNFNGATGGLLSNNLSGKRGTEDLDFYIGNEALVASQGPSYSLSYPIRHGQVENWDHMERFWENSIFKYLRTEPEDHFFLLTEPPLNPPENREQVAEIFFESFNCAGLYIAVQAVLALAASWTSSKVTDRSLTGTVIDSGDGVTHVIPVAEGYVIGSAIKNIPIAGRDITLFIQSLLRERGEADTSLRTAEKIKQEYCYVCPDIVKEFNKFDKDPSKFAQFVVENQEKTRRKVVDIGYERFLAPEIFFNPEIASSDFLTPLPTVVDQTIQACPIDVRKGLYNNIVLSGGSTMFKDFGRRLQRDLKSIVNNRIAQSELLSGTKSTGVDVSVISHRKQRNAVWFGGSLLAQTAEFKGYCHTKKDYEEYGPEIVRNFSLFNMV

SEQ ID NO: 22191 - protein, 2470 aa, Saccharomyces cerevisiae
MEPHEEQIWKSKLLKAANNDMDMDRNVPLAPNLNVNMNMKMNASRNGDEFGLTSSRFDGVVIGSNGDVNFKPILEKIFRELTSDYKEERKLASISLFDLLVSLEHELSIEEFQAVSNDINNKILELVHTKKTSTRVGAVLSIDTLISFYAYTERLPNETSRLAGYLRGLIPSNDVEVMRLAAKTLGKLAVPGGTYTSDFVEFEIKSCLEWLTASTEKNSFSSSKPDHAKHAALLIITALAENCPYLLYQYLNSILDNIWRALRDPHLVIRIDASITLAKCLSTLRNRDPQLTSQWVQRLATSCEYGFQVNTLECIHASLLVYKEILFLKDPFLNQVFDQMCLNCIAYENHKAKMIREKIYQIVPLLASFNPQLFAGKYLHQIMDNYLEILTNAPANKIPHLKDDKPQILISIGDIAYEVGPDIAPYVKQILDYIEHDLQTKFKFRKKFENEIFYCIGRLAVPLGPVLGKLLNRNILDLMFKCPLSDYMQETFQILTERIPSLGPKINDELLNLVCSTLSGTPFIQPGSPMEIPSFSRERAREWRNKNILQKTGESNDDNNDIKIIIQAFRMLKNIKSRFSLVEFVRIVALSYIEHTDPRVRKLAALTSCEIYVKDNICKQTSLHSLNTVSEVLSKLLAITIADPLQDIRLEVLKNLNPCFDPQLAQPDNLRLLFTALHDESFNIQSVAMELVGRLSSVNPAYVIPSIRKILLELLTKLKFSTSSREKEETASLLCTLIRSSKDVAKPYIEPLLNVLLPKFQDTSSTVASTALRTIGELSVVGGEDMKIYLKDLFPLIIKTFQDQSNSFKREAALKALGQLAASSGYVIDPLLDYPELLGILVNILKTENSQNIRRQTVTLIGILGAIDPYRQKEREVTSTTDISTEQNAPPIDIALLMQGMSPSNDEYYTTVVIHCLLKILKDPSLSSYHTAVIQAIMHIFQTLGLKCVSFLDQIIPTILDVMRTCSQSLLEFYFQQLCSLIIIVRQHIRPHVDSIFQAIKDFSSVAKLQITLVSVIEAISKALEGEFKRLVPLTLTLFLVILENDKSSDKVLSRRVLRLLESFGPNLEGYSHLITPKIVQMAEFTSGNLQRSAIITIGKLAKDVDLFEMSSRIVHSLLRVLSSTTSDELSKVIMNTLSLLLIQMGTSFAIFIPVINEVLMKKHIQHTIYDDLTNRILNNDVLPTKILEANTTDYKPAEQMEAADAGVAKLPINQSVLKSAWNSSQQRTKEDWQEWSKRLSIQLLKESPSHALRACSNLASMYYPLAKELFNTAFACVWTELYSQYQEDLIGSLCIALSSPLNPPEIHQTLLNLVEFMEHDDKALPIPTQSLGEYAERCHAYAKALHYKEIKFIKEPENSTIESLISINNQLNQTDAAIGILKHAQQHHSLQLKETWFEKLERWEDALHAYNEREKAGDTSVSVTLGKMRSLHALGEWEQLSQLAARKWKVSKLQTKKLIAPLAAGAAWGLGEWDMLEQYISVMKPKSPDKEFFDAILYLHKNDYDNASKHILNARDLLVTEISALINESYNRAYSVIVRTQIITEFEEIIKYKQLPPNSEKKLHYQNLWTKRLLGCQKNVDLWQRVLRVRSLVIKPKQDLQIWIKFANLCRKSGRMRLANKALNMLLEGGNDPSLPNTFKAPPPVVYAQLKYIWATGAYKEALNHLIGFTSRLAHDLGLDPNNMIAQSVKLSSASTAPYVEEYTKLLARCFLKQGEWRIATQPNWRNTNPDAILGSYLLATHFDKNWYKAWHNWALANFEVISMVQEETKLNGGKNDDDDDTAVNNDNVRIDGSILGSGSLTINGNRYPLELIQRHVVPAIKGFFHSISLLETSCLQDTLRLLTLLFNFGGIKEVSQAMYEGFNLMKIENWLEVLPQLISRIHQPDPTVSNSLLSLLSDLGKAHPQALVYPLTVAIKSESVSRQKAALSIIEKIRIHSPVLVNQAELVSHELIRVAVLWHELWYEGLEDASRQFFVEHNIEKMFSTLEPLHKHLGNEPQTLSEVSFQKSFGRDLNDAYEWLNNYKKSKDINNLNQAWDIYYNVFRKITRQIPQLQTLDLQHVSPQLLATHDLELAVPGTYFPGKPTIRIAKFEPLFSVISSKQRPRKFSIKGSDGKDYKYVLKGHEDIRQDSLVMQLFGLVNTLLKNDSECFKRHLDIQQYPAIPLSPKSGLLGWVPNSDTFHVLIREHRDAKKIPLNIEHWVMLQMAPDYENLTLLQKIEVFTYALDNTKGQDLYKILWLKSRSSETWLERRTTYTRSLAVMSMTGYILGLGDRHPSNLMLDRITGKVIHIDFGDCFEAAILREKYPEKVPFRLTRMLTYAMEVSGIEGSFRITCENVMRVLRDNKESLMAILEAFALDPLIHWGFDLPPQKLTEQTGIPLPLINPSELLRKGAITVEEAANMEAEQQNETKNARAMLVLRRITDKLTGNDIKRFNELDVPEQVDKLIQQATSIERLCQHYIGWCPFW

SEQ ID NO: 22192 - protein, 353 aa, Saccharomyces cerevisiae
MFEGFGPNKKRKISKLAAEQSLAQQPWVEKYRPKNLDEVTAQDHAVTVLKKTLKSANLPHMLFYGPPGTGKTSTILALTKELYGPDLMKSRILELNASDERGISIVREKVKNFARLTVSKPSKHDLENYPCPPYKIIILDEADSMTADAQSALRRTMETYSGVTRFCLICNYVTRIIDPLASRCSKFRFKALDASNAIDRLRFISEQENVKCDDGVLERILDISAGDLRRGITLLQSASKGAQYLGDGKNITSTQVEELAGVVPHDILIEIVEKVKSGDFDEIKKYVNTFMKSGWSAASVVNQLHEYYITNDNFDTNFKNQISWLLFTTDSRLNNGTNEHIQLLNLLVKISQL

SEQ ID NO: 22193 - protein, 206 aa, Saccharomyces cerevisiae
MKESVQEIIQQLIHSVDLQSSKFQLAIVCTMFNPIFWNIVARMEYHKHSLTKMCGGARKGCYMLAATIFSLGIVRDMVYESALREQPTCSLITGENWTKLGVALFGLGQVLVLSSMYKLGITGTYLGDYFGILMDERVTGFPFNVSNNPMYQGSTLSFLGIALYKGKPAGLVVSAVVYFMYKIALRWEEPFTAMIYANRDKAKKNM

SEQ ID NO: 22194 - protein, 396 aa, Saccharomyces cerevisiae
MAKTTKRASSFRRLMIFAIIALISLAFGVRYLFHNSNATDLQKILQNLPKEISQSINSANNIQSSDSDLVQHFESLAQEIRHQQEVQAKQFDKQRKILEKKIQDLKQTPPEATLRERIAMTFPYDSHVKFPAFIWQTWSNDEGPERVQDIKGMWESKNPGFAHEVLNHDVINALVHHYFYSIPEILETYEALPSIILKIDFFKYLILLVHGGVYADIDTFPVQPIPNWIPEELSPSDIGLIVGVEEDAQRADWRTKYIRRLQFGTWIIQAKPGHPVLREIISRIIETTLQRKRDDQLNVNLRNDLNIMSWTGSGLWTDTIFTYFNDFMRSGVREKVTWKLFHNLNQPKLLSDVLVFPKFSFNCPNQIDNDDPHKKFYFITHLASQFWKNTPKVEQK

SEQ ID NO: 22195 - protein, 415 aa, Saccharomyces cerevisiae
MSGIIDASSALRKRKHLKRGITFTVMIVGQSGSGRSTFINTLCGQQVVDTSTTILLPTDTSTEIDLQLREETVELEDDEGVKIQLNIIDTPGFGDSLDNSPSFEIISDYIRHQYDEILLEESRVRRNPRFKDGRVHCCLYLINPTGHGLKEIDVEFIRQLGSLVNIIPVISKSDSLTRDELKLNKKLIMEDIDRWNLPIYNFPFDEDEISDEDYETNMYLRTLLPFAIIGSNEVYEMGGDVGTIRGRKYPWGILDVEDSSISDFVILRNALLISHLHDLKNYTHEILYERYRTEALSGESVAAESIRPNLTKLNGSSSSSTTTRRNTNPFKQSNNINNDVLNPASDMHGQSTGENNETYMTREEQIRLEEERLKAFEERVQQELLLKRQELLQREKELREIEARLEKEAKIKQEE

SEQ ID NO: 22196 - protein, 311 aa, Saccharomyces cerevisiae
MSVSAAPAIPQYSVSDYMKFALAGAIGCGSTHSSMVPIDVVKTRIQLEPTVYNKGMVGSFKQIIAGEGAGALLTGFGPTLLGYSIQGAFKFGGYEVFKKFFIDNLGYDTASRYKNSVYMGSAAMAEFLADIALCPLEATRIRLVSQPQFANGLVGGFSRILKEEGIGSFYSGFTPILFKQIPYNIAKFLVFERASEFYYGFAGPKEKLSSTSTTLLNLLSGLTAGLAAAIVSQPADTLLSKVNKTKKAPGQSTVGLLAQLAKQLGFFGSFAGLPTRLVMVGTLTSLQFGIYGSLKSTLGCPPTIEIGGGGH

SEQ ID NO: 22197 - protein, 453 aa, Saccharomyces cerevisiae
MNNTSITGPQVLHRTKMRPLPVLEKYCISPHHGFLDDRLPLTRLSSKKYMKWEEIVADLPSLLQEDNKVRSVIDGLDVLDLDETILGDVRELRRAYSILGFMAHAYIWASGTPRDVLPECIARPLLETAHILGVPPLATYSSLVLWNFKVTDECKKTETGCLDLENITTINTFTGTVDESWFYLVSVRFEKIGSACLNHGLQILRAIRSGDKGDANVIDGLEGLAATIERLSKALMEMELKCEPNVFYFKIRPFLAGWTNMSHMGLPQGVRYGAEGQYRIFSGGSNAQSSLIQTLDILLGVKHTANAAHSSQGDSKINYLDEMKKYMPREHREFLYHLESVCNIREYVSRNASNRALQEAYGRCISMLKIFRDNHIQIVTKYIILPSNSKQHGSNKPNVLSPIEPNTKASGCLGHKVASSKTIGTGGTRLMPFLKQCRDETVATADIKNEDKN

SEQ ID NO: 22198 - protein, 110 aa, Saccharomyces cerevisiae
MTSVQNSPRLQQPQEQQQQQQQLSLKIKQLKLKRINELNNKLRKELSRERITASNACLTIINYTSNTKDYTLPELWGYPVAGSNHFIEGLKNAQKNSQMSNSNSVCCTLM

SEQ ID NO: 22199 - protein, 1151 aa, Saccharomyces cerevisiae
MDQDNNNHNDSNRLHPPDIHPNLGPQLWLNSSGDFDDNNNNNNNNNNNNSTRPQMPSRTRETATSERNASEVRDATLNNIFRFDSIQRETLLPTNNGQPLNQNFSLTFQPQQQTNALNGIDINTVNTNLMNGVNVQIDQLNRLLPNLPEEERKQIHEFKLIVGKKIQEFLVVIEKRRKKILNEIELDNLKLKELRIDNSPQAISYLHKLQRMRLRALETENMEIRNLRLKILTIIEEYKKSLYAYCHSKLRGQQVENPTDNFIIWINSIDTTESSDLKEGLQDLSRYSRQFINNVLSNPSNQNICTSVTRRSPVFALNMLPSEILHLILDKLNQKYDIVKFLTVSKLWAEIIVKILYYRPHINKKSQLDLFLRTMKLTSEETVFNYRLMIKRLNFSFVGDYMHDTELNYFVGCKNLERLTLVFCKHITSVPISAVLRGCKFLQSVDITGIRDVSDDVFDTLATYCPRVQGFYVPQARNVTFDSLRNFIVHSPMLKRIKITANNNMNDELVELLANKCPLLVEVDITLSPNVTDSSLLKLLTRLVQLREFRITHNTNITDNLFQELSKVVDDMPSLRLIDLSGCENITDKTIESIVNLAPKLRNVFLGKCSRITDASLFQLSKLGKNLQTVHFGHCFNITDNGVRALFHSCTRIQYVDFACCTNLTNRTLYELADLPKLKRIGLVKCTQMTDEGLLNMVSLRGRNDTLERVHLSYCSNLTIYPIYELLMSCPRLSHLSLTAVPSFLRPDITMYCRPAPSDFSENQRQIFCVFSGKGVHKLRHYLVNLTSPAFGPHVDVNDVLTKYIRSKNLIFNGETLEDALRRIITDLNQDSAAIIAATGLNQINGLNNDFLFQNINFERIDEVFSWYLNTFDGIRMSSEEVNSLLLQVNKTFCEDPFSDVDDDQDYVVAPGVNREINSEMCHIVRKFHELNDHIDDFEVNVASLVRVQFQFTGFLLHEMTQTYMQMIELNRQICLVQKTVQESGNIDYQKGLLIWRLLFIDKFIMVVQKYKLSTVVLRLYLKDNITLLTRQRELLIAHQRSAWNNNNDNDANRNANNIVNIVSDAGANDTSNNETNNGNDDNETENPNFWRQFGNRMQISPDQMRNLQMGLRNQNMVRNNNNNTIDESMPDTAIDSQMDEASGTPDEDML

SEQ ID NO: 22200 - protein, 322 aa, Saccharomyces cerevisiae
MSQKKKASHPAINLMAGGTAGLFEALCCHPLDTIKVRMQIYRRVAGIEHVKPPGFIKTGRTIYQKEGFLALYKGLGAVVIGIIPKMAIRFSSYEFYRTLLVNKESGIVSTGNTFVAGVGAGITEAVLVVNPMEVVKIRLQAQHLTPSEPNAGPKYNNAIHAAYTIVKEEGVSALYRGVSLTAARQATNQGANFTVYSKLKEFLQNYHQMDVLPSWETSCIGLISGAIGPFSNAPLDTIKTRLQKDKSISLEKQSGMKKIITIGAQLLKEEGFRALYKGITPRVMRVAPGQAVTFTVYEYVREHLENLGIFKKNDTPKPKPLK

SEQ ID NO: 22201 - protein, 282 aa, Saccharomyces cerevisiae
MVPKFYKLSNGFKIPSIALGTYDIPRSQTAEIVYEGVKCGYRHFDTAVLYGNEKEVGDGIIKWLNEDPGNHKREEIFYTTKLWNSQNGYKRAKAAIRQCLNEVSGLQYIDLLLIHSPLEGSKLRLETWRAMQEAVDEGLVKSIGVSNYGKKHIDELLNWPELKHKPVVNQIEISPWIMRQELADYCKSKGLVVEAFAPLCHGYKMTNPDLLKVCKEVDRNPGQVLIRWSLQHGYLPLPKTKTVKRLEGNLAAYNFELSDEQMKFLDHPDAYEPTDWECTDAP

SEQ ID NO: 22202 - protein, 236 aa, Saccharomyces cerevisiae
MSGENRAVVPIESNPEVFTNFAHKLGLKNEWAYFDIYSLTEPELLAFLPRPVKAIVLLFPINEDRKSSTSQQITSSYDVIWFKQSVKNACGLYAILHSLSNNQSLLEPGSDLDNFLKSQSDTSSSKNRFDDVTTDQFVLNVIKENVQTFSTGQSEAPEATADTNLHYITYVEENGGIFELDGRNLSGPLYLGKSDPTATDLIEQELVRVRVASYMENANEEDVLNFAMLGLGPNWE

SEQ ID NO: 22203 - protein, 340 aa, Saccharomyces cerevisiae
MTAPLVVLGNPLLDFQADVTAEYLAKYSLKENDAILVDAKSGDAKMAIFDELLQMPETKLVAGGAAQNTARGAAYVLGAGQVVYFGSVGKDKFSERLLNENEKAGVKSMYQVQNDIGTGKCAALITGHNRSLVTDLGAANFFTPDHLDKHWDLVEAAKLFYIGGFHLTVSPDAIVKLGQHAKENSKPFVLNFSAPFIPHVFKDALARVLPYATVIIANESEAEAFCDAFQLDCANTDLEAIAQRIVKDSPVEKTVIFTHGVEPTVVVSSKGTSTYPVKPLDSSKIVDTNGAGDAFAGGFMAGLTKGEDLETSIDMGQWLAALSIQEVGPSYPSEKISYSK

SEQ ID NO: 22204 - protein, 1118 aa, Saccharomyces cerevisiae [sequence omitted]

SEQ ID NO: 22205 - protein, 511 aa, Saccharomyces cerevisiae
MVLPRLYTATSRAAFKAAKQSAPLLSTSWKRCMASAAQSTPITGKVTAVIGAIVDVHFEQSELPAILNALEIKTPQGKLVLEVAQHLGENTVRTIAMDGTEGLVRGEKVLDTGGPISVPVGRETLGRIINVIGEPIDERGPIKSKLRKPIHADPPSFAEQSTSAEILETGIKVVDLLAPYARGGKIGLFGGAGVGKTVFIQELINNIAKAHGGFSVFTGVGERTREGNDLYREMKETGVINLEGESKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVASKVQETLQTYKSLQDIIAILGMDELSEQDKLTVERARKIQRFLSQPFAVAEVFTGIPGKLVRLKDTVASFKAVLEGKYDNIPEHAFYMVGGIEDVVAKAEKLAAEAN

SEQ ID NO: 22206 - protein, 549 aa, Saccharomyces cerevisiae
MKNSVGISIATIVAIIAAIYYVPWYEHFERKSPGAGEMRDRIESMFLESWRDYSKHGWGYDVYGPIEHTSHNMPRGNQPLGWIIVDSVDTLMLMYNSSTLYKSEFEAEIQRSEHWINDVLDFDIDAEVNVFETTIRMLGGLLSAYHLSDVLEVGNKTVYLNKAIDLGDRLALAFLSTQTGIPYSSINLHSGQAVKNHADGGASSTAEFTTLQMEFKYLAYLTGNRTYWELVERVYEPLYKNNDLLNTYDGLVPIYTFPDTGKFGASTIRFGSRGDSFYEYLLKQYLLTHETLYYDLYRKSMEGMKKHLLAQSKPSSLWYIGEREQGLHGQLSPKMDHLVCFMGGLLASGSTEGLSIHEARRRPFFSLSLERKSDWDLAKGITDTCYQMYKQSSSGLAPEIVVFNDGNIKQDGWWRSSVGDFFVKPLDRHNLQRPETVESIMFMYHLSHDHKYREWGAEIATSFFENTCVDCNDPKLRRFTSLSDCITLPTKKSNNMESFWLAETLKYLYILFLDEFDLTKVVFNTEAHPFPVLDEEILKSQSLTTGWSL

SEQ ID NO: 22207 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 22208 - protein, 359 aa, Saccharomyces cerevisiae
MSTKVVNVAVIGAGVVGSAFLDQLLAMKSTITYNLVLLAEAERSLISKDFSPLNVGSDWKAALAASTTKTLPLDDLIAHLKTSPKPVILVDNTSSAYIAGFYTKFVENGISIATPNKKAFSSDLATWKALFSNKPTNGFVYHEATVGAGLPIISFLREIIQTGDEVEKIEGIFSGTLSYIFNEFSTSQANDVKFSDVVKVAKKLGYTEPDPRDDLNGLDVARKVTIVGRISGVEVESPTSFPVQSLIPKPLESVKSADEFLEKLSDYDKDLTQLKKEAATENKVLRFIGKVDVATKSVSVGIEKYDYSHPFASLKGSDNVISIKTKRYTNPVVIQGAGAGAAVTAAGVLGDVIKIAQRL

SEQ ID NO: 22209 - protein, 361 aa, Saccharomyces cerevisiae
MISANSLLISTLCAFAIATPLSKRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVTNVNFISNKISGIKSYGIVIEGDYLNSKTTGTATGGVPISNLVMKDITGSVNSTAKRVKILVKNATNWQWSGVSITGGSSYSGCSGIPSGSGASC

SEQ ID NO: 22210 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKIDKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEETQLLYEEGIKPWKSASWVPPSRRGASSRETEAKKKSWKEVLKFPKSFN

SEQ ID NO: 22211 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGRYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 22212 - protein, 602 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPPKDVSHNDPKGDIEASIAEE

SEQ ID NO: 22213 - protein, 473 aa, Saccharomyces cerevisiae
MSEERHEDHHRDVENKLNLNGKDDINGNTSISIEVPDGGYGWFILLAFILYNFSTWGANSGYAIYLAHYLENNTFAGGSKLDYASIGGLAFSCGLFFAPVITWLYHIFSIQFIIGLGILFQGAALLLAAFSVTLWEIYLTQGVLIGFGLAFIFIPSVTLIPLWFRNKRSLASGIGTAGSGLGGIVFNLGMQSILQKRGVKWALIAQCIICTSLSTIALMLTRTTHQGLRQHKRSYKFELLDYDVLSNFAVWLLFGFVSFAMLGYVVLLYSLSDFTVSLGYTSKQGSYVSCMVSVGSLLGRPIVGHIADKYGSLTVGMILHLVMAILCWAMWIPCKNLATAIRFGLLVGSIMGTIWPTIASIVTRIVGLQKLPGTFGSTWIFMAAFALVAPIIGLELRSTDTNGNDYYRTAIFVGFAYFGVSLCQWLLRGFIIARDEIAVREAYSADQNELHLNVKLSHMSKCLFRYKQLPRRV

SEQ ID NO: 22214 - protein, 314 aa, Saccharomyces cerevisiae
MTASLTTKFLNNTYENPFMNASGVHCMTTQELDELANSKAGAFITKSATTLEREGNPEPRYISVPLGSINSMGLPNEGIDYYLSYVLNRQKNYPDAPAIFFSVAGMSIDENLNLLRKIQDSEFNGITELNLSCPNVPGKPQVAYDFDLTKETLEKVFAFFKKPLGVKLPPYFDFAHFDIMAKILNEFPLAYVNSINSIGNGLFIDVEKESVVVKPKNGFGGIGGEYVKPTALANVRAFYTRLRPEIKVIGTGGIKSGKDAFEHLLCGASMLQIGTELQKEGVKIFERIEKELKDIMEAKGYTSIDQFRGKLNSI

SEQ ID NO: 22215 - protein, 715 aa, Saccharomyces cerevisiae
MGYQLSATLKGHDQDVRDVVAVDDSKVASVSRDGTVRLWSKDDQWLGTVVYTGQGFLNSVCYDSEKELLLFGGKDTMINGVPLFATSGEDPLYTLIGHQGNVCSLSFQDGVVISGSWDKTAKVWKEGSLVYNLQAHNASVWDAKVVSFSENKFLTASADKTIKLWQNDKVIKTFSGIHNDVVRHLAVVDDGHFISCSNDGLIKLVDMHTGDVLRTYEGHESFVYCIKLLPNGDIVSCGEDRTVRIWSKENGSLKQVITLPAISIWSVDCMSNGDIIVGSSDNLVRIFSQEKSRWASEDEINELSTQVEKSTISSKTIEFDESKLSPYEILQSPGRKEGQIVVVKSPQGTIEAHQFSNSSWKKVGDVVGAGATGNDKKIEFEGKTYDYVFDVDIEDGKPPLKLPINVSDNPYTAADNFLARYELPMSYRDQVVQFILKNTNGISLDQPNDNASSSAVSPSKTSVMKVLPVKQYLIMENYNPDTIFNGIVKINSNEKTFDDEILAQIGGALHDIDESWELLLSFANTIRSNWEIKTPAYDIVRLIVKKLPYSSDIKDYIEEGLGNKNITLTMLTVRILVNCFNNENWGVKLLESNQVYKSIFETIDTEFSQASAKQSQNLAIAVSTLIFNYSALVTKGNSDLELLPIVADAINTKYGPLEEYQECEEAAYRLTVAYGNLATVEPTLRQFANSVTWLANIKRSYGNVPRFKDIFDDLS

SEQ ID NO: 22216 - protein, 1290 aa, Saccharomyces cerevisiae
MNFLSFKTTKHYHIFRYVNIRNDYRLLMIMIIGTVATGLVPAITSILTGRVFDLLSVFVANGSHQGLYSQLVQRSMAVMALGAASVPVMWLSLTSWMHIGERQGFRIRSQILEAYLEEKPMEWYDNNEKLLGDFTQINRCVEELRSSSAEASAITFQNLVAICALLGTSFYYSWSLTLIILCSSPIITFFAVVFSRMIHVYSEKENSETSKAAQLLTWSMNAAQLVRLYCTQRLERKKFKEIILNCNTFFIKSCFFVAANAGILRFLTLTMFVQGFWFGSAMIKKGKLNINDVITCFHSCIMLGSTLNNTLHQIVVLQKGGVAMEKIMTLLKDGSKRNPLNKTVAHQFPLDYATSDLTFANVSFSYPSRPSEAVLKNVSLNFSAGQFTFIVGKSGSGKSTLSNLLLRFYDGYNGSISINGHNIQTIDQKLLIENITVVEQRCTLFNDTLRKNILLGSTDSVRNADCSTNENRHLIKDACQMALLDRFILDLPDGLETLIGTGGVTLSGGQQQRVAIARAFIRDTPILFLDEAVSALDIVHRNLLMKAIRHWRKGKTTIILTHELSQIESDDYLYLMKEGEVVESGTQSELLADPTTTFSTWYHLQNDYSDAKTIVDTETEEKSIHTVESFNSQLETPKLGSCLSNLGYDETDQLSFYEAIYQKRSNVRTRRVKVEEENIGYALKQQKNTESSTGPQLLSIIQIIKRMIKSIRYKKILILGLLCSLIAGATNPVFSYTFSFLLEGIVPSTDGKTGSSHYLAKWSLLVLGVAAADGIFNFAKGFLLDCCSEYWVMDLRNEVMEKLTRKNMDWFSGENNKASEISALVLNDLRDLRSLVSEFLSAMTSFVTVSTIGLIWALVSGWKLSLVCISMFPLIIIFSAIYGGILQKCETDYKTSVAQLENCLYQIVTNIKTIKCLQAEFHFQLTYHDLKIKMQQIASKRAIATGFGISMTNMIVMCIQAIIYYYGLKLVMIHEYTSKEMFTTFTLLLFTIMSCTSLVSQIPDISRGQRAASWIYRILDEKHNTLEVENNNARTVGIAGHTYHGKEKKPIVSIQNLTFAYPSAPTAFVYKNMNFDMFCGQTLGIIGESGTGKSTLVLLLTKLYNCEVGKIKIDGTDVNDWNLTSLRKEISVVEQKPLLFNGTIRDNLTYGLQDEILEIEMYDALKYVGIHDFVISSPQGLDTRIDTTLLSGGQAQRLCIARALLRKSKILILDECTSALDSVSSSIINEIVKKGPPALLTMVITHSEQMMRSCNSIAVLKDGKVVERGNFDTLYNNRGELFQIVSNQSS

SEQ ID NO: 22217 - protein, 2473 aa, Saccharomyces cerevisiae
MNKYINKYTTPPNLLSLRQRAEGKHRTRKKLTHKSHSHDDEMSTTSNTDSNHNGPNDSGRVITGSAGHIGKISFVDSELDTTFSTLNLIFDKLKSDVPQERASGANELSTTLTSLAREVSAEQFQRFSNSLNNKIFELIHGFTSSEKIGGILAVDTLISFYLSTEELPNQTSRLANYLRVLIPSSDIEVMRLAANTLGRLTVPGGTLTSDFVEFEVRTCIDWLTLTADNNSSSSKLEYRRHAALLIIKALADNSPYLLYPYVNSILDNIWVPLRDAKLIIRLDAAVALGKCLTIIQDRDPALGKQWFQRLFQGCTHGLSLNTNDSVHATLLVFRELLSLKAPYLRDKYDDIYKSTMKYKEYKFDVIRREVYAILPLLAAFDPAIFTKKYLDRIMVHYLRYLKNIDMNAANNSDKPFILVSIGDIAFEVGSSISPYMTLILDNIREGLRTKFKVRKQFEKDLFYCIGKLACALGPAFAKHLNKDLLNLMLNCPMSDHMQETLMILNEKIPSLESTVNSRILNLLSISLSGEKFIQSNQYDFNNQFSIEKARKSRNQSFMKKTGESNDDITDAQILIQCFKMLQLIHHQYSLTEFVRLITISYIEHEDSSVRKLAALTSCDLFIKDDICKQTSVHALHSVSEVLSKLLMIAITDPVAEIRLEILQHLGSNFDPQLAQPDNLRLLFMALNDEIFGIQLEAIKIIGRLSSVNPAYVVPSLRKTLLELLTQLKFSNMPKKKEESATLLCTLINSSDEVAKPYIDPILDVILPKCQDASSAVASTALKVLGELSVVGGKEMTRYLKELMPLIINTFQDQSNSFKRDAALTTLGQLAASSGYVVGPLLDYPELLGILINILKTENNPHIRRGTVRLIGILGALDPYKHREIEVTSNSKSSVEQNAPSIDIALLMQGVSPSNDEYYPTVVIHNLMKILNDPSLSIHHTAAIQAIMHIFQNLGLRCVSFLDQIIPGIILVMRSCPPSQLDFYFQQLGSLISIVKQHIRPHVEKIYGVIREFFPIIKLQITIISVIESISKALEGEFKRFVPETLTFFLDILENDQSNKRIVPIRILKSLVTFGPNLEDYSHLIMPIVVRMTEYSAGSLKKISIITLGRLAKNINLSEMSSRIVQALVRILNNGDRELTKATMNTLSLLLLQLGTDFVVFVPVINKALLRNRIQHSVYDQLVNKLLNNECLPTNIIFDKENEVPERKNYEDEMQVTKLPVNQNILKNAWYCSQQKTKEDWQEWIRRLSIQLLKESPSACLRSCSSLVSVYYPLARELFNASFSSCWVELQTSYQEDLIQALCKALSSSENPPEIYQMLLNLVEFMEHDDKPLPIPIHTLGKYAQKCHAFAKALHYKEVEFLEEPKNSTIEALISINNQLHQTDSAIGILKHAQQHNELQLKETWYEKLQRWEDALAAYNEKEAAGEDSVEVMMGKLRSLYALGEWEELSKLASEKWGTAKPEVKKAMAPLAAAAWGLEQWDEIAQYTSVMKSQSPDKEFYDAILCLHRNNFKKAEVHIFNARDLLVTELSALVNESYNRAYNVVVRAQIIAELEEIIKYKKLPQNSDKRLTMRETWNTRLLGCQKNIDVWQRILRVRSLVIKPKEDAQVRIKFANLCRKSGRMALAKKVLNTLLEETDDPDHPNTAKASPPVVYAQLKYLWATGLQDEALKQLINFTSRMAHDLGLDPNNMIAQSVPQQSKRVPRHVEDYTKLLARCFLKQGEWRVCLQPKWRLSNPDSILGSYLLATHFDNTWYKAWHNWALANFEVISMLTSVSKKKQEGSDASSVTDINEFDNGMIGVNTFDAKEVHYSSNLIHRHVIPAIKGFFHSISLSESSSLQDALRLLTLWFTFGGIPEATQAMHEGFNLIQIGTWLEVLPQLISRIHQPNQIVSRSLLSLLSDLGKAHPQALVYPLMVAIKSESLSRQKAALSIIEKMRIHSPVLVDQAELVSHELIRMAVLWHEQWYEGLDDASRQFFGEHNTEKMFAALEPLYEMLKRGPETLREISFQNSFGRDLNDAYEWLMNYKKSKDVSNLNQAWDIYYNVFRKIGKQLPQLQTLELQHVSPKLLSAHDLELAVPGTRASGGKPIVKISKFEPVFSVISSKQRPRKFCIKGSDGKDYKYVLKGHEDIRQDSLVMQLFGLVNTLLQNDAECFRRHLDIQQYPAIPLSPKSGLLGWVPNSDTFHVLIREHREAKKIPLNIEHWVMLQMAPDYDNLTLLQKVEVFTYALNNTEGQDLYKVLWLKSRSSETWLERRTTYTRSLAVMSMTGYILGLGDRHPSNLMLDRITGKVIHIDFGDCFEAAILREKFPEKVPFRLTRMLTYAMEVSGIEGSFRITCENVMKVLRDNKGSLMAILEAFAFDPLINWGFDLPTKKIEEETGIQLPVMNANELLSNGAITEEEVQRVENEHKNAIRNARAMLVLKRITDKLTGNDIRRFNDLDVPEQVDKLIQQATSVENLCQHYIGWCPFW

SEQ ID NO: 22218 - protein, 1043 aa, Saccharomyces cerevisiae
MTTTKRLKFENLRIQFSNAIVGNFLRLPHSIINVLESTNYAIQEFGIAVHSHNSDIPIVHLGWDGHDSGSSENVVLINPVLATVYDLNQKSPLVDLYIQRYDHTHLATEVYVTPETSDDWEIIDANAMRFQNGEILHQTRIVTPGETLICYLEGIVTKFKIDRVEPSMKSARITDGSLVVVAPKVNKTRLVKAEYGHSNKTILKNGAIQLLKKVILRSTVCKMDFPKDNLFVVYISDGAQLPSQKGYASIVKCSLRQSKKSDSDNKSVGIPSKKIGVFIKCDSQIPENHIALSSHLWDAFFTHPMNGAKIKLEFLQMNQANIISGRNATVNIKYFGKDVPTKSGDQYSKLLGGSLLTNNLILPTEQIIIEIKKGESEQQLCNLNEISNESVQWKVTQMGKEEVKDIIERHLPKHYHVKETGEVSRTSKDEDDFITVNSIKKEMVNYLTSPIIATPAIILDGKQGIGKTRLLKELINEVEKDHHIFVKYADCETLHETSNLDKTQKLIMEWCSFCYWYGPSLIVLDNVEALFGKPQANDGDPSNNGQWDNASKLLNFFINQVTKIFNKDNKRIRVLFSGKQKTQINPLLFDKHFVSETWSLRAPDKHARAKLLEYFFSKNQIMKLNRDLQFSDLSLETEGFSPLDLEIFTEKIFYDLQLERDCDNVVTRELFSKSLSAFTPSALRGVKLTKETNIKWGDIGALANAKDVLLETLEWPTKYEPIFVNCPLRLRSGILLYGYPGCGKTLLASAVAQQCGLNFISVKGPEILNKFIGASEQNIRELFERAQSVKPCILFFDEFDSIAPKRGHDSTGVTDRVVNQLLTQMDGAEGLDGVYILAATSRPDLIDSALLRPGRLDKSVICNIPTESERLDILQAIVNSKDKDTGQKKFALEKNADLKLIAEKTAGFSGADLQGLCYNAYLKSVHRWLSAADQSEVVPGNDNIEYFSINEHGRREENRLRLKTLLQQDVVHETKTSTSAASELTAVVTINDLLEACQETKPSISTSELVKLRGIYDRFQKDRNGEMPNGENSIDIGSRLSLM

SEQ ID NO: 22219 - protein, 125 aa, Saccharomyces cerevisiae
MFRSVCRISSRVAPSAYRTIMGRSVMSNTILAQRFYSANLSKDQVSQRVIDVIKAFDKNSPNIANKQISSDTQFHKDLGLDSLDTVELLVAIEEEFDIEIPDKVADELRSVGETVDYIASNPDAN

SEQ ID NO: 22220 - protein, 175 aa, Saccharomyces cerevisiae
MGAAPSKIVDGLLEDTNFDRDEIERLRKRFMKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 22221 - protein, 466 aa, Saccharomyces cerevisiae
MSSTQVGNALSSSTTTLVDLSNSTVTQKKQYYKDGETLHNLLLELKNNQDLELLPHEQAHPKIFQALKARIGRINNETCDPGEENSFFICDLGEVKRLFNNWVKELPRIKPFYAVKCNPDTKVLSLLAELGVNFDCASKVEIDRVLSMNISPDRIVYANPCKVASFIRYAASKNVMKSTFDNVEELHKIKKFHPESQLLLRIATDDSTAQCRLSTKYGCEMENVDVLLKAIKELGLNLAGVSFHVGSGASDFTSLYKAVRDARTVFDKAANEYGLPPLKILDVGGGFQFESFKESTAVLRLALEEFFPVGCGVDIIAEPGRYFVATAFTLASHVIAKRKLSENEAMIYTNDGVYGNMNCILFDHQEPHPRTLYHNLEFHYDDFESTTAVLDSINKTRSEYPYKVSIWGPTCDGLDCIAKEYYMKHDVIVGDWFYFPALGAYTSSAATQFNGFEQTADIVYIDSELD

SEQ ID NO: 22222 - protein, 2051 aa, Saccharomyces cerevisiae
MDAYSTRPLTLSHGSLEHVLLVPTASFFIASQLQEQFNKILPEPTEGFAADDEPTTPAELVGKFLGYVSSLVEPSKVGQFDQVLNLCLTEFENCYLEGNDIHALAAKLLQENDTTLVKTKELIKNYITARIMAKRPFDKKSNSALFRAVGEGNAQLVAIFGGQGNTDDYFEELRDLYQTYHVLVGDLIKFSAETLSELIRTTLDAEKVFTQGLNILEWLENPSNTPDKDYLLSIPISCPLIGVIQLAHYVVTAKLLGFTPGELRSYLKGATGHSQGLVTAVAIAETDSWESFFVSVRKAITVLFFIGVRCYEAYPNTSLPPSILEDSLENNEGVPSPMLSISNLTQEQVQDYVNKTNSHLPAGKQVEISLVNGAKNLVVSGPPQSLYGLNLTLRKAKAPSGLDQSRIPFSERKLKFSNRFLPVASPFHSHLLVPASDLINKDLVKNNVSFNAKDIQIPVYDTFDGSDLRVLSGSISERIVDCIIRLPVKWETTTQFKATHILDFGPGGASGLGVLTHRNKDGTGVRVIVAGTLDINPDDDYGFKQEIFDVTSNGLKKNPNWLEEYHPKLIKNKSGKIFVETKFSKLIGRPPLLVPGMTPCTVSPDFVAATTNAGYTIELAGGGYFSAAGMTAAIDSVVSQIEKGSTFGINLIYVNPFMLQWGIPLIKELRSKGYPIQFLTIGAGVPSLEVASEYIETLGLKYLGLKPGSIDAISQVINIAKAHPNFPIALQWTGGRGGGHHSFEDAHTPMLQMYSKIRRHPNIMLIFGSGFGSADDTYPYLTGEWSTKFDYPPMPFDGFLFGSRVMIAKEVKTSPDAKKCIAACTGVPDDKWEQTYKKPTGGIVTVRSEMGEPIHKIATRGVMLWKEFDETIFNLPKNKLVPTLEAKRDYIISRLNADFQKPWFATVNGQARDLATMTYEEVAKRLVELMFIRSTNSWFDVTWRTFTGDFLRRVEERFTKSKTLSLIQSYSLLDKPDEAIEKVFNAYPAAREQFLNAQDIDHFLSMCQNPMQKPVPFVPVLDRRFEIFFKKDSLWQSEHLEAVVDQDVQRTCILHGPVAAQFTKVIDEPIKSIMDGIHDGHIKKLLHQYYGDDESKIPAVEYFGGESPVDVQSQVDSSSVSEDSAVFKATSSTDEESWFKALAGSEINWRHASFLCSFITQDKMFVSNPIRKVFKPSQGMVVEISNGNTSSKTVVTLSEPVQGELKPTVILKLLKENIIQMEMIENRTMDGKPVSLPLLYNFNPDNGFAPISEVMEDRNQRIKEMYWKLWIDEPFNLDFDPRDVIKGKDFEITAKEVYDFTHAVGNNCEDFVSRPDRTMLAPMDFAIVVGWRAIIKAIFPNTVDGDLLKLVHLSNGYKMIPGAKPLQVGDVVSTTAVIESVVNQPTGKIVDVVGTLSRNGKPVMEVTSSFFYRGNYTDFENTFQKTVEPVYQMHIKTSKDIAVLRSKEWFQLDDEDFDLLNKTLTFETETEVTFKNANIFSSVKCFGPIKVELPTKETVEIGIVDYEAGASHGNPVVDFLKRNGSTLEQKVNLENPIPIAVLDSYTPSTNEPYARVSGDLNPIHVSRHFASYANLPGTITHGMFSSASVRALIENWAADSVSSRVRGYTCQFVDMVLPNTALKTSIQHVGMINGRKLIKFETRNEDDVVVLTGEAEIEQPVTTFVFTGQGSQEQGMGMDLYKTSKAAQDVWNRADNHFKDTYGFSILDIVINNPVNLTIHFGGEKGKRIRENYSAMIFETIVDGKLKTEKIFKEINEHSTSYTFRSEKGLLSATQFTQPALTLMEKAAFEDLKSKGLIPADATFAGHSLGEYAALASLADVMSIESLVEVVFYRGMTMQVAVPRDELGRSNYGMIAINPGRVAASFSQEALQYVVERVGKRTGWLVEIVNYNVENQQYVAAGDLRALDTVTNVLNFIKLQKIDIIELQKSLSLEEVEGHLFEIIDEASKKSAVKPRPLKLERGFACIPLVGISVPFHSTYLMNGVKPFKSFLKKNIIKENVKVARLAGKYIPNLTAKPFQVTKEYFQDVYDLTGSEPIKEIIDNWEKYEQS

SEQ ID NO: 22223 - protein, 427 aa, Saccharomyces cerevisiae
MRKCKIFVGNSHPELGNMVCQRLGIEPAPCTLKKFANGETSVQIGVSVRDEDVYVIQSGSPSINDDIMELLILVSACRGGSARKITAVIPQFPYSKQCKMKRHRGAITARMLANLLVMAGADHVVSMDLHASQMQGFFTKPVDNLYGGPSLAKWIRENVEDYEDAVVVSKNPGGTKRVTALADSLKINFAMIHTDRRRSKDLYSQNKDLQQLKLRKQSMLRKNRPIIRQGDHPNEEENIILSNGIQTARIRNGHVIGDDEADDDEDAILESDSELHSIDGLDSHGLGGTYDAVDSEDEEEIPVLYREQLITLVGNVRGRSAIILDDMIDRPGSFISAAEHLVQNCGAKKVYVVATHGIFTGDCLEELEKSDAIDTIVVTNTYPISGERIAGSKKLVTIDVSPIFAECIRRDHYGESISVLFDSLAAL

SEQ ID NO: 22224 - protein, 470 aa, Saccharomyces cerevisiae
MSYKSAIIGLCLLAVILLAPPLAWHSHTKNIPAIILITWLLTMNLTCIVDAAIWSDDDFLTRWDGKGWCDIVIKLQVGANIGISCAVTNIIYNLHTILKADSVLPDLSSWTKIVKDLVISLFTPVMVMGFSYLLQVFRYGIARYNGCQNLLSPTWITTVLYTMWMLIWSFVGAVYATLVLFVFYKKRKDVRDILHCTNSGLNLTRFARLLIFCFIIILVMFPFSVYTFVQDLQQVEGHYTFKNTHSSTIWNTIIKFDPGRPIYNIWLYVLMSYLVFLIFGLGSDALHMYSKFLRSIKLGFVLDMWKRFIDKNKEKRVGILLNKLSSRKESRNPFSTDSENYISTCTENYSPCVGTPISQAHFYVDYRIPDDPRKSQNKSKKYLFADKETDDILDEIDLKESRHIPYVTQGQSFDDEISLGGFSKVTLDYSEKLHNSASSNFEGESLCYSPASKEENSSSNEHSSENTAGP

SEQ ID NO: 22225 - protein, 398 aa, Saccharomyces cerevisiae
MYVDPMNNNEIRKLSITAKTETTPDNVGQDIPVNAHSVHEECSSNTPVEINGRNSGKLKEEASAGICLVKKPMLQYRDTSGKYSLSDFQILRTLGTGSFGRVHLIRSNHNGRFYALKTLKKHTIVKLKQVEHTNDERRMLSIVSHPFIIRMWGTFQDSQQVFMVMDYIEGGELFSLLRKSQRFPNPVAKFYAAEVCLALEYLHSKDIIYRDLKPENILLDKNGHIKITDFGFAKYVPDVTYTLCGTPDYIAPEVVSTKPYNKSVDWWSFGVLIYEMLAGYTPFYNSNTMKTYENILNAELKFPPFFHPDAQDLLKKLITRDLSERLGNLQNGSEDVKNHPWFNEVIWEKLLARYIETPYEPPIQQGQGDTSQFDRYPEEEFNYGIQGEDPYMDLMKEF

SEQ ID NO: 22226 - protein, 341 aa, Saccharomyces cerevisiae
MQYKKSLVASALVATSLAAYAPKDPWSTLTPSATYKGGITDYSSTFGIAVEPIATTASSKAKRAAAISQIGDGQIQATTKTTAAAVSQIGDGQIQATTKTKAAAVSQIGDGQIQATTKTTSAKTTAAAVSQIGDGQIQATTKTKAAAVSQIGDGQIQATTKTTAAAVSQIGDGQIQATTKTTAAAVSQIGDGQIQATTNTTVAPVSQITDGQIQATTLTSATIIPSPAPAPITNGTDPVTAETCKSSGTLEMNLKGGILTDGKGRIGSIVANRQFQFDGPPPQAGAIYAAGWSITPEGNLAIGDQDTFYQCLSGNFYNLYDEHIGTQCNAVHLQAIDLLNC

SEQ ID NO: 22227 - protein, 325 aa, Saccharomyces cerevisiae
MQYKKPLVVSALAATSLAAYAPKDPWSTLTPSATYKGGITDYSSSFGIAIEAVATSASSVASSKAKRAASQIGDGQVQAATTTAAVSKKSTAAAVSQITDGQVQAAKSTAAAVSQITDGQVQAAKSTAAAVSQITDGQVQAAKSTAAAVSQITDGQVQAAKSTAAAASQISDGQVQATTSTKAAASQITDGQIQASKTTSGASQVSDGQVQATAEVKDANDPVDVVSCNNNSTLSMSLSKGILTDRKGRIGSIVANRQFQFDGPPPQAGAIYAAGWSITPEGNLALGDQDTFYQCLSGDFYNLYDKHIGSQCHEVYLQAIDLIDC

SEQ ID NO: 22228 - protein, 433 aa, Saccharomyces cerevisiae
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVN

SEQ ID NO: 22229 - protein, 844 aa, Saccharomyces cerevisiae
MTSKTPNREILPDNVVPLHYDLTVEPDFKTFKFEGSVKIELKINNPAIDTVTLNTVDTDIHSAKIGDVTSSEIISEEEQQVTTFAFPKGTMSSFKGNAFLDIKFTGILNDNMAGFYRAKYEDKLTGETKYMATTQMEPTDARRAFPCFDEPNLKASFAITLVSDPSLTHLSNMDVKNEYVKDGKKVTLFNTTPKMSTYLVAFIVAELKYVESKNFRIPVRVYATPGNEKHGQFAADLTAKTLAFFEKTFGIQYPLPKMDNVAVHEFSAGAMENWGLVTYRVVDLLLDKDNSTLDRIQRVAEVVQHELAHQWFGNLVTMDWWEGLWLNEGFATWMSWYSCNEFQPEWKVWEQYVTDTLQHALSLDSLRSSHPIEVPVKKADEINQIFDAISYSKGASLLRMISKWLGEETFIKGVSQYLNKFKYGNAKTEDLWDALADASGKDVRSVMNIWTKKVGFPVISVSEDGNGKITFRQNRYLSTADVKPDEDKTIYPVFLALKTKNGVDSSVVLSERSKTIELEDPTFFKVNSEQSGIYITSYTDERWAKLGQQADLLSVEDRVGLVADVKTLSASGYTSTTNFLNLVSKWNNEKSFVVWDQIINSISSMKSTWLFEPKETQDALDNFTKQLISGMTHHLGWEFKSSDSFSTQRLKVTMFGAACAARDADVEKAALKMFTDYCSGNKEAIPALIKPIVFNTVARVGGAENYEKVYKIYLDPISNDEKLAALRSLGRFKEPKLLERTLGYLFDGTVLNQDIYIPMQGMRAHQEGVEALWNWVKKNWDELVKRLPPGLSMLGSVVTLGTSGFTSMQKIDEIKKFFATKSTKGFDQSLAQSLDTITSKAQWG

SEQ ID NO: 22230 - protein, 247 aa, Saccharomyces cerevisiae
MPKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 22231 - protein, 302 aa, Saccharomyces cerevisiae
MFSRLSRSHSKALPIALGTVAIAAATAFYFANRNQHSFVFNESNKVFKGDDKWIDLPISKIEEESHDTRRFTFKLPTEDSEMGLVLASALFAKFVTPKGSNVVRPYTPVSDLSQKGHFQLVVKHYEGGKMTSHLFGLKPNDTVSFKGPIMKWKWQPNQFKSITLLGAGTGINPLYQLAHHIVENPNDKTKVNLLYGNKTPQDILLRKELDALKEKYPDKFNVTYFVDDKQDDQDFDGEISFISKDFIQEHVPGPKESTHLFVCGPPPFMNAYSGEKKSPKDQGELIGILNNLGYSKDQVFKF

SEQ ID NO: 22232 - protein, 640 aa, Saccharomyces cerevisiae
MLSLKKSALSKLTLLRNTRTFTSSALVRQTQGSVNGSASRSADGKYHIIDHEYDCVVIGAGGAGLRAAFGLAEAGYKTACISKLFPTRSHTVAAQGGINAALGNMHKDNWKWHMYDTVKGSDWLGDQDSIHYMTREAPKSIIELEHYGVPFSRTENGKIYQRAFGGQTKEYGKGAQAYRTCAVADRTGHALLHTLYGQALRHDTHFFIEYFALDLLTHNGEVVGVIAYNQEDGTIHRFRAHKTIIATGGYGRAYFSCTSAHTCTGDGNAMVSRAGFPLQDLEFVQFHPSGIYGSGCLITEGARGEGGFLVNSEGERFMERYAPTAKDLACRDVVSRAITMEIREGRGVGKKKDHMYLQLSHLPPEVLKERLPGISETAAIFAGVDVTKEPIPIIPTVHYNMGGIPTKWNGEALTIDEETGEDKVIPGLMACGEAACVSVHGANRLGANSLLDLVVFGRAVAHTVADTLQPGLPHKPLPSDLGKESIANLDKLRNANGSRSTAEIRMNMKQTMQKDVSVFRTQSSLDEGVRNITAVEKTFDDVKTTDRSMIWNSDLVETLELQNLLTCASQTAVSAANRKESRGAHAREDYPNRDDEHWMKHTLSWQKDVAAPVTLKYRRVIDHTLDEKECPSVPPTVRAY

SEQ ID NO: 22233 - protein, 467 aa, Saccharomyces cerevisiae
MPPKEDWEKYKAPLEDDDKKPDDDKIVPLTEGDIQVLKSYGAAPYAAKLKQTENDLKDIEARIKEKAGVKESDTGLAPSHLWDIMGDRQRLGEEHPLQVARCTKIIKGNGESDETTTDNNNSGNSNSNSNQQSTDADEDDEDAKYVINLKQIAKFVVGLGERVSPTDIEEGMRVGVDRSKYNIELPLPPRIDPSVTMMTVEEKPDVTYSDVGGCKDQIEKLREVVELPLLSPERFATLGIDPPKGILLYGPPGTGKTLCARAVANRTDATFIRVIGSELVQKYVGEGARMVRELFEMARTKKACIIFFDEIDAVGGARFDDGAGGDNEVQRTMLELITQLDGFDPRGNIKVMFATNRPNTLDPALLRPGRIDRKVEFSLPDLEGRANIFRIHSKSMSVERGIRWELISRLCPNSTGAELRSVCTEAGMFAIRARRKVATEKDFLKAVDKVISGYKKFSSTSRYMQYN

SEQ ID NO: 22234 - protein, 198 aa, Saccharomyces cerevisiae
MSAMMVKLGLNKSALLLKPSAFSRAAALSSSRRLLFNTARTNFLSTSPLKNVASEMNTKAAIAEEQILNKQRAKRPISPHLTIYQPQLTWYLSSLHRISLVLMGLGFYLFTILFGVSGLLGLGLTTEKVSNWYHQKFSKITEWSIKGSFAYLFAIHYGGAIRHLIWDTAKELTLKGVYRTGYALIGFTAVLGTYLLTL

SEQ ID NO: 22235 - protein, 528 aa, Saccharomyces cerevisiae
MSYNNGNTYSKSYSRNNKRPLFGKRSPNPQSLARPPPPKRIRTDSGYQSNMDNISSHRVNSNDQPGHTKSRGNNNLSRYNDTSFQTSSRYQGSRYNNNNTSYENRPKSIKRDETKAEFLSHLPKGPKSVEKSRYNNSSNTSNDIKNGYHASKYYNHKGQEGRSVIAKKVPVSVLTQQRSTSVYLRIMQVGEGTYGKVYKAKNTNTEKLVALKKLRLQGEREGFPITSIREIKLLQSFDHPNVSTIKEIMVESQKTVYMIFEYADNDLSGLLLNKEVQISHSQCKHLFKQLLLGMEYLHDNKILHRDVKGSNILIDNQGNLKITDFGLARKMNSRADYTNRVITLWYRPPELLLGTTNYGTEVDMWGCGCLLVELFNKTAIFQGSNELEQIESIFKIMGTPTINSWPTLYDMPWFFMIMPQQTTKYVNNFSEKFKSVLPSSKCLQLAINLLCYDQTKRFSATEALQSDYFKEEPKPEPLVLDGLVSCHEYEVKLARKQKRPNILSTNTNNKGNGNSNNNNNNNNDDDDK

SEQ ID NO: 22236 - protein, 770 aa, Saccharomyces cerevisiae
MLRTIILKAGSNASIPSPSRQNKLLRFFATAGAVSRTSPGSIKKIFDDNSYWRNINGQDANNSKISQYLFKKNKTGLFKNPYLTSPDGLRKFSQVSLQQAQELLDKMRNDFSESGKLTYIMNLDRLSDTLCRVIDLCEFIRSTHPDDAFVRAAQDCHEQMFEFMNVLNTDVSLCNILKSVLNNPEVSSKLSAEELKVGKILLDDFEKSGIYMNPDVREKFIQLSQEISLVGQEFINHTDYPGSNSVKIPCKDLDNSKVSTFLLKQLNKDVKGQNYKVPTFGYAAYALLKSCENEMVRKKLWTALHSCSDKQVKRLSHLIKLRAILANLMHKTSYAEYQLEGKWQDRRCQDFILTLMNNTIEKTANELKFIAELKAKDLKKPLTTNTDEILKLVRPWDRDYYTGKYFQLNPSNSPNAKEISYYFTLGNVIQGLSDLFQQIYGIRLEPAITDEGETWSPDVRRLNVISEEEGIIGIIYCDLFERNGKTSNPAHFTVCCSRQIYPSETDFSTIQVGENPDGTYFQLPVISLVCNFSPILIASKKSLCFLQLSEVETLFHEMGHAMHSMLGRTHMQNISGTRCATDFVELPSILMEHFAKDIRILTKIGKHYGTGETIQADMLQRFMKSTNFLQNCETYSQAKMAMLDQSFHDEKIISDIDNFDVVENYQALERRLKVLVDDQSNWCGRFGHLFGSGQLITATYFDRTIASKIWYALFEDDPYSRKNGDKFKKHLLKWGGLKDPWKCIADVLECPMLEKGGSDAMEFIAQSHKS

SEQ ID NO: 22237 - protein, 1271 aa, Saccharomyces cerevisiae
MAVIKKGARRKDVKEPKKRSAKIKKATFDANKKKEVGISDLTLLSKISDESINENLKKRFKNGIIYTYIGHVLISVNPFRDLGIYTNAVLESYKGKNRLEVPPHVFAIAESMYYNLKSYNENQCVIISGESGAGKTEAAKRIMQYIAAASNSHSESIGKIKDMVLATNPLLESFGCAKTLRNNNSSRHGKYLEIKFNSQFEPCAGNITNYLLEKQRVVGQIKNERNFHIFYQFTKGASDTYKQMFGVQMPEQYIYTAAAGCTSADQLMRKDYEGTLEAMRTIGLVQEEQDQIFRMLAAILWIGNISFIENEEGNAQVGDTSVTDFVAYLLQVDASLLVKCLVERIMQTSHGMKRGSVYHVPLNPVQATAVRDALAKAIYNNLFDWIVDRVNVSLQAFPGADKSIGILDIYGFEIFEHNSFEQICINYVNEKLQQIFIQLTLKAEQETYEREKIKWTPIKYFDNKVVCDLIEAKNPPGILAAMNDSIATAHADSNAADQAFAQRLNLFNSNPYFELRANKFVIKHYAGDVTYDINGITDKNKDQLQKDLIELIGTTTNTFLSTIFPDDVDKDSKRRPPTAGDKIIKSANELVETLSKAEPSYIRTIKPNQTKSPNDYDDHQVLHQVKYLGLQENVRIRRAGFAYRQTFEKFVERFYLLSPDCSYAGDYTWDGDTLEAVKLILRDAMIPEKEFQLGVTSVFIKTPESLFALEDMRDKYWYNMAARIQRAWRRFLQRRIDAAIKIQRTIREKKGGNKYVKLRDYGTKLLAGKKERRSMSLLGYRAFMGDYLSCNESKTKGSYIRRQVGIKDKVVFSIKGECLHSKFGRSAQRLKKVFILTKKTFYIIGQTREQNAMKYTQDYKIDVGKIKQVSLTNLQDDWMGVILVNSTQSDPLINTPFKTELMTRLKKLNEKIMIKVGPTIEYHKQPNKLHTVRSKISDSAPKYGDIYKSSTIYVRRGHPANSKSNKKPKNPGGLSGKPIKSKKSKHKSTHKHTHSHRSHRDAAKKQPLPSQKPVNPLSLRATAAQAAYNPKPDKTVPIKSSAIPAAKVSSKHSSKPSSKEKVAVKKASSSHKSSSAKQNQVSMPPSKGVEKNKEPLKETTATATANIPIPPPPPPMGQPKDPKFEAAYDFPGSGSSSELPLKKGDIVFISRDEPSGWSLAKLLDGSKEGWVPTAYMTPYKDTRNTVPVAATGAVNDVTNQKSSQIDNTISSAQEGVQFGSATVGPTSDNQSNPVGTFSDGLASALAARANKMRAESADDDDNDDGDDDDDW

SEQ ID NO: 22238 - protein, 570 aa, Saccharomyces cerevisiae
MSLLIDSVPTVAYKDQKPGTSGLRKKTKVFMDEPHYTENFIQATMQSIPNGSEGTTLVVGGDGRFYNDVIMNKIAAVGAANGVRKLVIGQGGLLSTPAASHIIRTYEEKCTGGGIILTASHNPGGPENDLGIKYNLPNGGPAPESVTNAIWEASKKLTHYKIIKNFPKLNLNKLGKNQKYGPLLVDIIDPAKAYVQFLKEIFDFDLIKSFLAKQRKDKGWKLLFDSLNGITGPYGKAIFVDEFGLPAEEVLQNWHPLPDFGGLHPDPNLTYARTLVDRVDREKIAFGAASDGDGDRNMIYGYGPAFVSPGDSVAIIAEYAPEIPYFAKQGIYGLARSFPTSSAIDRVAAKKGLRCYEVPTGWKFFCALFDAKKLSICGEESFGTGSNHIREKDGLWAIIAWLNILAIYHRRNPEKEASIKTIQDEFWNEYGRTFFTRYDYEHIECEQAEKVVALLSEFVSRPNVCGSHFPADESLTVIDCGDFSYRDLDGSISENQGLFVKFSNGTKFVLRLSGTGSSGATIRLYVEKYTDKKENYGQTADVFLKPVINSIVKFLRFKEILGTDEPTVRT

SEQ ID NO: 22239 - protein, 680 aa, Saccharomyces cerevisiae
MYSWKSKFKFGKSKEEKEAKHSGFFHSSKKEEQQNNQATAGEHDASITRSSLDRKGTINPSNSSVVPVRVSYDASSSTSTVRDSNGGNSENTNSSQNLDETANIGSTGTPNDATSSSGMMTIKVYNGDDFILPFPITSSEQILNKLLASGVPPPHKEISKEVDALIAQLSRVQIKNQGPADEDLISSESAAKFIPSTIMLPGSSTLNPLLYFTIEFDNTVATIEAEYGTIAKPGFNKISTFDVTRKLPYLKIDVFARIPSILLPSKTWQQEMGLQDEKLQTIFDKINSNQDIHLDSFHLPINLSFDSAASIRLYNHHWITLDNGLGKINISIDYKPSRNKPLSIDDFDLLKVIGKGSFGKVMQVRKKDTQKVYALKAIRKSYIVSKSEVTHTLAERTVLARVDCPFIVPLKFSFQSPEKLYFVLAFINGGELFYHLQKEGRFDLSRARFYTAELLCALDNLHKLDVVYRDLKPENILLDYQGHIALCDFGLCKLNMKDDDKTDTFCGTPEYLAPELLLGLGYTKAVDWWTLGVLLYEMLTGLPPYYDEDVPKMYKKILQEPLVFPDGFDRDAKDLLIGLLSRDPTRRLGYNGADEIRNHPFFSQLSWKRLLMKGYIPPYKPAVSNSMDTSNFDEEFTREKPIDSVVDEYLSESVQKQFGGWTYVGNEQLGSSMVQGRSIR

SEQ ID NO: 22240 - protein, 324 aa, Saccharomyces cerevisiae
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 22241 - protein, 451 aa, Saccharomyces cerevisiae
MLRTRLTNCSLWRPYYTSSLSRVPRAPPDKVLGLSEHFKKVKNVNKIDLTVGIYKDGWGKVTTFPSVAKAQKLIESHLELNKNLSYLPITGSKEFQENVMKFLFKESCPQFGPFYLAHDRISFVQTLSGTGALAVAAKFLALFISRDIWIPDPSWANHKNIFQNNGFENIYRYSYYKDGQIDIDGWIEQLKTFAYNNQQENNKNPPCIILHACCHNPTGLDPTKEQWEKIIDTIYELKMVPIVDMAYQGLESGNLLKDAYLLRLCLNVNKYPNWSNGIFLCQSFAKNMGLYGERVGSLSVITPATANNGKFNPLQQKNSLQQNIDSQLKKIVRGMYSSPPGYGSRVVNVVLSDFKLKQQWFKDVDFMVQRLHHVRQEMFDRLGWPDLVNFAQQHGMFYYTRFSPKQVEILRNNYFVYLTGDGRLSLSGVNDSNVDYLCESLEAVSKMDKLA

SEQ ID NO: 22242 - protein, 717 aa, Saccharomyces cerevisiae
MCGIFGYCNYLVERSRGEIIDTLVDGLQRLEYRGYDSTGIAIDGDEADSTFIYKQIGKVSALKEEITKQNPNRDVTFVSHCGIAHTRWATHGRPEQVNCHPQRSDPEDQFVVVHNGIITNFRELKTLLINKGYKFESDTDTECIAKLYLHLYNTNLQNGHDLDFHELTKLVLLELEGSYGLLCKSCHYPNEVIATRKGSPLLIGVKSEKKLKVDFVDVEFPEENAGQPEIPLKSNNKSFGLGPKKAREFEAGSQNANLLPIAANEFNLRHSQSRAFLSEDGSPTPVEFFVSSDAASVVKHTKKVLFLEDDDLAHIYDGELHIHRSRREVGASMTRSIQTLEMELAQIMKGPYDHFMQKEIYEQPESTFNTMRGRIDYENNKVILGGLKAWLPVVRRARRLIMIACGTSYHSCLATRAIFEELSDIPVSVELASDFLDRKCPVFRDDVCVFVSQSGETADTMLALNYCLERGALTVGIVNSVGSSISRVTHCGVHINAGPEIGVASTKAYTSQYIALVMFALSLSDDRVSKIDRRIEIIQGLKLIPGQIKQVLKLEPRIKKLCATELKDQKSLLLLGRGYQFAAALEGALKIKEISYMHSEGVLAGELKHGVLALVDENLPIIAFGTRDSLFPKVVSSIEQVTARKGHPIIICNENDEVWAQKSKSIDLQTLEVPQTVDCLQGLINIIPLQLMSYWLAVNKGIDVDFPRNLAKSVTVE

SEQ ID NO: 22243 - protein, 1518 aa, Saccharomyces cerevisiae
MTGHVSKTSHVPKGRPSSLAKKAAKRAMAKVNSNPKRASGHLERVVQSVNDATKRLSQPDSTVSVATKSSKRKSRDTVGPWKLGKTLGKGSSGRVRLAKNMETGQLAAIKIVPKKKAFVHCSNNGTVPNSYSSSMVTSNVSSPSIASREHSNHSQTNPYGIEREIVIMKLISHTNVMALFEVWENKSELYLVLEYVDGGELFDYLVSKGKLPEREAIHYFKQIVEGVSYCHSFNICHRDLKPENLLLDKKNRRIKIADFGMAALELPNKLLKTSCGSPHYASPEIVMGRPYHGGPSDVWSCGIVLFALLTGHLPFNDDNIKKLLLKVQSGKYQMPSNLSSEARDLISKILVIDPEKRITTQEILKHPLIKKYDDLPVNKVLRKMRKDNMARGKSNSDLHLLNNVSPSIVTLHSKGEIDESILRSLQILWHGVSRELITAKLLQKPMSEEKLFYSLLLQYKQRHSISLSSSSENKKSATESSVNEPRIEYASKTANNTGLRSENNDVKTLHSLEIHSEDTSTVNQNNAITGVNTEINAPVLAQKSQFSINTLSQPESDKAEAEAVTLPPAIPIFNASSSRIFRNSYTSISSRSRRSLRLSNSRLSLSASTSRETVHDNEMPLPQLPKSPSRYSLSRRAIHASPSTKSIHKSLSRKNIAATVAARRTLQNSASKRSLYSLQSISKRSLNLNDLLVFDDPLPSKKPASENVNKSEPHSLESDSDFEILCDQILFGNALDRILEEEEDNEKERDTQRQRQNDTKSSADTFTISGVSTNKENEGPEYPTKIEKNQFNMSYKPSENMSGLSSFPIFEKENTLSSSYLEEQKPKRAALSDITNSFNKMNKQEGMRIEKKIQREQLQKKNDRPSPLKPIQHQELRVNSLPNDQGKPSLSLDPRRNISQPVNSKVESLLQGLKFKKEPASHWTHERGSLFMSEHVEDEKPVKASDVSIESSYVPLTTVATSSRDPSVLAESSTIQKPMLSLPSSFLNTSMTFKNLSQILADDGDDKHLSVPQNQSRSVAMSHPLRKQSAKISLTPRSNLNANLSVKRNQGSPGSYLSNDLDGISDMTFAMEIPTNTFTAQAIQLMNNDTDNNKINTSPKASSFTKEKVIKSAAYISKEKEPDNSDTNYIPDYTIPNTYDEKAINIFEDAPSDEGSLNTSSSESDSRASVHRKAVSIDTMATTNVLTPATNVRVSLYWNNNSSGIPRETTEEILSKLRLSPENPSNTHMQKRFSSTRGSRDSNALGISQSLQSMFKDLEEDQDGHTSQADILESSMSYSKRRPSEESVNPKQRVTMLFDEEEEESKKVGGGKIKEEHTKLDNKISEESSQLVLPVVEKKENANNTENNYSKIPKPSTIKVTKDTAMESNTQTHTKKPILKSVQNVEVEEAPSSDKKNWFVKLFQNFSSHNNATKASKNHVTNISFDDAHMLTLNEFNKNSIDYQLKNLDHKFGRKVVEYDCKFVKGNFKFKIKITSTPNASSVITVKKRSKHSNTSSNKAFEKFNDDVERVIRNAGRS

SEQ ID NO: 22244 - protein, 239 aa, Saccharomyces cerevisiae
MKFSTALSVALFALAKMVIADSEEFGLVSIRSGSDLQYLSVYSDNGTLKLGSGSGSFEATITDDGKLKFDDDKYAVVNEDGSFKEGSESDAATGFSIKDGHLNYKSSSGFYAIKDGSSYIFSSKQSDDATGVAIRPTSKSGSVAADFSPSDSSSSSSASASSASASSSTKHSSSIESVETSTTVETSSASSPTASVISQITDGQIQAPNTVYEQTENAGAKAAVGMGAGALAVAAAYLL

SEQ ID NO: 22245 - protein, 313 aa, Saccharomyces cerevisiae
MAPYPYKVQTTVPELQYENFDGAKFGYMFWPVQNGTNEVRGRVLLIHGFGEYTKIQFRLMDHLSLNGYESFTFDQRGAGVTSPGRSKGVTDEYHVFNDLEHFVEKNLSECKAKGIPLFMWGHSMGGGICLNYACQGKHKNEISGYIGSGPLIILHPHTMYNKPTQIIAPLLAKFLPRVRIDTGLDLKGITSDKAYRAFLGSDPMSVPLYGSFRQIHDFMQRGAKLYKNENNYIQKNFAKDKPVIIMHGQDDTINDPKGSEKFIQDCPSADKELKLYPGARHSIFSLETDKVFNTVFNDMKQWLDKHTTTEAKP

SEQ ID NO: 22246 - protein, 1104 aa, Saccharomyces cerevisiae
MSSNNEPAQSRTSYFKLNEFLSNVKHYKNTFKGEIQWCNNLSLNDWKTHYLQITSTGALTHSIDELTADSTNIQPIIKHLQQCRIEIIKDKHSSFKDINANCNFIIQVNTSGKDNKVYLRVKSWSDFKKLLTCLIWWSSMKTNGIFNKFQVSRPLEFKSKKMAKPESLLVYKLNVFGPIVKNIVLPPATNILESPDIINNDDNSVGWFSAMGVLKSNGMLDLLLQSDGSLIYSLNISQLLRSEIRILDSSVLQSENSLFLGELPLLRSQLGLEKFRIENIASAATNSSDISQEIIVEFPLRIDLEDCFIALQSFARSEYLSITGSDKSNDMKISNSFKISILEANFQSINLNDKNNTPWSIFTDITAWGHTWARTSMVSNSSNPFWREEFQFNELLRLTNSYLEIKQLFHDLNNKKRLRLIGKIKITQEIINDTRYNKETRLPIMDVDNKNFQIGTICIKISSNLNFILPSTNFVKLEKLLMNANLSMVSNLIYKSSSSMENDNKLTQTSIIFLDIFQSLSRIEEWFHVLIDKELAKIDGTVSRINQKNLDSKHVFNSLFRGNSILTKSIEQYFFRVGNEYLSKALSAILKEIIESNKSCELDPARVKEKDEVKKRKIIADNYKRLYSWVTKIWKRLYATSNDLPIEIRNVLKIFRQKLEIICIDDTLQIILNGISGLLFLRFFCPVILNPKLFKYVSQNLNETARRNLTLISKVLLNLSTLTQFANKEPWLMKMNNFIDKRHNDLLDYIDKMTQKKLDFNSKILNLSSTISRPKLAIEQTMLDDLPQIPYLLDKNLRETEFVNLIVNFSQEDMTKMEKYNHMDNGGKGELIEEEGLLSGSSLNLSVDKKDLDSPIEVKPEIGELEFEKITENNTEIFGDDLMNLLKSDDVGSRSRDLDNGANSGIKFNSIIPKAEEEKHAMKELEQESCLLYNRINHIRKRLSGYECASSTLFEDKKYSISLSHKIFYEEIKEGKEIVLKLLNKPTNENSSARLQKFFTKGVSSKSNNTVGDSYCKFLTIDVSDENPKSSNKTSVHGTSSENGAKDDYLTLPNSQGKGNLGNRFSPTKLSRIMRKPPNADVPKEQNSRKLTRWFKKKKETGGS

SEQ ID NO: 22247 - protein, 224 aa, Saccharomyces cerevisiae
MMSSDQQGKCPVDEETKKLWLREHGNEAHPGATAPGNQLECSANPQDNDKTPEYHTTVDLSQSREVSTIPRTNSDRNWIYPSEKQFYEAMMKKNWDPNSDDMKVVVPLHNSINERVWNYIKSWEDKQGGEACGGIKLTNFKGDSKKLTPRAWFRSRILHLAKPFDRHDWQIDRCGKTVDYVIDFYSTDLNDANSQQQPLIYLDVRPKLNSFEGFRLRFWKSLGF

SEQ ID NO: 22248 - protein, 334 aa, Saccharomyces cerevisiae
MLSRVAKRAFSSTVANPYKVTVLGAGGGIGQPLSLLLKLNHKVTDLRLYDLKGAKGVATDLSHIPTNSVVKGFTPEEPDGLNNALKDTDMVLIPAGVPRKPGMTRDDLFAINASIVRDLAAATAESAPNAAILVISNPVNSTVPIVAQVLKNKGVYNPKKLFGVTTLDSIRAARFISEVENTDPTQERVNVIGGHSGITIIPLISQTNHKLMSDDKRHELIHRIQFGGDEVVKAKNGAGSATLSMAHAGAKFANAVLSGFKGERDVIEPSFVDSPLFKSEGIEFFASPVTLGPDGIEKIHPIGELSSEEEEMLQKCKETLKKNIEKGVNFVASK

SEQ ID NO: 22249 - protein, 392 aa, Saccharomyces cerevisiae
MATALYTANDFILISLPQNAQPVTAPGSKTDSWFNETLIGGRAFVSDFKIPEFKIGSLDTLIVESEELSKVDNQIGASIGKIIEILQGLNETSTNAYRTLPINNMPVPEYLENFQWQTRKFKLDKSIKDLITLISNESSQLDADVRATYANYNSAKTNLAAAERKKTGDLSVRSLHDIVKPEDFVLNSEHLTTVLVAVPKSLKSDFEKSYETLSKNVVPASASVIAEDAEYVLFNVHLFKKNVQEFTTAAREKKFIPREFNYSEELIDQLKKEHDSAASLEQSLRVQLVRLAKTAYVDVFINWFHIKALRVYVESVLRYGLPPHFNIKIIAVPPKNLSKCKSELIDAFGFLGGNAFMKDKKGKINKQDTSLHQYASLVDTEYEPFVMYIINL

SEQ ID NO: 22250 - protein, 656 aa, Saccharomyces cerevisiae
MHWNIISKEQSSSSVSLPTLDSSEPCHIEVILRAIPEKGLQNNESTFKIDPYENTVLFRTNNPLHETTKETHSTFQFDKVFDANATQEDVQKFLVHPIINDVLNGYNGTVITYGPSFSGKSYSLIGSKESEGILPNICKTLFDTLEKNEETKGDSFSVSVLAFEIYMEKTYDLLVPLPERKPLKLHRSSSKMDLEIKDICPAHVGSYEDLRSYIQAVQNVGNRMACGDKTERSRSHLVFQLHVEQRNRKDDILKNSSLYLVDLHGAEKFDKRTESTLSQDALKKLNQSIEALKNTVRSLSMKERDSAYSAKGSHSSAYRESQLTEVLKDSLGGNRKTKVILTCFLSNVPTTLSTLEFGDSIRQINNKVTDNTTGLNLKKKMDLFIQDMKIKDDNYVAQINILKAEIDSLKSLHNKSLPEDDEKKMLENTKKENIKLKLQLDSITQLLSSSTNEDPNNRIDEEVSEILTKRCEQIAQLELSFDRQMNSNSKLQQELEYKKSKEEALESMNVRLLEQIQLQEREIQELLTTNAILKGELETHTKLTETRSERIKSLESSVKELSLNKSAIPSPRRGSMSSSSGNTMLHIEEGSEISNSPWSANTSSKPLVWGARKVSSSSIATTGSQESFVARPFKKGLNLHSIKVTSSTPKSPSSGS

SEQ ID NO: 22251 - protein, 735 aa, Saccharomyces cerevisiae
MAANSNSRVASNHTSKKQKVRRNIHPFTNNTRIKRASKIVKFNDSGEGDHVSDQRSNKENVLTYKSLKSRASDLLKMRETLPVYQHKREIMSYIESNPVTVLIGETGSGKSTQIPQFVLEKLYDTKKHGSIAVTQPRRVAAINLATRVAQEHGCKLGEQVGYSVRFDNTTTTRTRLKYLTDGMLLRELMMNSDLREYSVIVIDEAHERTVLTDLILGFLKSLIQGPRPDLRIIVMSATLQAEKFSEFFNNAPILFVEGRKFDVKQYYLKAPTDDIVDAVIRCCIQINQGEELGDILCFLPGQEEIDKAVTIMEKIAKYVSDEAPVPLIVPYPLYAALPAVQQSLVFAPIKGFKRKVVFSTNIAETSVTISGVKFVVDSGLRKVKVWRHQLGLATLLTVPISQASAMQRSGRAGRESEGKSFRLYCESDYVKLPKQSEPEIARSDVTSPVLMLKRYGVDDLLNWTWFENPGKEAIVMGLQELYELGALDTRGKITKRGQQMALLPLQPHLSSVLIKASEVGCLSQVIDIVSCLSVENLLLNPSPEERDEVNERRLSLCNAGKRYGDLIMLKELFDIYFYELGKSQDASSERNDWCKGLCISIRGFKNVIRVRDQLRVYCKRLFSSISEEDEESKKIGEDGELISKILKCFLTGFIKNTAIGMPDRSYRTVSTGEPISIHPSSMLFMNKSCPGIMYTEYVFTTKGYARNVSRIELSWLQEVVTNAAAVAKQKVSDSK

SEQ ID NO: 22252 - protein, 881 aa, Saccharomyces cerevisiae
MRNVLRLLFLTAFVAIGSLAAVLGVDYGQQNIKAIVVSPQAPLELVLTPEAKRKEISGLSIKRLPGYGKDDPNGIERIYGSAVGSLATRFPQNTLLHLKPLLGKSLEDETTVTLYSKQHPGLEMVSTNRSTIAFLVDNVEYPLEELVAMNVQEIANRANSLLKDRDARTEDFVNKMSFTIPDFFDQHQRKALLDASSITTGIEETYLVSEGMSVAVNFVLKQRQFPPGEQQHYIVYDMGSGSIKASMFSILQPEDTTQPVTIEFEGYGYNPHLGGAKFTMDIGSLIENKFLETHPAIRTDELHANPKALAKINQAAEKAKLILSANSEASINIESLINDIDFRTSITRQEFEEFIADSLLDIVKPINDAVTKQFGGYGTNLPEINGVILAGGSSRIPIVQDQLIKLVSEEKVLRNVNADESAVNGVVMRGIKLSNSFKTKPLNVVDRSVNTYSFKLSNESELYDVFTRGSAYPNKTSILTNTTDSIPNNFTIDLFENGKLFETITVNSGAIKNSYSSDKCSSGVAYNITFDLSSDRLFSIQEVNCICQSENDIGNSKQIKNKGSRLAFTSEDVEIKRLSPSERSRLHEHIKLLDKQDKERFQFQENLNVLESNLYDARNLLMDDEVMQNGPKSQVEELSEMVKVYLDWLEDASFDTDPEDIVSRIREIGILKKKIELYMDSAKEPLNSQQFKGMLEEGHKLLQAIETHKNTVEEFLSQFETEFADTIDNVREEFKKIKQPAYVSKALSTWEETLTSFKNSISEIEKFLAKNLFGEDLREHLFEIKLQFDMYRTKLEEKLRLIKSGDESRLNEIKKLHLRNFRLQKRKEEKLKRKLEQEKSRNNNETESTVINSADDKTTIVNDKTTESNPSSEEDILHDEL

SEQ ID NO: 22253 - protein, 153 aa, Saccharomyces cerevisiae
MSSQTERTFIAVKPDGVQRGLVSQILSRFEKKGYKLVAIKLVKADDKLLEQHYAEHVGKPFFPKMVSFMKSGPILATVWEGKDVVRQGRTILGATNPLGSAPGTIRGDFGIDLGRNVCHGSDSVDSAEREINLWFKKEELVDWESNQAKWIYE

SEQ ID NO: 22254 - protein, 359 aa, Saccharomyces cerevisiae
MGVEQILKRKTGVIVGEDVHNLFTYAKEHKFAIPAINVTSSSTAVAALEAARDSKSPIILQTSNGGAAYFAGKGISNEGQNASIKGAIAAAHYIRSIAPAYGIPVVLHSDHCAKKLLPWFDGMLEADEAYFKEHGEPLFSSHMLDLSEETDEENISTCVKYFKRMAAMDQWLEMEIGITGGEEDGVNNENADKEDLYTKPEQVYNVYKALHPISPNFSIAAAFGNCHGLYAGDIALRPEILAEHQKYTREQVGCKEEKPLFLVFHGGSGSTVQEFHTGIDNGVVKVNLDTDCQYAYLTGIRDYVLNKKDYIMSPVGNPEGPEKPNKKFFDPRVWVREGEKTMGAKITKSLETFRTTNTL

SEQ ID NO: 22255 - protein, 640 aa, Saccharomyces cerevisiae
MSPRQLIPTLIPEWAPLSQQSCIREDELDSPPITPTSQTSSFGSSFSQQKPTYSTIIGENIHTILDEIRPYVKKITVSDQDKKTINQYTLGVSAGSGQFGYVRKAYSSTLGKVVAVKIIPKKPWNAQQYSVNQVMRQIQLWKSKGKITTNMSGNEAMRLMNIEKCRWEIFAASRLRNNVHIVRLIECLDSPFSESIWIVTNWCSLGELQWKRDDDEDILPQWKKIVISNCSVSTFAKKILEDMTKGLEYLHSQGCIHRDIKPSNILLDEEEKVAKLSDFGSCIFTPQSLPFSDANFEDCFQRELNKIVGTPAFIAPELCHLGNSKRDFVTDGFKLDIWSLGVTLYCLLYNELPFFGENEFETYHKIIEVSLSSKINGNTLNDLVIKRLLEKDVTLRISIQDLVKVLSRDQPIDSRNHSQISSSSVNPVRNEGPVRRFFGRLLTKKGKKKTSGKGKDKVLVSATSKVTPSIHIDEEPDKECFSTTVLRSSPDSSDYCSSLGEEAIQVTDFLDTFCRSNESLPNLTVNNDKQNSDMKTDRSESSSHSSLKIPTPIKAMIRLKSSPKENGNRTHINCSQDKPSSPLMDRTVGKRTVNNSGARKLAHSSNILNFKAYINSEDSDIRETVEDVKTYLNFADNGQI

SEQ ID NO: 22256 - protein, 528 aa, Saccharomyces cerevisiae
MFRQSKRRIASRKNFSSYDDIVKSELDVGNTNAANQIILSSSSSEEEKKLYARLYESKLSFYDLPPQGEITLEQFEIWAIDRLKILLEIESCLSRNKSIKEIETIIKPQFQKLLPFNTESLEDRKKDYYSHFILRLCFCRSKELREKFVRAETFLFKIRFNMLTSTDQTKFVQSLDLPLLQFISNEEKAELSHQLYQTVSASLQFQLNLNEEHQRKQYFQQEKFIKLPFENVIELVGNRLVFLKDGYAYLPQFQQLNLLSNEFASKLNQELIKTYQYLPRLNEDDRLLPILNHLSSGYTIADFNQQKANQFSENVDDEINAQSVWSEEISSNYPLCIKNLMEGLKKNHHLRYYGRQQLSLFLKGIGLSADEALKFWSEAFTRNGNMTMEKFNKEYRYSFRHNYGLEGNRINYKPWDCHTILSKPRPGRGDYHGCPFRDWSHERLSAELRSMKLTQAQIISVLDSCQKGEYTIACTKVFEMTHNSASADLEIGEQTHIAHPNLYFERSRQLQKKQQKLEKEKLFNNGNH

SEQ ID NO: 22257 - protein, 366 aa, Saccharomyces cerevisiae
MYHVPEMRLHYPLVNTQSNAAITPTRSYDNTLPSFNELSHQSTINLPFVQRETPNAYANVAQLATSPTQAKSGYYCRYYAVPFPTYPQQPQSPYQQAVLPYATIPNSNFQPSSFPVMAVMPPEVQFDGSFLNTLHPHTELPPIIQNTNDTSVARPNNLKSIAAASPTVTATTRTPGVSSTSVLKPRVITTMWEDENTICYQVEANGISVVRRADNNMINGTKLLNVTKMTRGRRDGILRSEKVREVVKIGSMHLKGVWIPFERAYILAQREQILDHLYPLFVKDIESIVDARKPSNKASLTPKSSPAPIKQEPSDNKHEIATEIKPKSIDALSNGASTQGAGELPHLKINHIDTEAQTSRAKNELS

SEQ ID NO: 22258 - protein, 363 aa, Saccharomyces cerevisiae
MNGSPTPKRYSSKSSRLYDDYYNIPYQYSNPTPMNRDYNDVGSRINADKLVPEEYKRNTEFINKAVQQNKELNFKLREKQNEIFELKKIAETLRSKLEKYVDITKKLEDQNLNLQIKISDLEKKLSDANSTFKEMRFPKVKDPMVDDDPVSENYDQINVPKHRAPDATGNPRTTNKVSNTSDQDSRLKAIERTLSVLTNYVMRSEDGNNDRMSPLPSPLNTILPINNRLNFQEPKRYNPTVKVNPSDDDIMMYESAELKRVEEEIEELKRKILVRKKHDLRKLSLNNQLQELQSMMDGDDNIKLDNVSKHNHATHRHSSQSSRDYSPSSDACLECSNDLYEKNRVKPENNMSETFATPTPNNR

SEQ ID NO: 22259 - protein, 1170 aa, Saccharomyces cerevisiae
MNELNTVSTNSSDSTKNGGTSNSPDDMDSAAAASHAIKKRTKASRACDQCRKKKIKCDYKDEKGVCSNCQRNGDRCSFDRVPLKRGPSKGYTRSTSHPRTNEIQDHNNSRSYNTFDNSNNTLNNNTGNSGDNGINSNTVPSTPSRSNSVLLPPLTQYIPQAGGIPPSFQNPAIQSTMPAGNIGQQQFWKVPYHEFQHQRKGSIDSLQSDISVRTLNPNEQLSYNTVQQSPITNKHTNDSGNANGSVTGSGSASGSGGYWSFIRTSGLLAPTDDHNGEQTRRSSSIPSLLRNTSNSLLLGGQPQLPPPQQQSQPQAHQQKLQQGQNLYSYSQFSQQQPYNPSISSFGQFAANGFHSRQGSVASEAMSPSAPAMFTSTSTNPVNVAQQTQRPQGQQVPQFSSELDGNKRRQSAPVSVTLSTDRLNGNENNNGEINNNNGSNNSGSSKDTSQHSQESVTTPAALEASSPGSTPQRSTKKRRKSYVSKKTKPKRDSSISITSKDSAHPMTTSSTIAYGQISDVDLIDTYYEFIHVGFPIIPLNKTTLTSDLLLVNTQPISNIHEVNSYVILWFRNSLELLVRVALKQKPGGKFFDNIVGVALSPSNDNNKAGFTTATARDDAEKTRRDSHNEVQDTLEVQSVFIAALNECFQKIVDIHPKFRENNDQISPKIKVIYLSTFILLNYILAFVGYDNSFVLGMSVTIFNEFKLYKLLLFPEPDINDVKPPVDEEVSTGNGNTKTSEFEIGSESAGHMNPSNSPNSMDENISHYSVLFKRLYVLLSVFDSLQSCAFGGPKLLNISIQGSTERFFSNDLGSKWCLEQSQLRLKSVLQSLKLGELMSELTRNRISMNGNRKPGFDITNSSSLLSEYVETQPLSVAQLFCKLLIGKHNFINCLLSLYDSEAGVYSDLTLDLSSKIADSLCSLISIILQVLTLILRLNPTNSIDFNYRPPNPPANNPTVQEGPSAMGSSPVAGNLSAAPPSEGNPDFYKKLLGLKQDTGTILSDLCRGIISPFAIAILHEVYNITELVKQMPTSLISIMMTATTTQNTQDTKKSQDLVMKLSNSMNEVVQITSVLTMIKPFKIFEHELNKPIMSLTGGLSSTTRNDVMWPKSGQGLRESSVMKTLLDERRTSGTQPTTAPVAAEEPRLENVALENFVSIGWKLLDDSELGWY

SEQ ID NO: 22260 - protein, 499 aa, Saccharomyces cerevisiae
MSTKKHTKTHSTYAFESNTNSVAASQMRNALNKLADSSKLDDAARAKFENELDSFFTLFRRYLVEKSSRTTLEWDKIKSPNPDEVVKYEIISQQPENVSNLSKLAVLKLNGGLGTSMGCVGPKSVIEVREGNTFLDLSVRQIEYLNRQYDSDVPLLLMNSFNTDKDTEHLIKKYSANRIRIRSFNQSRFPRVYKDSLLPVPTEYDSPLDAWYPPGHGDLFESLHVSGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLIESSNLEMEIIPNQKTITRDGHEINVLQLETACGAAIRHFDGAHGVVVPRSRFLPVKTCSDLLLVKSDLFRLEHGSLKLDPSRFGPNPLIKLGSHFKKVSGFNARIPHIPKIVELDHLTITGNVFLGKDVTLRGTVIIVCSDGHKIDIPNGSILENVVVTGNLQILEH

SEQ ID NO: 22261 - protein, 669 aa, Saccharomyces cerevisiae
MLRTRLSVSVAARSQLTRSLTASRTAPLRRWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRRHIKELVPIIYTPTEGDAIAAYSHRFRKPEGVFLDITEPDSIECRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 22262 - protein, 840 aa, Saccharomyces cerevisiae
MKFCLYCCHCYIVICGKATHYYKSSKATSNLKSSNRVLMRNPMSPSEQHSQHNSTLAASPFVSNVSAARTQQSLPTDAQNDRLQQPWNRTNTATSPYQSLANSPLIQKLQANIMTPHQPSANSNSNSNSITGNVVNDNNLLASMSKNSMFGSTIPSTLRKVSLQREYKDSVDGVVRDEDNDEDVHNNGDAAANANNDRESKLGHNGPLTTTTLTTTTTATQLDVSELSAIERLRLWRFDALMQHMYRTAEYIADKVYNISNDPDDAFWLGQVYYNNNQYVRAVELITRNNLDGVNILCRYLLGLSFVKLQRFDDALDVIGEYNPFSEDPSTTAANTMSNNGNNSNTSQPVTDGGIKMESSLCFLRGKIYFAQNNFNKARDAFREAILVDIKNFEAFEMLLSKNLLTPQEEWDLFDSLDFKEFGEDKEIMKNLYKINLSKYINTEDITKSNEILAKDYKLADNVDVVRSKVDICYTQCKFNECLELCETVLENDEFNTNILPAYIGCLYELSNKNKLFLLSHRLAETFPKSAITWFSVATYYMSLDRISEAQKYYSKSSILDPSFAAAWLGFAHTYALEGEQDQALTAYSTASRFFPGMHLPKLFLGMQFMAMNSLNLAESYFVLAYDICPNDPLVLNEMGVMYFKKNEFVKAKKYLKKALEVVKDLDPSSRTTISIQLNLGHTYRKLNENEIAIKCFRCVLEKNDKNSEIHCSLGYLYLKTKKLQKAIDHLHKSLYLKPNNSSATALLKNALELNVTLSLDASHPLIDKSNLMSQASKDKASLNKKRSSLTYDPVNMAKRLRTQKEIFDQNNKALRKGGHDSKTGSNNADDDFDADMELE

SEQ ID NO: 22263 - protein, 316 aa, Saccharomyces cerevisiae
MEEYDYSDVKPLPIETDLQDELCRIMYTEDYKRLMGLARALISLNELSPRALQLTAEIIDVAPAFYTIWNYRFNIVRHMMSESEDTVLYLNKELDWLDEVTLNNPKNYQIWSYRQSLLKLHPSPSFKRELPILKLMIDDDSKNYHVWSYRKWCCLFFSDFQHELAYASDLIETDIYNNSAWTHRMFYWVNAKDVISKVELADELQFIMDKIQLVPQNISPWTYLRGFQELFHDRLQWDSKVVDFATTFIGDVLSLPIGSPEDLPEIESSYALEFLAYHWGADPCTRDNAVKAYSLLAIKYDPIRKNLWHHKINNLN

SEQ ID NO: 22264 - protein, 683 aa, Saccharomyces cerevisiae
MNKELASKFLSSIKHEREQDIQTTSRLLTTLSIQQLVQNGLAINNIHLENIRSGLIGKLYMELGPNLAVNDKIQRGDIKVGDIVLVRPAKTKVNTKTKPKVKKVSEDSNGEQAECSGVVYKMSDTQITIALEESQDVIATTFYSYSKLYILKTTNVVTYNRMESTMRKLSEISSPIQDKIIQYLVNERPFIPNTNSFQNIKSFLNPNLNDSQKTAINFAINNDLTIIHGPPGTGKTFTLIELIQQLLIKNPEERILICGPSNISVDTILERLTPLVPNNLLLRIGHPARLLDSNKRHSLDILSKKNTIVKDISQEIDKLIQENKKLKNYKQRKENWNEIKLLRKDLKKREFKTIKDLIIQSRIVVTTLHGSSSRELCSLYRDDPNFQLFDTLIIDEVSQAMEPQCWIPLIAHQNQFHKLVLAGDNKQLPPTIKTEDDKNVIHNLETTLFDRIIKIFPKRDMVKFLNVQYRMNQKIMEFPSHSMYNGKLLADATVANRLLIDLPTVDATPSEDDDDTKIPLIWYDTQGDEFQETADEATILGSKYNEGEIAIVKEHIENLRSFNVPENSIGVISPYNAQVSHLKKLIHDELKLTDIEISTVDGFQGREKDVIILSLVRSNEKFEVGFLKEERRLNVAMTRPRRQLVVVGNIEVLQRCGNKYLKSWSEWCEENADVRYPNIDDYL

SEQ ID NO: 22265 - protein, 174 aa, Saccharomyces cerevisiae
MSLAKSAANKLDWAKVISSLRITGSTATQLSSFKKRNDEARRQLLELQSQPTEVDFSHYRSVLKNTSVIDKIESYVKQYKPVKIDASKQLQVIESFEKHAMTNAKETESLVSKELKDLQSTLDNIQSARPFDELTVDDLTKIKPEIDAKVEEMVKKGKWDVPGYKDRFGNLNVM

SEQ ID NO: 22266 - protein, 268 aa, Saccharomyces cerevisiae
MSSSKFEEVINKIINDSPPGELREVYDDLIKITSENSKNTILDAIENYNVQNCIPIEVNGNSVIISKYNKEGAKFFDPVNSVIFSVNHLERKGLDIEPYEFTHAKIEKGQLKELHDKLHEYLLQSFPGDVSFAVYPVPEEISKISIIIVSTKYNPNNFWNGHWRSSYIYDLETRELSGQISTQVHYYEDGNVSFQSGKDINQSNVDDVVCTIRDIETNFENDLDLSFFDLNEKQFKALRRRLPVTRSKINWGSAIGSYRLGKNAAEGK

SEQ ID NO: 22267 - protein, 202 aa, Saccharomyces cerevisiae
MATNITWHPNLTYDERKALRKQDGCTIWLTGLSASGKSTIACALEQLLLQKNLSAYRLDGDNIRFGLNKDLGFSEKDRNENIRRISEVSKLFADSCAISITSFISPYRVDRDRARELHKEAGLKFIEIFVDVPLEVAEQRDPKGLYKKAREGVIKEFTGISAPYEAPKAPELHLRTDQKTVEECATIIYEYLISEKIIRKHL

SEQ ID NO: 22268 - protein, 704 aa, Saccharomyces cerevisiae
MDEHLISTINKLQDALAPLGGGSQSPIDLPQITVVGSQSSGKSSVLENIVGRDFLPRGTGIVTRRPLVLQLINRRPKKSEHAKVNQTANELIDLNINDDDKKKDESGKHQNEGQSEDNKEEWGEFLHLPGKKFYNFDEIRKEIVKETDKVTGANSGISSVPINLRIYSPHVLTLTLVDLPGLTKVPVGDQPPDIERQIKDMLLKYISKPNAIILSVNAANTDLANSDGLKLAREVDPEGTRTIGVLTKVDLMDQGTDVIDILAGRVIPLRYGYIPVINRGQKDIEHKKTIREALENERKFFENHPSYSSKAHYCGTPYLAKKLNSILLHHIRQTLPEIKAKIEATLKKYQNELINLGPETMDSASSVVLSMITDFSNEYAGILDGEAKELSSQELSGGARISYVFHETFKNGVDSLDPFDQIKDSDIRTIMYNSSGSAPSLFVGTEAFEVLVKQQIRRFEEPSLRLVTLVFDELVRMLKQIISQPKYSRYPALREAISNQFIQFLKDATIPTNEFVVDIIKAEQTYINTAHPDLLKGSQAMVMVEEKLHPRQVAVDPKTGKPLPTQPSSSKAPVMEEKSGFFGGFFSTKNKKKLAALESPPPVLKATGQMTERETMETEVIKLLISSYFSIVKRTIADIIPKALMLKLIVKSKTDIQKVLLEKLYGKQDIEELTKENDITIQRRKECKKMVEILRNASQIVSSV

SEQ ID NO: 22269 - protein, 900 aa, Saccharomyces cerevisiae
MPGNLSFKDRVVVITGAGGGLGKVYALAYASRGAKVVVNDLGGTLGGSGHNSKAADLVVDEIKKAGGIAVANYDSVNENGEKIIETAIKEFGRVDVLINNAGILRDVSFAKMTEREFASVVDVHLTGGYKLSRAAWPYMRSQKFGRIINTASPAGLFGNFGQANYSAAKMGLVGLAETLAKEGAKYNINVNSIAPLARSRMTENVLPPHILKQLGPEKIVPLVLYLTHESTKVSNSIFELAAGFFGQLRWERSSGQIFNPDPKTYTPEAILNKWKEITDYRDKPFNKTQHPYQLSDYNDLITKAKKLPPNEQGSVKIKSLCNKVVVVTGAGGGLGKSHAIWFARYGAKVVVNDIKDPFSVVEEINKLYGEGTAIPDSHDVVTEAPLIIQTAISKFQRVDILVNNAGILRDKSFLKMKDEEWFAVLKVHLFSTFSLSKAVWPIFTKQKSGFIINTTSTSGIYGNFGQANYAAAKAAILGFSKTIALEGAKRGIIVNVIAPHAETAMTKTIFSEKELSNHFDASQVSPLVVLLASEELQKYSGRRVIGQLFEVGGGWCGQTRWQRSSGYVSIKETIEPEEIKENWNHITDFSRNTINPSSTEESSMATLQAVQKAHSSKELDDGLFKYTTKDCILYNLGLGCTSKELKYTYENDPDFQVLPTFAVIPFMQATATLAMDNLVDNFNYAMLLHGEQYFKLCTPTMPSNGTLKTLAKPLQVLDKNGKAALVVGGFETYDIKTKKLIAYNEGSFFIRGAHVPPEKEVRDGKRAKFAVQNFEVPHGKVPDFEAEISTNKDQAALYRLSGDFNPLHIDPTLAKAVKFPTPILHGLCTLGISAKALFEHYGPYEELKVRFTNVVFPGDTLKVKAWKQGSVVVFQTIDTTRNVIVLDNAAVKLSQAKSKL

SEQ ID NO: 22270 - protein, 234 aa, Saccharomyces cerevisiae
MLQFKLVLLGDSSVGKSSIVHRFVKDTFDELRESTIGAAFLSQSITIHPNDGNETKDVVIKFEIWDTAGQERYKSLAPMYYRNANAALVVYDITQEDSLQKARNWVDELKNKVGDDDLVIYLLGNKVDLCQETPSTETSPDSNEGGDEEQKVRAISTEEAKQYAQEQGLLFREVSAKTGEGVKEIFQDIGEKLYDLKKDEILSKQNRQIGGGNNGQVDINLQRPSTNDPTSCCS

SEQ ID NO: 22271 - protein, 742 aa, Saccharomyces cerevisiae
MSDEDSMLLNFTTNEDTAGSSYKQAAKVTGGRWKDRRRMKMKLEGKTVSRKRKANTTGDEGIIPGRGENSIKKLHKESSYSSEEQEKYKGRNAHNTQGRTLPADSQFVSSLFTSNREITTAVNTNIHDENVAINPSNAPLKGDQFASLGVSSLLVSHLEQKMRIKKPTSIQKQAIPQIIGNAGKNDFFIHAQTGSGKTLSYLLPIISTILNMDTHVDRTSGAFALVIAPTRELASQIYHVCSTLVSCCHYLVPCLLIGGERKKSEKARLRKGCNFIIGTPGRVLDHLQNTKVIKEQLSQSLRYIVLDEGDKLMELGFDETISEIIKIVHDIPINSEKFPKLPHKLVHMLCSATLTDGVNRLRNVALKDYKLISNGTKKDSDIVTVAPDQLLQRITIVPPKLRLVTLAATLNNITKDFIASGQQSKTLRTIVFVSCSDSVEFHYDAFSGSDGHHKNLTGDSVRLLTKGNTMFPCFSDSRDPDVVIYKLHGSLSQQMRTSTLQHFARDNEATKGKHLIMFCTDVASRGLDLPHVGSVIELDPPFAVEDHLHRVGRTARAGEKGESLLFLLPGEEEKYMDYIQPYHPMGWELLKFDKEILMPAFKDVNVNRNDKFIRKDEKSSKNKDVGDKEYEWDTNATTWHLNIERRVVGDSAFKNLAVKGFISHVRAYATHISQEKKFFNVKFLHLGHLAKSFGLRERPKAMGLQSSKDGNSEKKPTKENSKNKMFRMARMAEKQIASEFNY

SEQ ID NO: 22272 - protein, 1098 aa, Saccharomyces cerevisiae
MSGSFWKFGQDYSIESPVSKILNSAFIKINKDQDDDVPTGTCEENIADDEDNSSHDYAASEDNVVNENEEKEEENTLPTTESEYENYRPNLDVLDDLLDDDELYTELMCSNFKLLIFLKYPDVLSKLIEYVTNEKILDEETDSAKKPEIIEGVNDHPILIERDRKDKKEDAEEGGDSEETTNDSDHDSGDERSVDSEETSITLPPESEEQVETRRARIAAEILSADVWPISAAIMQNKDLLGRLWSILDHPAPLPIPASTYFMKINERLLDMDITGMLEFILSRDSLVARFLTHVDNPSLMDFLLKVISTDKPDSPTGVIKILKSQELIPKLLDHLNPEYGISTQSAAGDFIKAFVTLSTNSSNELASGIGPNELTRQLVSEEMIEKLIKIMLKGGTSLSNGVGIIIELIRKNNSDYDFIQLVYTTLESHPPTDRDPIHLIHLVKLFAKHMPDFADMLDKTKLPLMEMPFGNIEPLGFERFKICELIAELLHCSNMTLLNEPNGEMIAQERDIERAKELETSTEKENITAIVDNKSSYYDKDCVEKDITENLGALQINNQGSEEDELNDTGVSSVKLDVKSDAKVVEGLENDASGVELYDETLSDTESVRECLREKPLVGDRLKIALEDTKILISILDMFTEFPWNNFLHNVIFDIAQQIFNGPLKTGYNRFLLKDYLVDAYLTKKIVDADKACQDYEKKTGLRYGYMGHLTLVAEEISKFKEYIDEMKLTFCNTAVSDRLEEPFWKEYSETILADTREKYNTVLGDFGNDQESDDDVIRNSDSEDIIGDTEGNENYGNGENDELLSNGHDSGNMDLYYNFNNNENEENEEDYAEYSDVDNKNYYNNVETNDDDYDSDDGKSKSAESEFTDKISEHRDGNSLYNEDNDENGSDKWTSGTSLFPPDHFPSRSQPSDPKLQDQNIFHHQFDFEGVGDDDDYMDPNDDGQSYARPGNPLYTTPKTPPRPKTILFNSLSALDNNGEDEEVALGTSVDDRMDNEISSDEEDSEMKMKRMIWAMRRATHYIGQEVKKLSELKHSHCHIFTLYSSIFYCSTFFAYRSFIIHQIYTFLIEACNLILTEYNLIKNNEYSLLNILKFI

SEQ ID NO: 22273 - protein, 1683 aa, Saccharomyces cerevisiae
MSNVSTASGTHFAPPQADRSVTEEVDRVNSRPDELENQEVLRQLPENGNLTSSLQREKRRTPNGKEAERKHALPKSFVDRNLSDVSPNHSLDHIMHSNEHDPRRGSDEENMHRLYNNLHSSNNNVHSKRNSKREEERAPQRRSSSVAYTQQQFNGWKKEFGHAFKKISAIGRLKSSVNSPTPAGSGHRHNQHQHQQVNEEDLYTQRLASDLLDSLLAGCPASLFASTQFLRDEHGKRRAPLLLAKLDVRVSPLKNDNNILDITNSNHNHRGNNNNNTGENSDRRPSIPRSSSIISISSNVAEFMYSRNENSLFRIHLEYGIDEDRLKWSIIRSYKDIKSLHHKLKIVAFQQLTISKLYSDNNRYHSLQLPHFPHYKEMVKERNVMEKKAENKPSSAASAPHTSENNNNDNGSNITSLETLSSSEISEFNIDNVKMKHLQDLIDEPDDFSQPIHLRLERYLRLLNIALCLRPHANRLFEFYELSPLGNLLSRESGFQGKQGYLVIRSTAKAQGWRVSHFGKHAFKDMIDRHTTKWFLVRNSYLTYVSDLSSTTPLDVFLIDWKFKVRFSGNKNNILDNENEINWIIHDPNLEINDELEEFGIENDANNILDKNGKSKTHQKKSNISSKLLLLTLENSERKLKIICKSESSLKQWMSSIIKMSTSTPWSKPNRFGSFAPVRTNSFCKFLVDGRDYFWSLSEALLMAKDVIYIHDWWLSPELYLRRPVKGNQGFRIDRMLKSCAEKGIKIFIVIYRNVGNIVGTDSLWTKHSMLNLHPNIHIIRSPNQWLQNTYFWAHHEKFVVIDETFAFIGGTDLCYGRYDTFEHVLRDDAESLLDQNFPGKDYSNARIADFHDLDKPFESMYDRKVIPRMPWHDVQMMTLGEPARDLARHFVQRWNYLLRAKRPSRLTPLLTPPSDLTAEELKSLPMFEILREKSTCETQILRSAGNWSLGLKETECSIQNAYLKLIEQSEHFIYIENQFFITSTVWNGTCVLNKIGDALVDRIVKANQEKKPWKAFILIPLMPGFDSPVDTAEASSLRLIMQFQYQSISRGEHSTFSKLKKLNIDPAQYIQFFSLRKWSTFAPNERLITEQLYVHAKILIADDRRCIIGSANINERSQLGNRDSEVAILIRDTDLIKTKMNGDDYYAGKFPWELRQRLMREHLGCDVDLVEFVEKKFERFEKFAAKNYEKLHTLSKEGDSGNNWSDREMIDSAMIELGYREIFGCKFSPQWKSGHGNSVDDGSTQCGINEKEVGREDENVYEKFFNSVDYGKSSRKRTPLPKHNFASLGLTFNHRAGIENVGIRDHKVLSTDPRLRKNDEHKKEVDGYGPDCWKKESNKKFKADATEQLKEWALNSLASKVLDDKEMIKSEIPEGFSNYLPNEKDLEMYLTDKTVTNRNKWSMLKRICYLQYLSHKLDERKTQRLKKIKDMRRHLSSSTESTRNGSNSLPLNEKSNEGESTNVDQDIEGDEYHRLHEDILKNQELDDGSLDDLLSQIIPKITNFNSGEIDDAKKEELLKLNFIDPYSFEDPLISSFSEGLWFTIALRNTLLYKLVFHCQPDNAVQNWKEYGEFTELEQEFQINQEKLIDLEAENINSTTTNVVDKDREKEKMRKAAELRMKLSGSLLYGFNQKVFDKHTAQRILERIHGHLVIFPTEWLAKEVESRNWIFNSDRLSPMEIYN

SEQ ID NO: 22274 - protein, 659 aa, Saccharomyces cerevisiae
MTYKITTSESKKEYLYMGSGDTRGESSLVAKPIEIILNKLPHAILAQQQFQKYITSPIYRYLSKLLLFREVAWPESTKDTQKGQVGIFSFQNNYADSATTFRILAHLDEHGYPLPNGAAEKNLPSLFEGFKATVSIIQQRLLLDNVDGATNSDKEKYVQLPDINTGFVNKTYSRIDLTHLLEDVETNVENLSINKTLEMDELTRLDSMINELESRKLKILERVKHIDSKSTNLENDVTLIKDRINFIEEYNLEADREQSLRKQMEEERSSEASSFTQNEEAISSLCDVESKDTRLKDFYKMPHEKSHDKNRQIISETYSRNTTAFRMTIPHGEHGNSITALDFDTPWGTLCSSSYQDRIVKVWDLNHGIQVGELPGHLATVNCMQIDKKNYNMLITGSKDATLKLWDLNLSREIYLDHSPLKEKTEEIVTPCIHNFELHKDEITALSFDSEALVSGSRDKKIFHWDLTTGKCIQQLDLIFTPTHSDIKMPARSLNNGACLLGTEAPMIGALQCYNSALATGTKDGIVRLWDLRVGKPVRLLEGHTDGITSLKFDSEKLVTGSMDNSVRIWDLRTSSILDVIAYDLPVSSLDFDGKLITVGANEGGVNVFNMERDEHWMTPEPPHSLDGDELSRRIAIVKYKDGFLINGHNDGDINVWTL

SEQ ID NO: 22275 - protein, 602 aa, Saccharomyces cerevisiae
MSNTSSYEKNNPDNLKHNGITIDSEFLTQEPITIPSNGSAVSIDETGSGSKWQDFKDSFKRVKPIEVDPNLSEAEKVAIITAQTPLKHHLKNRHLQMIAIGGAIGTGLLVGSGTALRTGGPASLLIGWGSTGTMIYAMVMALGELAVIFPISGGFTTYATRFIDESFGYANNFNYMLQWLVVLPLEIVSASITVNFWGTDPKYRDGFVALFWLAIVIINMFGVKGYGEAEFVFSFIKVITVVGFIILGIILNCGGGPTGGYIGGKYWHDPGAFAGDTPGAKFKGVCSVFVTAAFSFAGSELVGLAASESVEPRKSVPKAAKQVFWRITLFYILSLLMIGLLVPYNDKSLIGASSVDAAASPFVIAIKTHGIKGLPSVVNVVILIAVLSVGNSAIYACSRTMVALAEQRFLPEIFSYVDRKGRPLVGIAVTSAFGLIAFVAASKKEGEVFNWLLALSGLSSLFTWGGICICHIRFRKALAAQGRGLDELSFKSPTGVWGSYWGLFMVIIMFIAQFYVAVFPVGDSPSAEGFFEAYLSFPLVMVMYIGHKIYKRNWKLFIPAEKMDIDTGRREVDLDLLKQEIAEEKAIMATKPRWYRIWNFWC

SEQ ID NO: 22276 - protein, 450 aa, Saccharomyces cerevisiae
MCFLLETSASPRSKLSKDFKPQFTLLSSVTKKKKKKVRPHNFQCIHSLNFVYFLFIHSFLFEYNQLLVLPLNKNLPSLNFSRNSSMKLSALLALSASTAVLAAPAVHHSDNHHHNDKRAVVTVTQYVNADGAVVIPAATTATSAAADGKVESVAAATTTLSSTAAAATTSAAASSSSSSSSSSSSSSSVGSGDFEDGTISCSDFPSGQGAVSLDWLGLGGWASIMDMNGNTATSCQDGYYCSYACSPGYAKTQWPSEQPSDGRSVGGLYCKNGKLYRSNTDTNSLCVEGQGSAQAVNKVSGSIAICGTDYPGSENMVVPTVVGAGSSQPINVIKEDSYYQWQGKKTSAQYYVNNAGVSVEDGCIWGTEGSGVGNWAPVVLGAGYTDGITYLSIIPNPNNKEAPNFNIKIVATDGSTVNGACSYENGVYSGSGSDGCTVSVTSGSANFVFY

SEQ ID NO: 22277 - protein, 304 aa, Saccharomyces cerevisiae
MNTSELSIAEEIDYEALPSHAPLHSQLLAGAFAGIMEHSLMFPIDALKTRVQAAGLNKAASTGMISQISKISTMEGSMALWKGVQSVILGAGPAHAVYFGTYEFCKARLISPEDMQTHQPMKTALSGTIATIAADALMNPFDTVKQRLQLDTNLRVWNVTKQIYQNEGFAAFYYSYPTTLAMNIPFAAFNFMIYESASKFFNPQNSYNPLIHCLCGGISGATCAALTTPLDCIKTVLQVRGSETVSIEIMKDANTFGRASRAILEVHGWKGFWRGLKPRIVANIPATAISWTAYECAKHFLMKN

SEQ ID NO: 22278 - protein, 4092 aa, Saccharomyces cerevisiae
MCKNEARLANELIEFVAATVTGIKNSPKENEQAFIDYLHCQYLERFQFFLGLLDGREFDTLFVFLFEELDRTIVTIDIGEEAIYDANLANKKYSTLLIIKSRSVIVDAEPIATQISAIYLPGPVNAGNLASIITHGVSSVFGQLIKSDTKTYSVETIDKTRRKLDDISKQFQQLHTSIETPDLLAMVPSIIKLAVSKGATSHDYANYLPSNDLESMRFLNILQSIANKWFLVLKQTLAIDRDIKNGSFLDEVEFWSNFYEVLKSLIEQTQSQEFQVCLSVLTNAKRFHNLTNLLNEGSLSDKFKLADKYNQFLSSIPIDEVRQASNLEDLQELFPVLASSLKKFRYSGYPVQRFVVLMDKISQEVMDAILSNLSDLFQLEYGSFLGLYEKSAGMIEEWDDIVQDVNLLIREDLRKRAPQELLIQKLTFTSASVKATLDEILSTRKRFFSLAETIKSISPSTYHEEIQRLYHPFEQIHDISVNFRLKLEQAESEFSKNMLDLEKKLQNTLASFMDSDHCPTEKLSYLVKFKPLMELCPRIKVKVLENQQILLLEIKKDIRQLETGLELLPKILHVEALNNIPPISARISYFLNVQSRIDNIVQYLEALFGSNWNDTLEGRSISTSIVQLRKETNPHDVFLHWLGNFPEKATANLLTTPILKLIRNNEDDYELKVNFDFALAAAYSELRSLTYMAFQVPSHIVRIARTYMYLYPRAINLVELIQTFFSLSKSLSYTFYTNIFLKRNVQTVWLLLQQILITPWESLQEESSEMSCSVHSLARLEKSIDGILSDYQILKNSEPQFAKEFSGLKSFDGTADDLHEVEEIISNIQAIFENLFTKGLTNVSDHISTFNNLIISIILEKVRLNLKKMHFPKHVLKLSFNEGRITSSPSLAAMKRSLLKDIEALLNKVVLINFLHDPDHPLSTTLTFNSLVIKLKDDIQNCIEQVQNLHCKINSYVKEWQKMEFLWQITEEAFLEVVDNSTQRCFGILKGLLDSQSKFDLIISRNNFSKNLVLHTEDAQRHIRSKMDSWILYVSKHLLTIYERDARKLHEDMNRDREAVEDMDINFTSLKNITVIIEAVNVNKRHLTERDIQIKLLGSVMRALTKLKVRFPSHFVYIDQLDNDFSSLRQSLSYVEQELQKHRVVIAKSLEEGVENINNLSQSLNESWSVRKPISPTLTPPEALKILEFFNESITKLKKKMHSVAAAAKMLLIPVVLNDQLTHVVEEVKTYDLVWRSIKNLWEDVQRTFETPWCRVDVLLLQSDLANFLRRADELPRAVKQFEMYKSLFSQVNMLTSVNKILVELKDGALKPRHWNMIFRDIGKRQIQKNLLDKLEFSLKDVMVLNLTLNEILLTKIIERAQKEFVIEKSLNRIKKFWKEAQYEVIEHSSGLKLVREWDVLEQACKEDLEELVSMKASNYYKIFEQDCLDLESKLTKLSEIQVNWVEVQFYWLDLYGILGENLDIQNFLPLETSKFKSLTSEYKMITTRAFQLDTTIEVIHIPNFDTTLKLTIDSLKMIKSSLSTFLERQRRQFPRFYFLGNDDLLKIIGSGKHHDQVSKFMKKMFGSIESIIFLEDFITGVRSVEGEVLNLNEKIELKDSIQAQEWLNILDTEIKLSVFTQFRDCLGQLKDGTDIEVVVSKYIFQAILLSAQVMWTELVEKCLQTNQFSKYWKEVDMKIKGLLDKLNKSSDNVKKKIEALLVEYLHFNNVIGQLKNCSTKEEARLLWAKVQKFYQKNDTLDDLNSVFISQSGYLLQYKFEYIGIPERLIYTPLLLIGFATLTDSLHQKYGGCFFGPAGTGKTETVKAFGQNLGRVVVVFNCDDSFDYQVLSRLLVGITQIGAWGCFDEFNRLDEKVLSAVSANIQQIQNGLQVGKSHITLLEEETPLSPHTAVFITLNPGYNGRSELPENLKKSFREFSMKSPQSGTIAEMILQIMGFEDSKSLASKIVHFLELLSSKCSSMNHYHFGLRTLKGVLRNCSPLISEFGEGEKTVVESLKRVILPSLGDTDELVFKDELSKIFDSAGTPLNSKAIVQCLKDAGQRSGFSMSEEFLKKCMQFYYMQKTQQALILVGKAGCGKTATWKTVIDAMAIFDGHANVVYVIDTKVLTKESLYGSMLKATLEWRDGLFTSILRRVNDDITGTFKNSRIWVVFDSDLDPEYVEAMNSVLDDNKILTLPNGERLPIPPNFRILFETDNLDHTTPATITRCGLLWFSTDVCSISSKIDHLLNKSYEALDNKLSMFELDKLKDLISDSFDMASLTNIFTCSNDLVHILGVRTFNKLETAVQLAVHLISSYRQWFQNLDDKSLKDVITLLIKRSLLYALAGDSTGESQRAFIQTINTYFGHDSQELSDYSTIVIANDKLSFSSFCSEIPSVSLEAHEVMRPDIVIPTIDTIKHEKIFYDLLNSKRGIILCGPPGSGKTMIMNNALRNSSLYDVVGINFSKDTTTEHILSALHRHTNYVTTSKGLTLLPKSDIKNLVLFCDEINLPKLDKYGSQNVVLFLRQLMEKQGFWKTPENKWVTIERIHIVGACNPPTDPGRIPMSERFTRHAAILYLGYPSGKSLSQIYEIYYKAIFKLVPEFRSYTEPFARASVHLYNECKARYSTGLQSHYLFSPRELTRLVRGVYTAINTGPRQTLRSLIRLWAYEAWRIFADRLVGVKEKNSFEQLLYETVDKYLPNQDLGNISSTSLLFSGLLSLDFKEVNKTDLVNFIEERFKTFCDEELEVPMVIHESMVDHILRIDRALKQVQGHMMLIGASRTGKTILTRFVAWLNGLKIVQPKIHRHSNLSDFDMILKKAISDCSLKESRTCLIIDESNILETAFLERMNTLLANADIPDLFQGEEYDKLLNNLRNKTRSLGLLLDTEQELYDWFVGEIAKNLHVVFTICDPTNNKSSAMISSPALFNRCIINWMGDWDTKTMSQVANNMVDVIPMEFTDFIVPEVNKELVFTEPIQTIRDAVVNILIHFDRNFYQKMKVGVNPRSPGYFIDGLRALVKLVTAKYQDLQENQRFVNVGLEKLNESVLKVNELNKTLSKKSTELTEKEKEARSTLDKMLMEQNESERKQEATEEIKKILKVQEEDIRKRKEVVMKSIQDIEPTILEAQRGVKNIKKQQLTEIRSMVNPPSGVKIVMEAVCAILGYQFSNWRDIQQFIRKDDFIHNIVHYDTTLHMKPQIRKYMEEEFLSDPNFTYETINRASKACGPLYQWVNAQINFSKVLENVDPLRQEMKRIEFESLKTKANLLAAEEMTQDLEASIEVSKRKYSLLIRDVEAIKTEMSNVQANLDRSISLVKSLTFEKERWLNTTKQFSKTSQELIGNCIISSIYETYFGHLNERERADMLVILKRLLGKFAVKYDVNYRFIDYLVTLDEKMKWLECGLDKNDYFLENMSIVMNSQDAVPFLLDPSSHMITVISNYYGNKTVLLSFLEEGFVKRLENAIRFGSVVIIQDGEFFDPIISRLISREFNHAGNRVTVEIGDHEVDVSGDFKLFIHSCDPSGDIPIFLRSRVRLVHFVTNKESIETRIFDITLTEENAEMQRKREDLIKLNTEYKLKLKNLEKRLLEELNNSQGNMLENDELMVTLNNLKKEAMNIEKKLSESEEFFPQFDNLVEEYSIIGKHSVKIFSMLEKFGQFHWFYGISIGQFLSCFKRVFIKKSRETRAARTRVDEILWLLYQEVYCQFSTALDKKFKMIMAMTMFCLYKFDIESEQYKEAVLTMIGVLSESSDGVPKLTVDTNNDLRYLWDYVTTKSYISALNWFKNEFFVDEWNIADVVANSENNYFTMASERDVDGTFKLIELAKASKESLKIIPLGSIENLNYAQEEISKSKIEGGWILLQNIQMSLSWVKTYLHKHVEETKAAEEHEKFKMFMTCHLTGDKLPAPLLQRTDRFVYEDIPGILDTVKDLWGSQFFTGKISGVWSVYCTFLLSWFHALITARTRLVPHGFSKKYYFNDCDFQFASVYLENVLATNSTNNIPWAQVRDHIATIVYGGKIDEEKDLEVVAKLCAHVFCGSDNLQIVPGVRIPQPLLQQSEEEERARLTAILSNTIEPADSLSSWLQLPRESILNYERLQAKEVASSTEQLLQEM

SEQ ID NO: 22279 - protein, 291 aa, Saccharomyces cerevisiae
MNTLLFKRKGGNCGNESNIVSQGSPSSSNLPESPGTLDEKNLPRLPTPFARSLSTIPSYEQMKRTNKLPDYHLKIVVVGDGAVGKTCLLISYVQGTFPTDYIPTIFENYVTNIEGPNGQIIELALWDTAGQEEYSRLRPLSYTNADVLMVCYSVGSKTSLKNVEDLWFPEVKHFCPSTPIMLVGLKSDLYEADNLSDLVEPSSAESLAKRLGAFAHIQCSARLKENIDEVFETAIHTLLSDSLYAPREPTHTIKNPFKRNTTRSDIDSSTGDTSVSISGTKRLRKNKCIIM

SEQ ID NO: 22280 - protein, 395 aa, Saccharomyces cerevisiae; identical to SEQ ID NO: 22145

SEQ ID NO: 22281 - protein, 425 aa, Saccharomyces cerevisiae
MQICKVFLTQVKKLLFVSLLFCLIAQTCWLALVPYQRQLSLDSYFFRRSREVSSRYDFTRRRHMNQTLKLSSNTYNDEPLNKTKGIKNQRENATLLMLVRNWELSGALRSMRSLEDRFNKNYQYDWTFLNDVPFDQEFIEATTAMASGRTQYALIPAEDWNRPSWINETLFEEALQLMEEKNILYGGSKSYRNMCRFNSGFFFRQKILDPYDFYFRVEPDVEYFCDFPYDPFKVMRQNNKKYGFVITMYEYEDTIPSLWEAVEEYLEETESADIDMESNAFGFVSNFDFIGKSFGVIDSNSGYNLCHFWTNFEIGDLNFFRSEKYIRFFEYLDSKGGFYYERWGDAPVHSIAASLLLKKDEIIHFDELGYKHMPFGTCPSAYYLRLQQRCLCDSNHPDNIDLNVISCLRRWWKDGSGKYFLKHDS

SEQ ID NO: 22282 - protein, 593 aa, Saccharomyces cerevisiae
MVRDLVTLPSSLPLITAGFATDQVHLLIGTGSTDSVSVCKNRIHSILNAGGNPIVVNPSSPSHTKQLQLEFGKFAKFEIVEREFRLSDLTTLGRVLVCKVVDRVFVDLPITQSRLCEEIFWQCQKLRIPINTFHKPEFSTFNMIPTWVDPKGSGLQISVTTNGNGYILANRIKRDIISHLPPNISEVVINMGYLKDRIINEDHKALLEEKYYQTDMSLPGFGYGLDEDGWESHKFNKLIREFEMTSREQRLKRTRWLSQIMEYYPMNKLSDIKLEDFETSSSPNKKTKQETVTEGVVPPTDENIENGTKQLQLSEVKKEEGPKKLGKISLVGSGPGSVSMLTIGALQEIKSADIILADKLVPQAILDLIPPKTETFIAKKFPGNAERAQQELLAKGLESLDNGLKVVRLKQGDPYIFGRGGEEFNFFKDHGYIPVVLPGISSSLACTVLAQIPATQRDIADQVLICTGTGRKGALPIIPEFVESRTTVFLMALHRANVLITGLLKHGWDGDVPAAIVERGSCPDQRVTRTLLKWVPEVVEEIGSRPPGVLVVGKAVNALVEKDLINFDESRKFVIDEGFREFEVDVDSLFKLY

SEQ ID NO: 22283 - protein, 1071 aa, Saccharomyces cerevisiae
MGHSGREERIKDIFKELTSKELTPGLLLTLQKLAQKPNTNLEQFIASCKALTKLSSNNPIIFNELLELLKNKSEEDSTGPKKIAPSINKRKKFKIQLDLDDNEDELDSPVQKKPAPTRTLFKRIDKLKAKQLRQYSPTVKDPSPNSEQQTQNGHAETKDYEPTRSEVVEEDREWYDNDDDYGNLVPEPLSELPEEAKLLPVIRNIDNDDALRNTVQLYPIPLKQRMEWIPPFLSKFALENKVPTSIIIGSISETSSQVSALSMVNPFRNPDSEFSANAKRGSKLVALRRINMEHIQQSRDNTTVLNTAMGEVLGLENNNKAKDKSNQKICDDTALFTPSKDDIKHTKEQLPVFRCRSQLLSLIRENQVVVIIGETGSGKTTQLAQYLYEEGYANDRGKSIVVTQPRRVAAISVAKRVAMEMQVPLGKEVGYSIRFEDVTDSECTKLKFVTDGILLRETLLDDTLDKYSCVIIDEAHERSLNTDILLGFFKILLARRRDLKLIITSATMNAKKFSAFFGNAPQFTIPGRTFPVQTIYTSNPVQDYVEAAVSQAVKIHLANDCSSGDILIFMTGQEDIETTFDTLQEKFLQVYSKKFGTANFEEINDIEILPIYSALPADLQFKIFQDLHGTKRKIIIATNIAETSLTIKGIRYVIDCGYSKLKVYNPKIGLDSLVITPISKANADQRSGRAGRTAPGTAYRLYTEDTFKEDMYLQTIPEIQRTNLSNTLLLLKSLDVTDELSKFPFIDKPPLQTFLSSLYELWFIGAIDTSGQLTPLGLQMAKFPLQPSLSKILLIAVRNGCSDEMLTIVSMLSVPQVFYRPKERQKEADIARNKFFIAKSDHLTLLNVFEQWRANNFSSHWCNKHFVQYKSLVRARDIRDQLLTILKSQKIPVISSGKDWDIIKKCICSGFAHQAAKITGLRNYVHLKTGVSVQLHPTSALHGLGDLPPYVVYHELLMTSKEYICCVTSVDPFWLMEYGGLLYDIKRIKNDQEATTTGLFGEHYEHTLDKVEDDIDINIRRCKDMRDSVIQELKMTDNSNKEDKKQKTKKQNILNGKENSMKPFKRRKPFF

SEQ ID NO: 22284 - protein, 128 aa, Saccharomyces cerevisiae [sequence omitted]

SEQ ID NO: 22285 - protein, 1875 aa, Saccharomyces cerevisiae
MSDHDTPMESIQNGENSDERLNAIASFFGCSLEQVKSFDGDVVKHLNDKLLQFNELKSENLKVTVSFDELKASSLKKIDGLKTEMENVIRENDKIRKERNDTFVKFESVENEKMKLSSELEFVKRKLDDLTEEKKETQSNQQRTLKILDERLKEIELVRVENNRSNSECKKLRSTIMDLETKQQGYITNDLNSRTELERKTQELTLLQSNNDWLEKELRSKNEQYLSYRQKTDKVILDIRNELNRLRNDFQMERTNNDVLKQKNNELSKSLQEKLLEIKGLSDSLNSEKQEFSAEMSLKQRLVDLLESQLNAVKEELNSIRELNTAKVIADDSKKQTPENEDLLKELQLTKEKLAQCEKECLRLSSITDEADEDNENLSAKSSSDFIFLKKQLIKERRTKEHLQNQIETFIVELEHKVPIINSFKERTDMLENELNNAALLLEHTSNEKNAKVKELNAKNQKLVECENDLQTLTKQRLDLCRQIQYLLITNSVSNDSKGPLRKEEIQFIQNIMQEDDSTITESDSQKVVTERLVEFKNIIQLQEKNAELLKVVRNLADKLESKEKKSKQSLQKIESETVNEAKEAIITLKSEKMDLESRIEELQKELEELKTSVPNEDASYSNVTIKQLTETKRDLESQVQDLQTRISQITRESTENMSLLNKEIQDLYDSKSDISIKLGKEKSSRILAEERFKLLSNTLDLTKAENDQLRKRFDYLQNTILKQDSKTHETLNEYVSCKSKLSIVETELLNLKEEQKLRVHLEKNLKQELNKLSPEKDSLRIMVTQLQTLQKEREDLLEETRKSCQKKIDELEDALSELKKETSQKDHHIKQLEEDNNSNIEWYQNKIEALKKDYESVITSVDSKQTDIEKLQYKVKSLEKEIEEDKIRLHTYNVMDETINDDSLRKELEKSKINLTDAYSQIKEYKDLYETTSQSLQQTNSKLDESFKDFTNQIKNLTDEKTSLEDKISLLKEQMFNLNNELDLQKKGMEKEKADFKKRISILQNNNKEVEAVKSEYESKLSKIQNDLDQQTIYANTAQNNYEQELQKHADVSKTISELREQLHTYKGQVKTLNLSRDQLENALKENEKSWSSQKESLLEQLDLSNSRIEDLSSQNKLLYDQIQIYTAADKEVNNSTNGPGLNNILITLRRERDILDTKVTVAERDAKMLRQKISLMDVELQDARTKLDNSRVEKENHSSIIQQHDDIMEKLNQLNLLRESNITLRNELENNNNKKKELQSELDKLKQNVAPIESELTALKYSMQEKEQELKLAKEEVHRWKKRSQDILEKHEQLSSSDYEKLESEIENLKEELENKERQGAEAEEKFNRLRRQAQERLKTSKLSQDSLTEQVNSLRDAKNVLENSLSEANARIEELQNAKVAQGNNQLEAIRKLQEDAEKASRELQAKLEESTTSYESTINGLNEEITTLKEEIEKQRQIQQQLQATSANEQNDLSNIVESMKKSFEEDKIKFIKEKTQEVNEKILEAQERLNQPSNINMEEIKKKWESEHEQEVSQKIREAEEALKKRIRLPTEEKINKIIERKKEELEKEFEEKVEERIKSMEQSGEIDVVLRKQLEAKVQEKQKELENEYNKKLQEELKDVPHSSHISDDERDKLRAEIESRLREEFNNELQAIKKKSFDEGKQQAMMKTTLLERKLAKMESQLSETKQSAESPPKSVNNVQNPLLGLPRKIEENSNSPFNPLLSGEKLLKLNSKSSSGGFNPFTSPSPNKHLQNDNDKRESLANKTDPPTHLEPSFNIPASRGLISSSSTLSTDTNDEELTSNNPAQKDSSNRNVQSEEDTEKKKEGEPVKRGEAIEEQTKSNKRPIDEVGELKNDEDDTTENINESKKIKTEDEEEKETDKVNDENSI

SEQ ID NO: 22286 - protein, 549 aa, Saccharomyces cerevisiae
MSPSKMNATVGSTSEVEQKIRQELALSDEVTTIRRNAPAAVLYEDGLKENKTVISSSGALIAYSGVKTGRSPKDKRIVEEPTSKDEIWWGPVNKPCSERTWSINRERAADYLRTRDHIYIVDAFAGWDPKYRIKVRVVCARAYHALFMTNMLIRPTEEELAHFGEPDFTVWNAGQFPANLHTQDMSSKSTIEINFKAMEMIILGTEYAGEMKKGIFTVMFYLMPVHHNVLTLHSSANQGIQNGDVTLFFGLSGTGKTTLSADPHRLLIGDDEHCWSDHGVFNIEGGCYAKCINLSAEKEPEIFDAIKFGSVLENVIYDEKSHVVDYDDSSITENTRCAYPIDYIPSAKIPCLADSHPKNIILLTCDASGVLPPVSKLTPEQVMYHFISGYTSKMAGTEQGVTEPEPTFSSCFGQPFLALHPIRYATMLATKMSQHKANAYLINTGWTGSSYVSGGKRCPLKYTRAILDSIHDGSLANETYETLPIFNLQVPTKVNGVPAELLNPAKNWSQGESKYRGAVTNLANLFVQNFKIYQDRATPDVLAAGPQFE

SEQ ID NO: 22287 - protein, 717 aa, Saccharomyces cerevisiae
MLLNPDQILNLVRKVYEVDIKQFYSQLRLKNLRGLLDHAAHLFNVYLRDLEINQEMEALTAFIIGCYYLYLIIPQSLQFQTRNNLYSSYAKLKNDYQDEHVMGYVLKVVRDESTVIVDRYLAESNGICRTIKRKRAYSLPLRPLPVHMASLSIHNKFDGSLHEIPNELTKPTNDNSKEDIVRESNQIASSNKLEAGSEVAYYTSKEALSKPSYLKLSTGKDALFKTLSSPATAPPVHSLEVSSQIRDSSQDSSSSLSKVEKPKEEEGKIEAIESSAPKAYNLPVIEDSNDLLSELSITGLQNPCNTCYINSIIQCLFGTTLFRDLFLTKKYRLFLNTNKYPKEVQLSRSIYVLFKKMYLNGGRAIIPNRFLKMCKKLRPDLNIPDDQQDTQEFLLIVLARIHEELSNENVVKYYPDLVSYDANALQVNPSKYEKWYERNVITDGLSPIDHIYRGQLENILKCQRCGNSSYSYSTFYVLSLAIPKLSLYSFTSKSRKIKLEDCINLFTGDEELSGDNAWDCPNCRITDSKSKKEEITSQKKKSTIFGFHSRSRSKSPHHHHHHHHSSDDSTKNAKKRNSKKLTTIKSLDFIVLPPILVIHLSRFYYDLTKKNSTVITYPLILNIILKNGKVIRYKLYGTVNHSGNLINGHYTSVVNKEKSHEIGLNRQVWVTFDDDYIQQHRKDRNNFEAGKTEMSSDEVYVLFYERMDEENYEEEFC

SEQ ID NO: 22288 - protein, 1169 aa, Saccharomyces cerevisiae
MPVAARYIFLTGLFLLSVANVALGTTEACLPAGEKKNGMTINFYQYSLKDSSTYSNPSYMAYGYADAEKLGSVSGQTKLSIDYSIPCNGASDTCACSDDDATEYSASQVVPVKRGVKLCSDNTTLSSKTEKRENDDCDQGAAYWSSDLFGFYTTPTNVTVEMTGYFLPPKTGTYTFGFATVDDSAILSVGGNVAFECCKQEQPPITSTDFTINGIKPWNADAPTDIKGSTYMYAGYYYPIKIVYSNAVSWGTLPVSVVLPDGTEVNDDFEGYVFSFDDNATQAHCSVPNPAEHARTCVSSATSSWSSSEVCTECTETESTSYVTPYVTSSSWSSSEVCTECTETESTSTSTPYVTSSSSSSSEVCTECTETESTSYVTPYVSSSTAAANYTSSFSSSSEVCTECTETESTSTSTPYVTSSSWSSSEVCTECTETESTSYVTPYVSSSTAAANYTSSFSSSSEVCTECTETESTSTSTPYVTSSSSSSSEVCTECTETESTSYVTPYVSSSTAAANYTSSFSSSSEVCTECTETESTSTSTPYVTSSSWSSSEVCTECTETESTSYVTPYVSSSTAAANYTSSFSSSSEVCTECTETESTSTSTPYATSSTGTATSFTASTSNTMTSLVQTDTTVSFSLSSTVSEHTNAPTSSVESNASTFISSNKGSVKSYVTSSIHSITPMYPSNQTVTSSSVVSTPITSESSESSASVTILPSTITSEFKPSTMKTKVVSISSSPTNLITSYDTTSKDSTVGSSTSSVSLISSISLPSSYSASSEQIFHSSIVSSNGQALTSFSSTKVSSSESSESHRTSPTTSSESGIKSSGVEIESTSTSSFSFHETSTASTSVQISSQFVTPSSPISTVAPRSTGLNSQTESTNSSKETMSSENSASVMPSSSATSPKTGKVTSDETSSGFSRDRTTVYRMTSETPSTNEQTTLITVSSCESNSCSNTVSSAVVSTATTTINGITTEYTTWCPLSATELTTVSKLESEEKTTLITVTSCESGVCSETASPAIVSTATATVNDVVTVYSTWSPQATNKLAVSSDIENSASKASFVSEAAETKSISRNNNFVPTSGTTSIETHTTTTSNASENSDNVSASEAVSSKSVTNPVLISVSQQPRGTPASSMIGSSTASLEMSSYLGIANHLLTNSGISIFIASLLLAIV

SEQ ID NO: 22289 - protein, 324 aa, Saccharomyces cerevisiae
MKRIPIKELIVEHPGKVLILDGGQGTELENRGININSPVWSAAPFTSESFWEPSSQERKVVEEMYRDFMIAGANILMTITYQANFQSISENTSIKTLAAYKRFLDKIVSFTREFIGEERYLIGSIGPWAAHVSCEYTGDYGPHPENIDYYGFFKPQLENFNQNRDIDLIGFETIPNFHELKAILSWDEDIISKPFYIGLSVDDNSLLRDGTTLEEISVHIKGLGNKINKNLLLMGVNCVSFNQSALILKMLHEHLPGMPLLVYPNSGEIYNPKEKTWHRPTNKLDDWETTVKKFVDNGARIIGGCCRTSPKDIAEIASAVDKYS

SEQ ID NO: 22290 - protein, 583 aa, Saccharomyces cerevisiae
MDEFESTKLSKVQFSTSVLSTPSNEGNNLIHRFKNSFKRNDSPAIQEGLLYSELSEEEKIQWDLANQPYKKVLDQRHLTMIAIGGTLGTGLFIGLGESLASGPASLLIGFLLVGASMLCVVQCGAELSCQYPVSGSYALHASRFIDPSVGFSIGINYLLMWLISYPSELVGCSLTISYWAPSVNPAAWVAIAFVLSMLLNLFGARGFAESEFYMSIFKIVALFIFIIIGIVLIAGGGPDSTGYIGTKYWHDPGSFAVPVFKNLCNTFVSAAYSFSGTEMVVLTSTEARSVSSVSRAAKGTFWRIIIFYIVTVIIIGCLVPYNDPRLISGSSSEDITASPFVIALSNTGAMGTRVSHFMNAVILIAVFSVCNSCVYASSRLIQGLATAGQLPKICAYMDRNGRPLVGMAICGAFGLLGFLVVSKNQGTVFTWLFALCSISFFTTWFCICFCQVRFRMAMKAQGRSKDDIIYRSTLGIYGGIFGCILNVLLVIGEIYVSAAPVGSPSSAANFFEYCMSIPIMIAVYIGHRIYRRDWRHWYIKRMDIDLDSGHSLEDFEATKLERDEDKKYVSSKPLYYRIYRFFC

SEQ ID NO: 22291 - protein, 233 aa, Saccharomyces cerevisiae
MNGRGFLIYNGGEKMKQKMIIYDTPAGPYPARVRIALAEKNMLSSVQFVRINLWKGEHKKPEFLAKNYSGTVPVLELDDGTLIAECTAITEYIDALDGTPTLTGKTPLEKGVIHMMNKRAELELLDPVSVYFHHATPGLGPEVELYQNKEWGLRQRDKALHGMHYFDTVLRERPYVAGDSFSMADITVIAGLIFAAIVKLQVPEECEALRAWYKRMQQRPSVKKLLEIRSKSS

SEQ ID NO: 22292 - protein, 531 aa, Saccharomyces cerevisiae
MSKVDVKIGADSISSSDEILVPSRLADVTLAFMEENDAAVPEITPEQEKKLKRKLFLTIFTFVSAINLLLYMDKATLSYDSILGFFEDTGLTQNTYNTVNTLFYVGFAIGQFPGQYLAQKLPLGKFLGGLLATWTILIFLSCTAYNFSGVVALRFFLGLTESVVIPILITTMGMFFDASERAAAQPFFFAACMGSPIPTGFIAYGVLHITNPSISLWKIFTIIIGGLTFIMTVVVILWFPNNPADVKFFSIQERVWIIRRVQASTGSSIEQKVFKKSQFREAMKDYITWLFGLFFLLQQLANNLPYQQNLLFEGMGGVDALGSTLVSVAGAGFAVVCAFIATLMLAKWKNISALTAIFWTLPALVGSIAAAALPWDNKIGILANICMAGQIFGIPFIIALSWASSSASGYTKKLTRSSVSLFAMGIANIISPQIWREKDSPRFLPAWIVQIVLSFSLAPAILLLIHFILKRRNNQRLKNYDENLQNYLDRIQLIESENPSSIEEGKVVTHENNLAVFDLTDLENETFIYPL

SEQ ID NO: 22293 - protein, 143 aa, Saccharomyces cerevisiae
MSRSGVAVADESLTAFNDLKLGKKYKFILFGLNDAKTEIVVKETSTDPSYDAFLEKLPENDCLYAIYDFEYEINGNEGKRSKIVFFTWSPDTAPVRSKMVYASSKDALRRALNGVSTDVQGTDFSEVSYDSVLERVSRGAGSH

SEQ ID NO: 22294 - protein, 1661 aa, Saccharomyces cerevisiae
MHHVLNSTRPDHRFWFYDDVTQYGRTKYLNYYTPLVLLIFTVLFITYNIWKHYYYYDVLHLKQKNPIDELLYSSTDEDEQSPLINNNTITTNYVDNNCTKDALKNRHFSLEKLKSVKVNGEPHGTPEIVRRGFIEKSRIILEFFLVLSQVIIHSFILLHYVNKNPEFTQQGTITGLVEWCALFIIVSLRLANVNQNFKFINKYPGNLWSVSFINYLALFISMILPFRSIFIHHINSPISRKYYISQISINLALFLLLFFARIRNNFAIIYKTDSWITPSPEPVTSIAGFICWAWLDSFVWKAHKVSIKVKDIWGLMMQDYSFFVVKKFRYFVDHKVKRKRIFSLNLFFFFSNYLVLQCFWAFLGSVLSFIPTVLLKRILEYVEDQSSAPSNLAWFYVTVMFVGRILVAICQAQALFFGRRVCIRMKSIIISEIYTKALRRKISTNKTKPSNEDPQEINDQKSINGDEESTSSANLGAIINLMAIDAFKVSEICGYLHSFLEAFVMTVVALALLYRLLGFAAIVGVLIIVAMLPLNYKLAKYIGDLQKKNLAVTDNRIQKLNEAFQAIRIIKYFSWEENFEKDINTIRENELSLLLMRSIVWSISSFLWFVTPTIVTAASFAYYIYVQGEVLTTPVAFTALSLFTLLRDPLDRLSDMLSFVVQSKVSLDRVQDFLNENDTKKYDQLTIDPNGNRFAFENSTISWDKDNQDFKLKDLNIEFKTGKLNVVIGPTGSGKTSLLMALLGEMYLLNGKVVVPALEPRQELIVDANGTTNSIAYCSQAAWLLNDTVKNNILFNSPFNEARYKAVVEACGLKRDFEILKAGDLTEIGEKGITLSGGQKQRVSLARALYSNARHVLLDDCLSAVDSHTASWIYDNCITGPLMEDRTCILVSHNIALTLRNAELVVLLEDGRVKDQGDPIDMLQKGLFGEDELVKSSILSRANSSANLAAKSSTSLSNLPAVKEQQVSVNNNSSHFEAKKLQKSLRTEAERTEDGKLIKEETKEEGVVGLDVYKWYLKIFGGWKIVSFLASLFLIAQLLYIGQSWWVRAWASHNVIAKIIPRAQRAIAFISKKASHLIDWRGSSQISMASAENQPSSGHSTMYYLVLYLIIGFAQALLGAGKTILNFVAGINASRKIFNMILNKVLHSKIRFFDATPTGRIMNRFSKDIEAIDQELTPYIQGAFYSLIECLSTVILITFITPQFLSVAIVVSILYYFVGYFYMAGSRELKRFESISRSPIYQHFSETLVGVTTIRAFGDEGRFMQENLHKIDENNKPFFYLWVANRWLAFRIDMIGSLVIFGAGLFILFNINNLDSGMAGISLTYAISFTEGALWLVRLYSEVEMNMNSVERVKEYMEIEQEPYNEHKEIPPPQWPQDGKIEVNDLSLRYAPNLPRVIKNVSFSVDAQSKIGIVGRTGAGKSTIITALFRFLEPETGHIKIDNIDISGVDLQRLRRSITIIPQDPTLFSGTIKTNLDPYDEFSDRQIFEALKRVNLISEEQLQQGATRETSNEASSTNSENVNKFLDLSSEISEGGSNLSQGQRQLMCLARSLLRSPKIILLDEATASIDYSSDAKIQETIRKEFQGSTILTIAHRLRSVIDYDKILVMDAGEVKEYDHPYSLLLNKQSAFYSMCEHSGELDILIELAKKAFVEKLNSKKD

SEQ ID NO: 22295 - protein, 266 aa, Saccharomyces cerevisiae
MLNVLLRRKAFCLVTKKGMATATTAAATHTPRLKTFKVYRWNPDEPSAKPHLQSYQVDLNDCGPMVLDALLKIKDEQDSTLTFRRSCREGICGSCAMNIGGRNTLACICKIDQNESKQLKIYPLPHMFIVKDLVPDLTNFYQQYKSIQPYLQRSSFPKDGTEVLQSIEDRKKLDGLYECILCACCSTSCPSYWWNQEQYLGPAVLMQAYRWLIDSRDQATKTRKAMLNNSMSLYRCHTIMNCTRTCPKGLNPGLAIAEIKKSLAFA

SEQ ID NO: 22296 - protein, 837 aa, Saccharomyces cerevisiae
MVKVKSKKNSLTSSLDNKIVDLIYRLLEEKTLDRKRSLRQESQGEEGENNEGEEDEDIFESMFFAKDLTAGEIFTFCLTKDLSLQRVKKVVLQKTIDRMLKDVIESELEEFGSYPGYNNEEEEKPSLEEELAKKNMMIERDTNEMNKRITSTWSKSGSVSESITETDDPKTEEVKKSKKRSKEGTCKVKRQKIKEDRSPPNSSLKSLGGMDDVVAQLMELIGLPILHPEIFLSTGVEPPRGVLLHGPPGCGKTSIANALAGELQVPFISISAPSVVSGMSGESEKKIRDLFDEARSLAPCLVFFDEIDAITPKRDGGAQREMERRIVAQLLTSMDELTMEKTNGKPVIIIGATNRPDSLDAALRRAGRFDREICLNVPNEVSRLHILKKMSDNLKIDGAIDFAKLAKLTPGFVGADLKALVTAAGTCAIKRIFQTYANIKSTPTTATDSSEDNMEIDETANGDESSLKNTANMIDPLPLSVVQQFIRNYPEPLSGEQLSLLSIKYEDFLKALPTIQPTAKREGFATVPDVTWANVGALQRVRLELNMAIVQPIKRPELYEKVGISAPGGVLLWGPPGCGKTLLAKAVANESRANFISIKGPELLNKYVGESERSIRQVFTRARASVPCVIFFDELDALVPRRDTSLSESSSRVVNTLLTELDGLNDRRGIFVIGATNRPDMIDPAMLRPGRLDKSLFIELPNTEEKLDIIKTLTKSHGTPLSSDVDFEEIIRNEKCNNFSGADLAALVRESSVLALKRKFFQSEEIQSVLDNDLDKEFEDLSVGVSGEEIIVTMSDFRSALRKIKPSVSDKDRLKYDRLNKKMGLTEEMKDAEEMKQ

SEQ ID NO: 22297 - protein, 908 aa, Saccharomyces cerevisiae
MNDQTQFTERALTILTLAQKLASDHQHPQLQPIHILAAFIETPEDGSVPYLQNLIEKGRYDYDLFKKVVNRNLVRIPQQQPAPAEITPSYALGKVLQDAAKIQKQQKDSFIAQDHILFALFNDSSIQQIFKEAQVDIEAIKQQALELRGNTRIDSRGADTNTPLEYLSKYAIDMTEQARQGKLDPVIGREEEIRSTIRVLARRIKSNPCLIGEPGIGKTAIIEGVAQRIIDDDVPTILQGAKLFSLDLAALTAGAKYKGDFEERFKGVLKEIEESKTLIVLFIDEIHMLMGNGKDDAANILKPALSRGQLKVIGATTNNEYRSIVEKDGAFERRFQKIEVAEPSVRQTVAILRGLQPKYEIHHGVRILDSALVTAAQLAKRYLPYRRLPDSALDLVDISCAGVAVARDSKPEELDSKERQLQLIQVEIKALERDEDADSTTKDRLKLARQKEASLQEELEPLRQRYNEEKHGHEELTQAKKKLDELENKALDAERRYDTATAADLRYFAIPDIKKQIEKLEDQVAEEERRAGANSMIQNVVDSDTISETAARLTGIPVKKLSESENEKLIHMERDLSSEVVGQMDAIKAVSNAVRLSRSGLANPRQPASFLFLGLSGSGKTELAKKVAGFLFNDEDMMIRVDCSELSEKYAVSKLLGTTAGYVGYDEGGFLTNQLQYKPYSVLLFDEVEKAHPDVLTVMLQMLDDGRITSGQGKTIDCSNCIVIMTSNLGAEFINSQQGSKIQESTKNLVMGAVRQHFRPEFLNRISSIVIFNKLSRKAIHKIVDIRLKEIEERFEQNDKHYKLNLTQEAKDFLAKYGYSDDMGARPLNRLIQNEILNKLALRILKNEIKDKETVNVVLKKGKSRDENVPEEAEECLEVLPNHEATIGADTLGDDDNEDSMEIDDDLD

SEQ ID NO: 22298 - protein, 639 aa, Saccharomyces cerevisiae
MSKAVGIDLGTTYSCVAHFSNDRVDIIANDQGNRTTPSFVGFTDTERLIGDAAKNQAAMNPANTVFDAKRLIGRNFNDPEVQGDMKHFPFKLIDVDGKPQIQVEFKGETKNFTPEQISSMVLGKMKETAESYLGAKVNDAVVTVPAYFNDSQRQATKDAGTIAGLNVLRIINEPTAAAIAYGLDKKGKEEHVLIFDLGGGTFDVSLLSIEDGIFEVKATAGDTHLGGEDFDNRLVNHFIQEFKRKNKKDLSTNQRALRRLRTACERAKRTLSSSAQTSVEIDSLFEGIDFYTSITRARFEELCADLFRSTLDPVEKVLRDAKLDKSQVDEIVLVGGSTRIPKVQKLVTDYFNGKEPNRSINPDEAVAYGAAVQAAILTGDESSKTQDLLLLDVAPLSLGIETAGGVMTKLIPRNSTIPTKKSEVFSTYADNQPGVLIQVFEGERAKTKDNNLLGKFELSGIPPAPRGVPQIEVTFDVDSNGILNVSAVEKGTGKSNKITITNDKGRLSKEDIEKMVAEAEKFKEEDEKESQRIASKNQLESIAYSLKNTISEAGDKLEQADKDAVTKKAEETIAWLDSNTTATKEEFDDQLKELQEVANPIMSKLYQAGGAPEGAAPGGFPGGAPPAPEAEGPTVEEVD

SEQ ID NO: 22299 - protein, 1466 aa, Saccharomyces cerevisiae
MGTSSEVSLAHHRDIFHYYVSLKTFFEVTGENRDRSNSTRAQKARAKLLKLSSSQFYELSTDVSDELQRRIGEDANQPDYLLPKANFHMKRNQARQKLANLSQTRFNDLLDDILFEIKRRGFDKDLDAPRPPLPQPMKQEVSKDSDDTARTSTNSSSVTQVAPNVSVQPSLVIPKMASIDWSSEEEEEEQVKEKPNEPEGKQTSMDEKKEAKPALNPIVTDSDLPDSQVLARDITSMARTPTTTHKNYWDVNDSPIIKVDKDIDNEKGPEQLKSPEVQRAENNNPNSEMEDKVKELTDLNSDLHLQIEDLNAKLASLTSEKEKEKKEEKEEKEKEKNLKINYTIDESFQKELLSLNSQIGELSIENENLKQKISEFELHQKKNDNHNDLKITDGFISKYSSADGLIPAQYILNANNLIIQFTTRLSAVPIGDSTAISHQIGEELFQILSQLSNLISQLLLSADLLQYKDQVILLKASLSHAITSIRYFSVYGPVLIPKITVQAAVSEVCFAMCNLIDSAKIKSDSNGESTTSNEGNRQVLEYSSPTATTPMTPTFPSTSGINMKKGFINPRKPASFLNDVEEEESPVKPLKITQKAINSPIIRPSSSNGVPTTSRKPSGTGLFSLMIDSSIAKNSSHKEDNDKYVSPIKAVTSASNSASSNISEIPKLTLPPQAKIGTVIPPSENQVPNIKIENTEEDNKRSDITNEISVKPTSSIADKLKQFEQSSEKKSSPKENPIAKEEMDSKPKLSNKFITSMNDVSTDDSSSDGNENDDADDDDDFTYMALKQTMKREGSKIEKNNDSKLPANIVELDLHESPESVKIESPESIKEITSSEMSSEMPSSSLPKRLVEDVEPSEMPEKGASVESVRKKNFQEPLGNVESPDMTQKVKSLGMTGKAVGPESDSRVESPGMTGQIKSLNMAGKVVGPEADSRVESPGMKEQIKSLGMTGKITAQESIKSPEAARKLASSGEVDKIESPRMVRESESLEAVGNTIPSNMTVKMESPNLKGNTVSEPQEIRRDIASSEPIENVDPPKVLKKIVFPKAVNRTGSPKSVEKTPSSATLKKSGLPEPNSQIVSPELAKNSPLAPIKKNVELRETNKPHTETITSVEPTNKDANTSWRDADLNRTIKREEEDEDFDRVNHNIQITGAYTKTGKIDYHKIPVDRKAKSEAEVHTSEEDIDESNNVNGKRADAQIHITERKHAFVNPTENSQVKKTSHSPFLNSKPVQYENSESNGGINNHIKIKNTGETTAHDEKHYSDDDDSSYQFVPMKHEEQEQEQNRSEEEESEDDDEEEEDSDFDVDTFDIENPDNTLSELLLYLEHQTMDVISTIQSLLTSIKKPQVTKGNLRGESNAINQVIGQMVDATSISMEQSRNANLKKHGDWVVQSLRDCSRRMTILCQLTGDGILAKEKSDQDYADKNFKQRLAGIAFDVAKCTKELVKTVEEASLKDEINYLNSKLK

SEQ ID NO: 22300 - protein, 737 aa, Saccharomyces cerevisiae
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHNSSRVDEDADDDIIFIKEQPIQFSSPLILPSSSSINNNNNIVTSNNPGCGTAATSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIARFPGSHIQAIARQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKSKHKLGNSPSDLNSTVIKHFDRKTLSLQWPEKNKRGDTITTEKSMKRVLQSCDRLDIYISKVLKQDYGDSLSINWNLPPEKNWSLINSKLAWKRQTHSSSSSTTDELDKETFLFWYWFIDLLRKMFEFDPTKRITAKDALDHEWFNLGILDDGIATYNNTQG

SEQ ID NO: 22301 - protein, 1048 aa, Saccharomyces cerevisiae
MPITSSPDLFYLNDCDVVYWYDLTRLVCHYVNLTERDLLANEREKFLTSLDLLTAQITYVYMLFRNLRLVEDSFKKTLKKLIYTLSRFSINANIWFHSTLFEEREAIASQKDPERRSPLLQSILGTFQKFHFLLRLLHFLSNPNELTILPQLTPRFFKDSFNTISWNNPFLRKRLNQHMSHDLPRQMIKAVAGASGIVAENIDEIPASKQGTSCSSETSHHSPSAPFQRRRRGTIFSNVSGSSDESDTIWSKRKKPYPLNEETLSLVRARKKQLDGKLKQMIKSANEYLSNTANFSKMLNFEMNFKTYEEVSGTIPIIDILENLDLTIFLNLRELGDENRVFDEDVAIDDEDEEFLKHSLSSLSYILSDYFNMKQYFHDVVVKFIIVAQHLTLEDPFVFSPMQNDLPTGYYEPMKPSSLNLDNAKDKKNGSQNTDIQEEEDEYEPDPDSLILFHNLINQDSDFNDLKFFNLAHVFKKSCDDYFDVLKLAIEFVNQLILERENLLNYAARMMKNNITELLLRGEEGYGSYDGGETAEKSDTNAVYADSDTKDNDEWRDSQVKLPRYLQREYDSELIWGSNNRIKGGSKHALISYLTDNEKKDLFFDITFLITFRSIFTTTEFLSYLISQYNLDPPEDLCFEEYNEWVTKKLIPVKCRVVEIMTTFFKQYWFLGYDEPDLATLNLDYFAQVAIKENITGSVELLKEVNQKFKHGNIQEATAPMKTLDQQICQDHYSGTLYSTTESILAVDPVLFATQLTILEHEIYCEITIFDCLQKIWKNKYTKSYGASPGLNEFISFANKLTNFISYSVVKEADKSKRAKLLSHFIFIAEYCRKFNNFSSMTAIISALYSSPIYRLEKTWQAVIPQTRDLLQSLNKLMDPKKNFINYRNELKSLHSAPCVPFFGVYLSDLTFTDSGNPDYLVLEHGLKGVHDEKKYINFNKRSRLVDILQEIIYFKKTHYDFTKDRTVIECISNSLENIPHIEKQYQLSLIIEPKPRKKVVPNSNSNNKSQEKSRDDQTDEGKTSTKKDRFPKFQLHKTKKKAPKVSK

SEQ ID NO: 22302 - protein, 752 aa, Saccharomyces cerevisiae
MVVGTKKYSNLDFVPTISDSEDDVPILDSSDDEKVEAKKTTKKRKGKNNKKKVSEGDNLDEDVHEDLDAGFKFDLDADDTTSNFQGWNFLAEGESNKDDAEAFVKKDVDLDKIIRRKGGLVKMAHIDSKQEEETEKEKVEKENDSDDEELAMDGFGMGAPMNNGDENQSEEEEEEEEKEEEEEEEEEQEEMTLEKGGKDDEIDEEDDSEEAKADFYAPETEGDEAKKQMYENFNSLSLSRPVLKGLASLGYVKPSPIQSATIPIALLGKDIIAGAVTGSGKTAAFMIPIIERLLYKPAKIASTRVIVLLPTRELAIQVADVGKQIARFVSGITFGLAVGGLNLRQQEQMLKSRPDIVIATPGRFIDHIRNSASFNVDSVEILVMDEADRMLEEGFQDELNEIMGLLPSNRQNLLFSATMNSKIKSLVSLSLKKPVRIMIDPPKKAATKLTQEFVRIRKRDHLKPALLFNLIRKLDPTGQKRIVVFVARKETAHRLRIIMGLLGMSVGELHGSLTQEQRLDSVNKFKNLEVPVLICTDLASRGLDIPKIEVVINYDMPKSYEIYLHRVGRTARAGREGRSVTFVGESSQDRSIVRAAIKSVEENKSLTQGKALGRNVDWVQIEETNKLVESMNDTIEDILVEEKEEKEILRAEMQLRKGENMLKHKKEIQARPRRTWFQSESDKKNSKVLGALSRNKKVTNSKKRKREEAKADGNGARSYRKTKTDRIADQERTFKKQKSTNSNKKKGFKSRR

SEQ ID NO: 22303 - protein, 757 aa, Saccharomyces cerevisiae
MASLEDLIPTVNKLQDVMYDSGIDTLDLPILAVVGSQSSGKSSILETLVGRDFLPRGTGIVTRRPLVLQLNNISPNSPLIEEDDNSVNPHDEVTKISGFEAGTKPLEYRGKERNHADEWGEFLHIPGKRFYDFDDIKREIENETARIAGKDKGISKIPINLKVFSPHVLNLTLVDLPGITKVPIGEQPPDIEKQIKNLILDYIATPNCLILAVSPANVDLVNSESLKLAREVDPQGKRTIGVITKLDLMDSGTNALDILSGKMYPLKLGFVGVVNRSQQDIQLNKTVEESLDKEEDYFRKHPVYRTISTKCGTRYLAKLLNQTLLSHIRDKLPDIKTKLNTLISQTEQELARYGGVGATTNESRASLVLQLMNKFSTNFISSIDGTSSDINTKELCGGARIYYIYNNVFGNSLKSIDPTSNLSVLDVRTAIRNSTGPRPTLFVPELAFDLLVKPQIKLLLEPSQRCVELVYEELMKICHKCGSAELARYPKLKSMLIEVISELLRERLQPTRSYVESLIDIHRAYINTNHPNFLSATEAMDDIMKTRRKRNQELLKSKLSQQENGQTNGINGTSSISSNIDQDSAKNSDYDDDGIDAESKQTKDKFLNYFFGKDKKGQPVFDASDKKRSIAGDGNIEDFRNLQISDFSLGDIDDLENAEPPLTEREELECELIKRLIVSYFDIIREMIEDQVPKAVMCLLVNYCKDSVQNRLVTKLYKETLFEELLVEDQTLAQDRELCVKSLGVYKKAATLISNIL

SEQ ID NO: 22304 - protein, 523 aa, Saccharomyces cerevisiae
MKNMSQRSMDVEKKAANADSCSVSTSSINVDDADVALRFLKQNGLDESSTANEDDVVAGEEANFYGSHELSPKVLRKVDLFILPFLCCTYLLMFLDKALLNYAASMGIKDHLKGNEFSNLGTIFSAAYIFMEPVVTYLIQKFPISKILGTFITVWGIVLACHAACKTYASLMVVRTLLGLFESSSAVGCIAISGMYYTKSEQSARIGFWATQAGTGYIVGGLISFGFLHYHGTAFTSWQIMFLVVGLVTVAFGVLTFLYLPDNVTNAWFLNKEEKIQVVEHIRANQTGLETKKFKKQQVKELFLHDKFTWPMLLLTACSQISTGAIGTFSVTITGTFGFDKYETALLQLPIGAITAMIILITTQMLSRWGHITLITTSMYIPAIIGCIVLISLPLSHKIGNLFSLYLLYSGSCVITNIYIWNSCNTSGYTKRVFRNAITMIVYNVSCIIAPQMFRAYSAPRYIPAKIALLVTQCVCVPLQLYIGYICKKENEKRDKEQEGQERKKYQFLDLTDIENRNFRYIY

SEQ ID NO: 22305 - protein, 461 aa, Saccharomyces cerevisiae [sequence omitted]

SEQ ID NO: 22306 - protein, 712 aa, Saccharomyces cerevisiae
MLNSALLWKVWLRIDNSTDEVNQPIAVQFDEIDTVDDLKSRFFQKLSSTRWREINDNASIAIGLYAPKFDNQADNTSSNNTNDNSCRSKSNGAGSGANLSVNSNTKSSVSPTAGSFGLSKDLAKDRNVLQHPKPTQKRGALYDAFAAVPTVAATTNVDFPPNEAPMLSPQRPYSTSPKQFPATTKSPLLRFASVSPYPKFHSDNQIMASAGLTYVSPHNKNKYTRPLIRKGLNFTTESVNDCTYKIIFEPDELAINIYKELFGTMGSQPASQPLLIFSNVNLRQDVPPLDILNVVDYVPTNEEISQQKTQPTDHGAVGVFHLDDHISPGEQGLKQTIGDKADLKGKDGNSSPQEFKLITDEEQLRRASQELKDEEKDAESPWQAILLLPKGYKGGVDFRNKPVAHTDSSFNNEDTITHSELEVNTGSPSQESGSLNEAGIGITQPMSEVQRRKEDVTPASPILTSSQTPHYSNSLYNAPFAVSSPPDPLPNLFTTTSEKVFPKINVLIVEDNVINQAILGSFLRKHKISYKLAKNGQEAVNIWKEGGLHLIFMDLQLPVLSGIEAAKQIRDFEKQNGIGIQKSLNNSHSNLEKGTSKRFSQAPVIIVALTASNSQMDKRKALLSGCNDYLTKPVNLHWLSKKITEWGCMQALIDFDSWKQGESRMTDSVLVKSPQKPIAPSNPHSFKQATSMTPTHSPVRKNSNLSPTQIEL

SEQ ID NO: 22307 - protein, 432 aa, Saccharomyces cerevisiae
MNKRTQEYKNTRAIMSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 22308 - protein, 1169 aa, Saccharomyces cerevisiae
MSHIEQEERKRFFNDDLDTSETSLNFKSENKESFLFANSHNDDDDDVVVSVSDTTEGEGDRSIVPVRREIEEEGQNQFITELLRIIPEMPKDLVMELNEKFGSQEEGLSLALSHYFDHNSGTSISKIPSSPNQLNTLSDTSNSTLSPSSFHPKRRRIYGFRNQTRLEDKVTWKRFIGALQVTGMATRPTVRPLKYGSQMKLKRSSEEISATKVYDSRGRKKASMASLVRIFDIQYDREIGRVSEDIAQILYPLLSSHEISFEVTLIFCDNKRLSIGDSFILQLDCFLTSLIFEERNDGESLMKRRRTEGGNKREKDNGNFGRTLTETDEELESRSKRLALLKLFDKLRLKPILDEQKALEKHKIELNSDPEIIDLDNDEICSNQVTEVHNNLRDTQHEEETMNLNQLKTFYKAAQSSESLKSLPETEPSRDVFKLELRNYQKQGLTWMLRREQEFAKAASDGEASETGANMINPLWKQFKWPNDMSWAAQNLQQDHVNVEDGIFFYANLHSGEFSLAKPILKTMIKGGILSDEMGLGKTVAAYSLVLSCPHDSDVVDKKLFDIENTAVSDNLPSTWQDNKKPYASKTTLIVVPMSLLTQWSNEFTKANNSPDMYHEVYYGGNVSSLKTLLTKTKTPPTVVLTTYGIVQNEWTKHSKGRMTDEDVNISSGLFSVNFYRIIIDEGHNIRNRTTVTSKAVMALQGKCKWVLTGTPIINRLDDLYSLVKFLELDPWRQINYWKTFVSTPFESKNYKQAFDVVNAILEPVLLRRTKQMKDKDGKPLVELPPKEVVIKRLPFSKSQDLLYKFLLDKAEVSVKSGIARGDLLKKYSTILVHILRLRQVCCHPGLIGSQDENDEDLSKNNKLVTEQTVELDSLMRVVSERFDNSFSKEELDAMIQRLKVKYPDNKSFQSLECSICTTEPMDLDKALFTECGHSFCEKCLFEYIEFQNSKNLGLKCPNCRNQIDACRLLALVQTNSNSKNLEFKPYSPASKSSKITALLKELQLLQDSSAGEQVVIFSQFSTYLDILEKELTHTFSKDVAKIYKFDGRLSLKERTSVLADFAVKDYSRQKILLLSLKAGGVGLNLTCASHAYMMDPWWSPSMEDQAIDRLHRIGQTNSVKVMRFIIQDSIEEKMLRIQEKKRTIGEAMDTDEDERRKRRIEEIQMLFE

SEQ ID NO: 22309 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 22310 - protein, 365 aa, Saccharomyces cerevisiae
MDLVLEVADHYVLDDLYAKVLPASLAANIPVKWQKLLGLNSGFSNSTILQETLNSKNAVKECRRFYGQVPFLFDMSTTSFASLLPRSSILREFLSLWVIVTIFGLLLYLFTASLSYVFVFDKSIFNHPRYLKNQMAMEIKLAVSAIPWMSMLTVPWFVMELNGHSKLYMKIDYENHGVRKLIIEYFTFIFFTDCGVYLAHRWLHWPRVYRALHKPHHKWLVCTPFASHSFHPVDGFLQSISYHIYPLILPLHKVSYLILFTFVNFWTVMIHDGQYLSNNPAVNGTACHTVHHLYFNYNYGQFTTLWDRLGGSYRRPDDSLFDPKLRDAKETWDAQVKEVEHFIKEVEGDDNDRIYENDPNTKKNN

SEQ ID NO: 22311 - protein, 356 aa, Saccharomyces cerevisiae
MTDLTTQEAIVLERPGKITLTNVSIPKISDPNEVIIQIKATGICGSDIHYYTHGRIANYVVESPMVLGHESSGIVALIGENVKTLKVGDRVALEPGIPDRFSPEMKEGRYNLDPNLKFAATPPFDGTLTKYYKTMKDFVYKLPDDVSFEEGALIEPLSVAIHANKLAKIKFGARCVVFGAGPIGLLAGKVASVFGAADVVFVDLLENKLETARQFGATHIVNSGDLPHGVTVDSVIKKAIGKKGADVVFECSGAEPCVRAGIEVCKAGGTIVQVGMGQEEIQFPISIIPTKELTFQGCFRYCQGDYSDSIELVSSRKLSLKPFITHRYSFKDAVEAFEETSHHPLNNIKTIIEGPE

SEQ ID NO: 22312 - protein, 284 aa, Saccharomyces cerevisiae
MTPSTPPRSRGTRYLAQPSGNTSSSALMQGQKTPQKPSQNLVPVTPSTTKSFKNAPLLAPPNSNMGMTSPFNGLTSPQRSPFPKSSVKRTLFQFESHDNGTVREEQEPLGRVNRILFPTQQNVDIDAAEEEEEGEVLLPPSRPTSARQLHLSLERDEFDQTHRKKIIKDVPGTPSDKVITFELAKNWNNNSPKNDARSQESEDEEDIIINPVRVGKNPFASDELVTQEIRNERKRAMLRENPDIEDVITYVNKKGEVVEKRRLTDEEKRRFKPKALFQSRDQEH

SEQ ID NO: 22313 - protein, 574 aa, Saccharomyces cerevisiae
MAVEENNMPVVSQQPQAGEDVISSLSKDSHLSAQSQKYSNDELKAGESGSEGSQSVPIEIPKKPMSEYVTVSLLCLCVAFGGFMFGWDTGTISGFVVQTDFLRRFGMKHKDGTHYLSNVRTGLIVAIFNIGCAFGGIILSKGGDMYGRKKGLSIVVSVYIVGIIIQIASINKWYQYFIGRIISGLGVGGIAVLCPMLISEIAPKHLRGTLVSCYQLMITAGIFLGYCTNYGTKSYSNSVQWRVPLGLCFAWSLFMIGALTLVPESPRYLCEVNKVEDAKRSIAKSNKVSPEDPAVQAELDLIMAGIEAEKLAGNASWGELFSTKTKVFQRLLMGVFVQMFQQLTGNNYFFYYGTVIFKSVGLDDSFETSIVIGVVNFASTFFSLWTVENLGHRKCLLLGAATMMACMVIYASVGVTRLYPHGKSQPSSKGAGNCMIVFTCFYIFCYATTWAPVAWVITAESFPLRVKSKCMALASASNWVWGFLIAFFTPFITSAINFYYGYVFMGCLVAMFFYVFFFVPETKGLSLEEIQELWEEGVLPWKSEGWIPSSRRGNNYDLEDLQHDDKPWYKAMLE

SEQ ID NO: 22314 - protein, 438 aa, Saccharomyces cerevisiae
METPPIVIDNGSYEIKFGPSTNKKPFRALNALAKDKFGTSYLSNHIKNIKDISSITFRRPHELGQLTLWELESCIWDYCLFNPSEFDGFDLKEGKGHHLVASESCMTLPELSKHADQVIFEEYEFDSLFKSPVAVFVPFTKSYKGEMRTISGKDEDIDIVRGNSDSTNSTSSESKNAQDSGSDYHDFQLVIDSGFNCTWIIPVLKGIPYYKAVKKLDIGGRFLTGLLKETLSFRHYNMMDETILVNNIKEQCLFVSPVSYFDSFKTKDKHALEYVLPDFQTSFLGYVRNPRKENVPLPEDAQIITLTDELFTIPETFFHPEISQITKPGIVEAILESLSMLPEIVRPLMVGNIVCTGGNFNLPNFAQRLAAELQRQLPTDWTCHVSVPEGDCALFGWEVMSQFAKTDSYRKARVTREEYYEHGPDWCTKHRFGYQNWI

SEQ ID NO: 22315 - protein, 1418 aa, Saccharomyces cerevisiae
MSDSPLSKRQKRKSAQEPELSLDQGDAEEDSQVENRVNLSENTPEPDLPALEASYSKSYTPRKLVLSSGENRYAFSQPTNSTTTSLHVPNLQPPKTSSRGRDHKSYSQSPPRSPGRSPTRRLELLQLSPVKNSRVELQKIYDRHQSSSKQQSRLFINELVLENFKSYAGKQVVGPFHTSFSAVVGPNGSGKSNVIDSMLFVFGFRANKMRQDRLSDLIHKSEAFPSLQSCSVAVHFQYVIDESSGTSRIDEEKPGLIITRKAFKNNSSKYYINEKESSYTEVTKLLKNEGIDLDHKRFLILQGEVENIAQMKPKAEKESDDGLLEYLEDIIGTANYKPLIEERMGQIENLNEVCLEKENRFEIVDREKNSLESGKETALEFLEKEKQLTLLRSKLFQFKLLQSNSKLASTLEKISSSNKDLEDEKMKFQESLKKVDEIKAQRKEIKDRISSCSSKEKTLVLERRELEGTRVSLEERTKNLVSKMEKAEKTLKSTKHSISEAENMLEELRGQQTEHETEIKDLTQLLEKERSILDDIKLSLKDKTKNISAEIIRHEKELEPWDLQLQEKESQIQLAESELSLLEETQAKLKKNVETLEEKILAKKTHKQELQDLILDLKKKLNSLKDERSQGEKNFTSAHLKLKEMQKVLNAHRQRAMEARSSLSKAQNKSKVLTALSRLQKSGRINGFHGRLGDLGVIDDSFDVAISTACPRLDDVVVDTVECAQHCIDYLRKNKLGYARFILLDRLRQFNLQPISTPENVPRLFDLVKPKNPKFSNAFYSVLRDTLVAQNLKQANNVAYGKKRFRVVTVDGKLIDISGTMSGGGNHVAKGLMKLGTNQSDKVDDYTPEEVDKIERELSERENNFRVASDTVHEMEEELKKLRDHEPDLESQISKAEMEADSLASELTLAEQQVKEAEMAYVKAVSDKAQLNVVMKNLERLRGEYNDLQSETKTKKEKIKGLQDEIMKIGGIKLQMQNSKVESVCQKLDILVAKLKKVKSASKKSGGDVVKFQKLLQNSERDVELSSDELKVIEEQLKHTKLALAENDTNMNETLNLKVELKEQSEQLKEQMEDMEESINEFKSIEIEMKNKLEKLNSLLTYIKSEITQQEKGLNELSIRDVTHTLGMLDDNKMDSVKEDVKNNQELDQEYRSCETQDESEIKDAETSCDNYHPMNIDETSDEVSRGIPRLSEDELRELDVELIESKINELSYYVEETNVDIGVLEEYARRLAEFKRRKLDLNNAVQKRDEVKEQLGILKKKRFDEFMAGFNIISMTLKEMYQMITMGGNAELELVDSLDPFSEGVTFSVMPPKKSWRNITNLSGGEKTLSSLALVFALHKYKPTPLYVMDEIDAALDFRNVSIVANYIKERTKNAQFIVISLRNNMFELAQQLVGVYKRDNRTKSTTIKNIDILNRT

SEQ ID NO: 22316 - protein, 1147 aa, Saccharomyces cerevisiae
MPNPNTADYLVNPNFRTSKGGSLSPTPEAFNDTRVAAPATLRMMGKQSGPRNDQQQAPLMPPADIKQGKEQAAQRQNDASRPNGAVELRQFHRRSLGDWEFLETVGAGSMGKVKLVKHRQTKEICVIKIVNRASKAYLHKQHSLPSPKNESEILERQKRLEKEIARDKRTVREASLGQILYHPHICRLFEMCTMSNHFYMLFEYVSGGQLLDYIIQHGSLKEHHARKFARGIASALQYLHANNIVHRDLKIENIMISSSGEIKIIDFGLSNIFDYRKQLHTFCGSLYFAAPELLKAQPYTGPEVDIWSFGIVLYVLVCGKVPFDDENSSILHEKIKKGKVDYPSHLSIEVISLLTRMIVVDPLRRATLKNVVEHPWMNRGYDFKAPSYVPNRVPLTPEMIDSQVLKEMYRLEFIDDIEDTRRSLIRLVTEKEYIQLSQEYWDKLSNAKGLSSSLNNNYLNSTAQQTLIQNHITSNPSQSGYNEPDSNFEDPTLAYHPLLSIYHLVSEMVARKLAKLQRRQALALQAQAQQRQQQQQVALGTKVALNNNSPDIMTKMRSPQKEVVPNPGIFQVPAIGTSGTSNNTNTSNKPPLHVMVPPKLTIPEQAHTSPTSRKSSDIHTELNGVLKSTPVPVSGEYQQRSASPVVGEHQEKNTIGGIFRRISQSGQSQHPTRQQEPLPEREPPTYMSKSNEISIKVPKSHSRTISDYIPSARRYPSYVPNSVDVKQKPAKNTTIAPPIRSVSQKQNSDLPALPQNAELIVQKQRQKLLQENLDKLQINDNDNNNVNAVVDGINNDNSDHYLSVPKGRKLHPSARAKSVGHARRESLKFTRPPIPAALPPSDMTNDNGFLGEANKERYNPVSSNFSTVPEDSTTYSNDTNNRLTSVYSQELTEKQILEEASKAPPGSMPSIDYPKSMFLKGFFSVQTTSSKPLPIVRHNIISVLTRMNIDFKEVKGGFICVQQRPSIETAAVPVITTTGVGLDSGKAMDLQNSLDSQLSSSYHSTASSASRNSSIKRQGSYKRGQNNIPLTPLATNTHQRNSSIPMSPNYGNQSNGTSGELSSMSLDYVQQQDDILTTSRAQNINNVNGQTEQTNTSGIKERPPIKFEIHIVKVRIVGLAGVHFKKVSGNTWLYKELASYILKELNL

SEQ ID NO: 22317 - protein, 650 aa, Saccharomyces cerevisiae
MYYGISQFSEAYNKILRNSSSHSSCQLVIFVSCLNIDALCATKMLSLLFKKQLVQSQIVPIFGYSELRRHYSQLDDNINSLLLVGFGGVIDLEAFLEIDPQEYVIDTDEKSGEQSFRRDIYVLDAHRPWNLDNIFGSQIIQCFDDGTVDDTLGEQKEAYYKLLELDEESGDDELSGDENDNNGGDDEATDADEVTDEDEEDEDETISNKRGNSSIGPNDLSKRKQRKKQIHEYEGVLEEYYSQGTTVVNSISAQIYSLLSAIGETNLSNLWLNILGTTSLDIAYAQVYNRLYPLLQDEVKRLTPSSRNSVKTPDTLTLNIQPDYYLFLLRHSSLYDSFYYSNYVNAKLSLWNENGKKRLHKMFARMGIPLSTAQETWLYMDHSIKRELGIIFDKNLDRYGLQDIIRDGFVRTLGYRGSISASEFVEALTALLEVGNSTDKDSVKINNDNNDDTDGEEEEDNSAQKLTNLRKRWVSNFWLSWDALDDRKVELLNRGIQLAQDLQRAIFNTGVAILEKKLIKHLRIYRLCVLQDGPDLDLYRNPLTLLRLGNWLIECCAESEDKQLLPMVLASIDENKDTYLVAGLTPRYPRGLDTIHTKKPILNNFSMAFQQITAETDAKVRIDNFESSIIEIRREDLSPFLEKLTLSGLL

SEQ ID NO: 22318 - protein, 650 aa, Saccharomyces cerevisiae
MYYGISQFSEAYNKILRNSSSHSSCQLVIFVSCLNIDALCATKMLSLLFKKQLVQSQIVPIFGYSELRRHYSQLDDNINSLLLVGFGGVIDLEAFLEIDPQEYVIDTDEKSGEQSFRRDIYVLDAHRPWNLDNIFGSQIIQCFDDGTVDDTLGEQKEAYYKLLELDEESGDDELSGDENDNNGGDDEATDADEVTDEDEEDEDETISNKRGNSSIGPNDLSKRKQRKKQIHEYEGVLEEYYSQGTTVVNSISAQIYSLLSAIGETNLSNLWLNILGTTSLDIAYAQVYNRLYPLLQDEVKRLTPSSRNSVKTPDTLTLNIQPDYYLFLLRHSSLYDSFYYSNYVNAKLSLWNENGKKRLHKMFARMGIPLSTAQETWLYMDHSIKRELGIIFDKNLDRYGLQDIIRDGFVRTLGYRGSISASEFVEALTALLEVGNSTDKDSVKINNDNNDDTDGEEEEDNSAQKLTNLRKRWVSNFWLSWDALDDRKVELLNRGIQLAQDLQRAIFNTGVAILEKKLIKHLRIYRLCVLQDGPDLDLYRNPLTLLRLGNWLIECCAESEDKQLLPMVLASIDENTDTYLVAGLTPRYPRGLDTIHTKKPILNNFSMAFQQITAETDAKVRIDNFESSIIEIRREDLSPFLEKLTLSGLL

SEQ ID NO: 22319 - protein, 435 aa, Saccharomyces cerevisiae
MTTNEEFIGTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 22320 - protein, 435 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 22321 - protein, 227 aa, Saccharomyces cerevisiae
MNGLRVAAKIQPARQTIIFLHGLGDTGSGWGFLAQYLQQRDPAAFQHTNFVFPNAPELHVTANGGALMPAWFDILEWDPSFSKVDSDGFMNSLNSIEKTVKQEIDKGIKPEQIIIGGFSQGAALALATSVTLPWKIGGIVALSGFCSIPGILKQHKNGINVKTPIFHGHGDMDPVVPIGLGIKAKQFYQDSCEIQNYEFKVYKGMAHSTVPDELEDLASFIKKSLSS

SEQ ID NO: 22322 - protein, 569 aa, Saccharomyces cerevisiae
MKLKTVRSAVLSSLFASQVLGKIIPAANKRDDDSNSKFVKLPFHKLYGDSLENVGSDKKPEVRLLKRADGYEEIIITNQQSFYSVDLEVGTPPQNVTVLVDTGSSDLWIMGSDNPYCSSNSMGSSRRRVIDKRDDSSSGGSLINDINPFGWLTGTGSAIGPTATGLGGGSGTATQSVPASEATMDCQQYGTFSTSGSSTFRSNNTYFSISYGDGTFASGTFGTDVLDLSDLNVTGLSFAVANETNSTMGVLGIGLPELEVTYSGSTASHSGKAYKYDNFPIVLKNSGAIKSNTYSLYLNDSDAMHGTILFGAVDHSKYTGTLYTIPIVNTLSASGFSSPIQFDVTINGIGISDSGSSNKTLTTTKIPALLDSGTTLTYLPQTVVSMIATELGAQYSSRIGYYVLDCPSDDSMEIVFDFGGFHINAPLSSFILSTGTTCLLGIIPTSDDTGTILGDSFLTNAYVVYDLENLEISMAQARYNTTSENIEIITSSVPSAVKAPGYTNTWSTSASIVTGGNIFTVNSSQTASFSGNLTTSTASATSTSSKRNVGDHIVPSLPLTLISLLFAFI

SEQ ID NO: 22323 - protein, 508 aa, Saccharomyces cerevisiae
MKLQLAAVATLAVLTSPAFGRVLPDGKYVKIPFTKKKNGDNGELSKRSNGHEKFVLANEQSFYSVELAIGTPSQNLTVLLDTGSADLWVPGKGNPYCGSVMDCDQYGVFDKTKSSTFKANKSSPFYAAYGDGTYAEGAFGQDKLKYNELDLSGLSFAVANESNSTFGVLGIGLSTLEVTYSGKVAIMDKRSYEYDNFPLFLKHSGAIDATAYSLFLNDESQSSGSILFGAVDHSKYEGQLYTIPLVNLYKSQGYQHPVAFDVTLQGLGLQTDKRNITLTTTKLPALLDSGTTLTYLPSQAVALLAKSLNASYSKTLGYYEYTCPSSDNKTSVAFDFGGFRINAPLSDFTMQTSVGTCVLAIIPQAGNATAILGDSFLRNAYVVYDLDNYEISLAQAKYGTGKENVEVIKSTVPSAIRAPSYNNTWSNYASATSGGNIFTTVRTFNGTSTATTTRSTTTKKTNSTTTAKSTHKSKRALQRAATNSASSIRSTLGLLLVPSLLILSVFFS

SEQ ID NO: 22324 - protein, 770 aa, Saccharomyces cerevisiae
MDNVVDPWYINPSGFAKDTQDEEYVQHHDNVNPTIPPPDNYILNNENDDGLDNLLGMDYYNIDDLLTQELRDLDIPLVPSPKTGDGSSDKKNIDRTWNLGDENNKVSHYSKKSMSSHKRGLSGTAIFGFLGHNKTLSISSLQQSILNMSKDPQPMELINELGNHNTVKNNNDDFDHIRENDGENSYLSQVLLKQQEELRIALEKQKEVNEKLEKQLRDNQIQQEKLRKVLEEQEEVAQKLVSGATNSNSKPGSPVILKTPAMQNGRMKDNAIIVTTNSANGGYQFPPPTLISPRMSNTSINGSPSRKYHRQRYPNKSPESNGLNLFSSNSGYLRDSELLSFSPQNYNLNLDGLTYNDHNNTSDKNNNDKKNSTGDNIFRLFEKTSPGGLSISPRINGNSLRSPFLVGTDKSRDDRYAAGTFTPRTQLSPIHKKRESVVSTVSTISQLQDDTEPIHMRNTQNPTLRNANALASSSVLPPIPGSSNNTPIKNSLPQKHVFQHTPVKAPPKNGSNLAPLLNAPDLTDHQLEIKTPIRNNSHCEVESYPQVPPVTHDIHKSPTLHSTSPLPDEIIPRTTPMKITKKPTTLPPGTIDQYVKELPDKLFECLYPNCNKVFKRRYNIRSHIQTHLQDRPYSCDFPGCTKAFVRNHDLIRHKISHNAKKYICPCGKRFNREDALMVHRSRMICTGGKKLEHSINKKLTSPKKSLLDSPHDTSPVKETIARDKDGSVLMKMEEQLRDDMRKHGLLDPPPSTAAHEQNSNRTLSNETDAL

SEQ ID NO: 22325 - protein, 582 aa, Saccharomyces cerevisiae
MVQESRPGSVRSYSVGYQARSRSSSQRRHSLTRQRSSQRLIRTISIESDVSNITDDDDLRAVNEGVAGVQLDVSETANKGPRRASATDVTDSLGSTSSEYIEIPFVKETLDASLPSDYLKQDILNLIQSLKISKWYNNKKIQPVAQDMNLVKISGAMTNAIFKVEYPKLPSLLLRIYGPNIDNIIDREYELQILARLSLKNIGPSLYGCFVNGRFEQFLENSKTLTKDDIRNWKNSQRIARRMKELHVGVPLLSSERKNGSACWQKINQWLRTIEKVDQWVGDPKNIENSLLCENWSKFMDIVDRYHKWLISQEQGIEQVNKNLIFCHNDAQYGNLLFTAPVMNTPSLYTAPSSTSLTSQSSSLFPSSSNVIVDDIINPPKQEQSQDSKLVVIDFEYAGANPAAYDLANHLSEWMYDYNNAKAPHQCHADRYPDKEQVLNFLYSYVSHLRGGAKEPIDEEVQRLYKSIIQWRPTVQLFWSLWAILQSGKLEKKEASTAITREEIGPNGKKYIIKTEPESPEEDFVENDDEPEAGVSIDTFDYMAYGRDKIAVFWGDLIGLGIITEEECKNFSSFKFLDTSYL

SEQ ID NO: 22326 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 22327 - protein, 683 aa, Saccharomyces cerevisiae
MTIKEHKVVYEAHNVKALKAPQHFYNSQPGKGYVTDMQHYQEMYQQSINEPEKFFDKMAKEYLHWDAPYTKVQSGSLNNGDVAWFLNGKLNASYNCVDRHAFANPDKPALIYEADDESDNKIITFGELLRKVSQIAGVLKSWGVKKGDTVAIYLPMIPEAVIAMLAVARIGAIHSVVFAGFSAGSLKDRVVDANSKVVITCDEGKRGGKTINTKKIVDEGLNGVDLVSRILVFQRTGTEGIPMKAGRDYWWHEEAAKQRTYLPPVSCDAEDPLFLLYTSGSTGSPKGVVHTTGGYLLGAALTTRYVFDIHPEDVLFTAGDVGWITGHTYALYGPLTLGTASIIFESTPAYPDYGRYWRIIQRHKATHFYVAPTALRLIKRVGEAEIAKYDTSSLRVLGSVGEPISPDLWEWYHEKVGNKNCVICDTMWQTESGSHLIAPLAGAVPTKPGSATVPFFGINACIIDPVTGVELEGNDVEGVLAVKSPWPSMARSVWNHHDRYMDTYLKPYPGHYFTGDGAGRDHDGYYWIRGRVDDVVNVSGHRLSTSEIEASISNHENVSEAAVVGIPDELTGQTVVAYVSLKDGYLQNNATEGDAEHITPDNLRRELILQVRGEIGPFASPKTIILVRDLPRTRSGKIMRRVLRKVASNEAEQLGDLTTLANPEVVPAIISAVENQFFSQKKK

SEQ ID NO: 22328 - protein, 462 aa, Saccharomyces cerevisiae
MFSRTASKFRNTRRLLSTISSQIPGTRTSKLPNGLTIATEYIPNTSSATVGIFVDAGSRAENVKNNGTAHFLEHLAFKGTQNRSQQGIELEIENIGSHLNAYTSRENTVYYAKSLQEDIPKAVDILSDILTKSVLDNSAIERERDVIIRESEEVDKMYDEVVFDHLHEITYKDQPLGRTILGPIKNIKSITRTDLKDYITKNYKGDRMVLAGAGAVDHEKLVQYAQKYFGHVPKSESPVPLGSPRGPLPVFCRGERFIKENTLPTTHIAIALEGVSWSAPDYFVALATQAIVGNWDRAIGTGTNSPSPLAVAASQNGSLANSYMSFSTSYADSGLWGMYIVTDSNEHNVQLIVNEILKEWKRIKSGKISDAEVNRAKAQLKAALLLSLDGSTAIVEDIGRQVVTTGKRLSPEEVFEQVDKITKDDIIMWANYRLQNKPVSMVALGNTSTVPNVSYIEEKLNQ

SEQ ID NO: 22329 - protein, 168 aa, Saccharomyces cerevisiae
MSSTKFLKPLCRIRAFHTSIARSFTIPFLPKIPQKPGGVSGTANDSSYMPPESRAQGSYHWIVERGLSLAVLPLIAVPLVTTGPISTFTDTFLSLVLLGHCHIGFQSCIIDYISERVYGKVHHYAMYLLSLGSFLSFVGIYKLESQEAGLIASLKSLWDNKPVEKKRQ

SEQ ID NO: 22330 - protein, 871 aa, Saccharomyces cerevisiae
MNSLYELDPKWKKLLKTDNFLGGLTVNEFVQELSKDHRNDVLIDANTKNLPTNEKDQDAIREAIWKQLDPKPYIRTFESTLKELKNLNEETLNKRQYFSEQVATQEVIHSENVIKLSKDLHTTLLTFDKLDDRLTNVTQVVSPLGDKLETAIKKKQNYIQSVELIRRYNDFYSMGKSDIVEQLRLSKNWKLNLKSVKLMKNLLILSSKLETSSIPKTINTKLVIEKYSEMMENELLENFNSAYRENNFTKLNEIAIILNNFNGGVNVIQSFINQHDYFIDTKQIDLENEFENVFIKNVKFKEQLIDFENHSVIIETSMQNLINDVETVIKNESKIVKRVFEEKATHVIQLFIQRVFAQKIEPRFEVLLRNSLSISNLAYVRILHGLFTLFGKFTKSLIDYFQLLEIDDSNQILSTTLEQCFADLFSHYLYDRSKYFGIEKRSLEAILVDMTSKFTVNYDKEINKRVLLDKYKEKLSTNVDAFMHSPRGNTHSRQDSTSRSKLSQFNSFLKTHLDKDHLSLNRTNTLSDSFNNSSSSTQYDVANNSSSLVNSSFTASDIDNSPNSPANYSLNDVDSMLKCVVESTARVMELIPNKAHLYILEILKIMFLGIVDSYMEIALEVAYWKICKVDINKTAGVVNLNFLKFISMSTEILDLLSISIKSIFLPLLNNSPEIKAQIIEMTNSQIQKMEILINIILQETITVISTKFSAILCKQKKKDFVPKSQELLDQDTLPAIEIVNILNLIFEQSSKFLKGKNLQTFLTLIGEELYGLLLSHYSHFQVNSIGGVVVTKDIIGYQTAIEDWGVASLIDKFATLRELANLFTVQPELLESLTKEGHLADIGRDIIQSYISNREDFNHDNFINSVKLNFR

SEQ ID NO: 22331 - protein, 412 aa, Saccharomyces cerevisiae
MTKIKVANPIVEMDGDEQTRIIWHLIRDKLVLPYLDVDLKYYDLSVEYRDQTNDQVTVDSATATLKYGVAVKCATITPDEARVEEFHLKKMWKSPNGTIRNILGGTVFREPIIIPRIPRLVPQWEKPIIIGRHAFGDQYKATDVIVPEEGELRLVYKSKSGTHDVDLKVFDYPEHGGVAMMMYNTTDSIEGFAKASFELAIERKLPLYSTTKNTILKKYDGKFKDVFEAMYARSYKEKFESLGIWYEHRLIDDMVAQMLKSKGGYIIAMKNYDGDVESDIVAQGFGSLGLMTSVLITPDGKTFESEAAHGTVTRHFRQHQQGKETSTNSIASIFAWTRGIIQRGKLDNTPDVVKFGQILESATVNTVQEDGIMTKDLALILGKSERSAYVTTEEFIDAVESRLKKEFEAAAL

SEQ ID NO: 22332 - protein, 382 aa, Saccharomyces cerevisiae
MAGTFLFTSESVGEGHPDKICDQVSDAILDACLAEDPHSKVACETAAKTGMIMVFGEITTKAQLDYQKIVRDTIKKIGYDDSAKGFDYKTCNVLVAIEQQSPDIAQGVHEEKDLEDIGAGDQGIMFGYATDETPEGLPLTILLAHKLNMAMADARRDGSLAWLRPDTKTQVTVEYKDDHGRWVPQRIDTVVVSAQHADEITTEDLRAQLKSEIIEKVIPRDMLDENTKYFIQPSGRFVIGGPQGDAGLTGRKIIVDAYGGASSVGGGAFSGKDYSKVDRSAAYAARWVAKSLVAAGLCKRVQVQFSYAIGIAEPLSLHVDTYGTATKSDEEIIDIISKNFDLRPGVLVKELDLARPIYLPTASYGHFTNQEYPWEKPKTLKF

SEQ ID NO: 22333 - protein, 695 aa, Saccharomyces cerevisiae
MIVRMIRLCKGPKLLRSQFASASALYSTKSLFKPPMYQKAEINLIIPHRKHFLLRSIRLQSDIAQGKKSTKPTLKLSNANSKSSGFKDIKRLFVLSKPESKYIGLALLLILISSSVSMAVPSVIGKLLDLASESDGEDEEGSKSNKLYGFTKKQFFTALGAVFIIGAVANASRIIILKVTGERLVARLRTRTMKAALDQDATFLDTNRVGDLISRLSSDASIVAKSVTQNVSDGTRAIIQGFVGFGMMSFLSWKLTCVMMILAPPLGAMALIYGRKIRNLSRQLQTSVGGLTKVAEEQLNATRTIQAYGGEKNEVRRYAKEVRNVFHIGLKEAVTSGLFFGSTGLVGNTAMLSLLLVGTSMIQSGSMTVGELSSFMMYAVYTGSSLFGLSSFYSELMKGAGAAARVFELNDRKPLIRPTIGKDPVSLAQKPIVFKNVSFTYPTRPKHQIFKDLNITIKPGEHVCAVGPSGSGKSTIASLLLRYYDVNSGSIEFGDEDIRNFNLRKYRRLIGYVQQEPLLFNGTILDNILYCIPPEIAEQDDRIRRAIGKANCTKFLANFPDGLQTMVGARGAQLSGGQKQRIALARAFLLDPAVLILDEATSALDSQSEEIVAKNLQRRVERGFTTISIAHRLSTIKHSTRVIVLGKHGSVVETGSFRDLIAIPNSELNALLAEQQDEEGKGGVIDLDNSVAREV

SEQ ID NO: 22334 - protein, 496 aa, Saccharomyces cerevisiae
MSMSNIVVFGGDSHPELVTKICENLDIHPSKVELGKFSNGETNIALRESVREKDVYIIQSGCGQVNDTFMQLLILISACKSASASRVTAVMPYLCYSRQPDIPYTAKGAPIISKPKENYTFESHPGTPVSSSLMTQRPGAESSLKSLDSAIRSTINLENPQPIRTPNSSATANNNFDIKKTLSFSRIPMIPGGKLQNTSNSTDAGELFNAQNAGYKLWVVQAGTLIAHLLSAAGADHVITMDLHDPQFPGFFDIPVDNLYCKPIAQNYIQHRIPDYQDAVIVSPDAGGAKRATAIADALELSFALIHKERRSQLLKGPPDATLTSGGSLPVSPRPLVTTLVSSQNTTSSGATGVAALEMKKTTSTSSTSSQSSNSSKFVQTTMLVGDVRNKVCIIVDDLVDTSYTITRAAKLLKDQGSTKVYALITHGVFSGDALERIGQSSIDKLIISNTVPQDRTLQYLGKDRVDVIDVSCIIGEAIRRIHNGESISMLFEHGW

SEQ ID NO: 22335 - protein, 440 aa, Saccharomyces cerevisiae
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 22336 - protein, 420 aa, Saccharomyces cerevisiae
MSKGKVCLAYSGGLDTSVILAWLLDQGYEVVAFMANVGQEEDFDAAKEKALKIGACKFVCVDCREDFVKDILFPAVQVNAVYEDVYLLGTSLARPVIAKAQIDVAKQEGCFAVSHGCTGKGNDQIRFELSFYALKPDVKCITPWRMPEFFERFAGRKDLLDYAAQKGIPVAQTKAKPWSTDENQAHISYEAGILEDPDTTPPKDMWKLIVDPMDAPDQPQDLTIDFERGLPVKLTYTDNKTSKEVSVTKPLDVFLAASNLARANGVGRIDIVEDRYINLKSRGCYEQAPLTVLRKAHVDLEGLTLDKEVRQLRDSFVTPNYSRLIYNGFLLHPECEYIRSMIQPSQNSVNGTVRVRLYKGNVIILGRSTKTEKLYDPTESSMDELTGFLPTDTTGFIAIQAIRIKKYGESKKTKGEELTL

SEQ ID NO: 22337 - protein, 303 aa, Saccharomyces cerevisiae
MTVTDTFKLFILRHGQSELNSENIFCGWIDAQLTEKGKSQARHSAKLIKQFCDSNNISLPQIGYTSRLIRTQQTMDVILEELGLKHTNYVITTNTNIKEELQDTRFEGSMPVLQTWRLNERHYGAWQGQRKPDILKEYGKEKYMYIRRDYNGKPPKVNLNLEMVQEENDQGSSTGYDFKEPNRHLKYGPEEKANERLPESESLCEVVVRLKPFLNNVVLSTANKISQESCVIVGHGSSVRSLLKVLEGISDEDIKDVDIPNGIPLVIELDRDNYSFVRKFYLDPESAKVNAQMVRDEGFEKNP

SEQ ID NO: 22338 - protein, 396 aa, Saccharomyces cerevisiae
MTVTIKELTNHNYIDHELSATLDSTDAFEGPEKLLEIWFFPHKKSITTEKTLRNIGMDRWIEILKLVKCEVLSMKKTKELDAFLLSESSLFVFDHKLTMKTCGTTTTLFCLEKLFQIVEQELSWAFRTTQGGKYKPFKVFYSRRCFLFPCKQAAIHQNWADEVDYLNKFFDNGKSYSVGRNDKSNHWNLYVTETDRSTPKGKEYIEDDDETFEVLMTELDPECASKFVCGPEASTTALVEPNEDKGHNLGYQMTKNTRLDEIYVNSAQDSDLSFHHDAFAFTPCGYSSNMILAEKYYYTLHVTPEKGWSYASFESNIPVFDISQGKQDNLDVLLHILNVFQPREFSMTFFTKNYQNQSFQKLLSINESLPDYIKLDKIVYDLDDYHLFYMKLQKKI

SEQ ID NO: 22339 - protein, 380 aa, Saccharomyces cerevisiae
MREESRSRKRKHIPVDIEEVEVRSKYFKKNERTVELVKENKINKDLQNYGGVNIDWIKALKPIEYFEWIESRTCDDPRTWGRPITKEEMINDSGAKVPESFLPIYNRVRLMRSKVKTPVDAMGCSMIPVLVSNKCGIPSEKVDPKNFRLQFLIGTMLSAQTRDERMAQAALNITEYCLNTLKIAEGITLDGLLKIDEPVLANLIRCVSFYTRKANFIKRTAQLLVDNFDSDIPYDIEGILSLPGVGPKMGYLTLQKGWGLIAGICVDVHVHRLCKMWNWVDPIKCKTAEHTRKELQVWLPHSLWYEINTVLVGFGQLICMARGKRCDLCLANDVCNARNEKLIESSKFHQLEDKEDIEKVYSHWLDTVTNGITTERHKKK

SEQ ID NO: 22340 - protein, 254 aa, Saccharomyces cerevisiae
MSGYDRALSIFSPDGHIFQVEYALEAVKRGTCAVGVKGKNCVVLGCERRSTLKLQDTRITPSKVSKIDSHVVLSFSGLNADSRILIEKARVEAQSHRLTLEDPVTVEYLTRYVAGVQQRYTQSGGVRPFGVSTLIAGFDPRDDEPKLYQTEPSGIYSSWSAQTIGRNSKTVREFLEKNYDRKEPPATVEECVKLTVRSLLEVVQTGAKNIEITVVKPDSDIVALSSEEINQYVTQIEQEKQEQQEQDKKKKSNH

SEQ ID NO: 22341 - protein, 1093 aa, Saccharomyces cerevisiae
MTSLIDLGRYVERTHHGEDTEPRSKRVKIAKPDLSSFQPGSIIKIRLQDFVTYTLTEFNLSPSLNMIIGPNGSGKSTFVCAVCLGLAGKPEYIGRSKKVEDFIKNGQDVSKIEITLKNSPNVTDIEYIDARDETIKITRIITRSKRRSDYLINDYQVSESVVKTLVAQLNIQLDNLCQFLSQERVEEFARLKSVKLLVETIRSIDASLLDVLDELRELQGNEQSLQKDLDFKKAKIVHLRQESDKLRKSVESLRDFQNKKGEIELHSQLLPYVKVKDHKEKLNIYKEEYERAKANLRAILKDKKPFANTKKTLENQVEELTEKCSLKTDEFLKAKEKINEIFEKLNTIRDEVIKKKNQNEYYRGRTKKLQATIISTKEDFLRSQEILAQTHLPEKSVFEDIDIKRKEIINKEGEIRDLISEIDAKANAINHEMRSIQRQAESKTKSLTTTDKIGILNQDQDLKEVRDAVLMVREHPEMKDKILEPPIMTVSAINAQFAAYLAQCVDYNTSKALTVVDSDSYKLFANPILDKFKVNLRELSSADTTPPVPAETVRDLGFEGYLSDFITGDKRVMKMLCQTSKIHTIPVSRRELTPAQIKKLITPRPNGKILFKRIIHGNRLVDIKQSAYGSKQVFPTDVSIKQTNFYQGSIMSNEQKIRIENEIINLKNEYNDRKSTLDALSNQKSGYRHELSELASKNDDINREAHQLNEIRKKYTMRKSTIETLREKLDQLKREARKDVSQKIKDIDDQIQQLLLKQRHLLSKMASSMKSLKNCQKELISTQILQFEAQNMDVSMNDVIGFFNEREADLKSQYEDKKKFVKEMRDTPEFQSWMREIRSYDQDTKEKLNKVAEKYEEEGNFNLSFVQDVLDKLESEIAMVNHDESAVTILDQVTAELRELEHTVPQQSKDLETIKAKLKEDHAVLEPKLDDIVSKISARFARLFNNVGSAGAVRLEKPKDYAEWKIEIMVKFRDNAPLKKLDSHTQSGGERAVSTVLYMIALQEFTSAPFRVVDEINQGMDSRNERIVHKAMVENACAENTSQYFLITPKLLTGLHYHEKMRIHCVMAGSWIPNPSEDPKMIHFGETSNYSFD

SEQ ID NO: 22342 - protein, 536 aa, Saccharomyces cerevisiae
MIMLRIPTRSYCSPSKLIKGVGLSPLKKSLLSKKIKEDIHPSLPVRTRFAPSPTGFLHLGSLRTALYNYLLARNTNGQFLLRLEDTDQKRLIEGAEENIYEILKWCNINYDETPIKQSERKLIYDKYVKILLSSGKAYRCFCSKERLNDLRHSAMELKPPSMASYDRCCAHLGEEEIKSKLAQGIPFTVRFKSPERYPTFTDLLHGQINLQPQVNFNDKRYDDLILVKSDKLPTYHLANVVDDHLMGITHVIRGEEWLPSTPKHIALYNAFGWACPKFIHIPLLTTVGDKKLSKRKGDMSISDLKRQGVLPEALINFCALFGWSPPRDLASKKHECFSMEELETIFNLNGLTKGNAKVDDKKLWFFNKHFLQKRILNPSTLRELVDDIMPSLESIYNTSTISREKVAKILLNCGGSLSRINDFHDEFYYFFEKPKYNDNDAVTKFLSKNESRHIAHLLKKLGQFQEGTDAQEVESMVETMYYENGFSRKVTYQAMRFALAGCHPGAKIAAMIDILGIKESNKRLSEGLQFLQREKK

SEQ ID NO: 22343 - protein, 676 aa, Saccharomyces cerevisiae
MLRRHGLFWLKTCPRLNVLLNQSIPIPHLLHSRDICQQRWYAKGKRRNQISKKELKPLNFSIPNYISVNKLANLLNCRVERLIKDLTALGFENITTTYILSKEYVELILQEYNFALPNLSTSTNLDNVYDELKSPVNPKLLTKRAPVVTIMGHVDHGKTTIIDYLRKSSVVAQEHGGITQHIGAFQITAPKSGKKITFLDTPGHAAFLKMRERGANITDIIVLVVSVEDSLMPQTLEAIKHAKNSGNEMIIAITKIDRIPQPKEREKKIEKVINDLIVQGIPVEKIGGDVQVIPISAKTGENMDLLEESIVLLSEVMDIRAENSPKTIAEGWIIESQVKKQVGNVATVLVKKGTLQKGKILICGNTFCKIKNLIDDKGIPILKATPSYATEVLGWKDVPHVGDEVIQVKSEAIAKKFISKRQDLIEVQKNSSIVEKLNEERALAKEQHLNKELEHENTVQEHEQNTGPKLINYIIKCDVSGSAEAVSESISSLGNDEVRCNVISSSVGIPTESDLKMAQITESTILCFNLGNLPSEVINNRAGIKIKQYNVIYKLIEDVTETLTENLKPIFEKKIVSTVDVRETFDFRLKKKIIRIAGCKVNNGVIKKNSLVQVVRGPNEDVIFDGKISTLKHNKDDVAEVSKGHECGITFESGFEGFKPGDKILVYENVRVPRYL

SEQ ID NO: 22344 - protein, 1001 aa, Saccharomyces cerevisiae
MSVPAIAPRRKRLADGLSVTQKVFVRSRNGGATKIVREHYLRSDIPCLSRSCTKCPQIVVPDAQNELPKFILSDSPLELSAPIGKHYVVLDTNVVLQAIDLLENPNCFFDVIVPQIVLDEVRNKSYPVYTRLRTLCRDSDDHKRFIVFHNEFSEHTFVERLPNETINDRNDRAIRKTCQWYSEHLKPYDINVVLVTNDRLNREAATKEVESNIITKSLVQYIELLPNADDIRDSIPQMDSFDKDLERDTFSDFTFPEYYSTARVMGGLKNGVLYQGNIQISEYNFLEGSVSLPRFSKPVLIVGQKNLNRAFNGDQVIVELLPQSEWKAPSSIVLDSEHFDVNDNPDIEAGDDDDNNESSSNTTVISDKQRRLLAKDAMIAQRSKKIQPTAKVVYIQRRSWRQYVGQLAPSSVDPQSSSTQNVFVILMDKCLPKVRIRTRRAAELLDKRIVISIDSWPTTHKYPLGHFVRDLGTIESAQAETEALLLEHDVEYRPFSKKVLECLPAEGHDWKAPTKLDDPEAVSKDPLLTKRKDLRDKLICSIDPPGCVDIDDALHAKKLPNGNWEVGVHIADVTHFVKPGTALDAEGAARGTSVYLVDKRIDMLPMLLGTDLCSLKPYVDRFAFSVIWELDDSANIVNVNFMKSVIRSREAFSYEQAQLRIDDKTQNDELTMGMRALLKLSVKLKQKRLEAGALNLASPEVKVHMDSETSDPNEVEIKKLLATNSLVEEFMLLANISVARKIYDAFPQTAMLRRHAAPPSTNFEILNEMLNTRKNMSISLESSKALADSLDRCVDPEDPYFNTLVRIMSTRCMMAAQYFYSGAYSYPDFRHYGLAVDIYTHFTSPIRRYCDVVAHRQLAGAIGYEPLSLTHRDKNKMDMICRNINRKHRNAQFAGRASIEYYVGQVMRNNESTETGYVIKVFNNGIVVLVPKFGVEGLIRLDNLTEDPNSAAFDEVEYKLTFVPTNSDKPRDVYVFDKVEVQVRSVMDPITSKRKAELLLK

SEQ ID NO: 22345 - protein, 592 aa, Saccharomyces cerevisiae
MTEDFISSVKRSNEELKERKSNFGFVEYKSKQLTSSSSHNSNSSHHDDDNQHGKRNIFQRCVDSFKSPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVQYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 22346 - protein, 447 aa, Saccharomyces cerevisiae
MPKESEVINSEFHVDVQDPERLNGHPVAKFINKLSGQPESYVNRTNYIFGRTLGAGSFGVVRQARKLSTNEDVAIKILLKKALQGNNVQLQMLYEELSILQKLSHPNIVSFKDWFESKDKFYIVTQLATGGELFDRILSRGKFTEVDAVEIIVQILGAVEYMHSKNVVHRDLKPENVLYVDKSENSPLVIADFGIAKQLKGEEDLIYKAAGSLGYVAPEVLTQDGHGKPCDIWSIGVITYTLLCGYSPFIAESVEGFMEECTASRYPVTFHMPYWDNISIDVKRFILKALRLNPADRPTATELLDDPWITSKRVETSNILPDVKKGFSLRKKLRDAIEIVKLNNRIKRLRNMYSLGDDGDNDIEENSLNESLLDGVTHSLDDLRLQSQKKGGELTEEQMKLKSALTKDAFVQIVKAATKNKHKVLAGEEEDDSKKTLHDDRESKSED

SEQ ID NO: 22347 - protein, 686 aa, Saccharomyces cerevisiae
MIRPLCSKIIISYIFAISQFLLAANAWSPTDSYVPGTVSCPDDINLVREATSISQNESAWLEKRNKVTSVALKDFLTRATANFSDSSEVLSKLFNDGNSENLPKIAVAVSGGGYRSMLTGAGVLAAMDNRTEGAYEHGLGGLLQSTTYLSGASGGNWLVGTLALNNWTSVQDILNNMQNDDSIWDLSDSIVTPGGINIFKTAKRWDHISNAVESKQNADYNTSLADIWGRALAYNFFPSLNRGGIGLTWSSIRDFPVFQNAEMPFPISVADGRYPGTKVINLNATVFEFNPFEMGSWDPSLNSFANVKYLGTNVSNGVPLERGKCTAGFDNAGFIMGTSSTLFNQFLLRINSTHLPSFITRLARHFLKDLSQDFNDIAVYSPNPFKDTKFLDSDYTTSIVDSDSLFLVDGGEDDENVPVLPLIQKERDVDIIFAVDNSADMRLAWPDGSSLVHTYERQFVKQGQGMSFPYVPDTNTFVNLGLNKKPTFFGCDANNLTDLQYIPPLVVYLPNAEYSFNSNQSAFKLSYSESQRRSMIQNGFEIATRNNFTDDPEFMGCVGCAIIRRKQQALNITLPPECETCFKNYCWNGTLDTTPLPDVEKDVHHSFINVNSFNSSIGQEESLYAGSSASQSSSSSSSSSSSSEIPSATATLEKKAATNSGSHLSGISVKFSAMIMLTLLMFTGAV

SEQ ID NO: 22348 - protein, 769 aa, Saccharomyces cerevisiae
MTIADASKVNHELSSDDDDDVPLSQTLKKRKVASMNSASLQDEAEPYDSDEAISKISKKKTKKIKTEPVQSSSLPSPPAKKSATSKPKKIKKEDGDVKVKTTKKEEQENEKKKREEEEEEDKKAKEEEEEYKWWEKENEDDTIKWVTLKHNGVIFPPPYQPLPSHIKLYYDGKPVDLPPQAEEVAGFFAALLESDHAKNPVFQKNFFNDFLQVLKESGGPLNGIEIKEFSRCDFTKMFDYFQLQKEQKKQLTSQEKKQIRLEREKFEEDYKFCELDGRREQVGNFKVEPPDLFRGRGAHPKTGKLKRRVNPEDIVLNLSKDAPVPPAPEGHKWGEIRHDNTVQWLAMWRENIFNSFKYVRLAANSSLKGQSDYKKFEKARQLKSYIDAIRRDYTRNLKSKVMLERQKAVAIYLIDVFALRAGGEKSEDEADTVGCCSLRYEHVTLKPPNTVIFDFLGKDSIRFYQEVEVDKQVFKNLTIFKRPPKQPGHQLFDRLDPSILNKYLQNYMPGLTAKVFRTYNASKTMQDQLDLIPNKGSVAEKILKYNAANRTVAILCNHQRTVTKGHAQTVEKANNRIQELEWQKIRCKRAILQLDKDLLKKEPKYFEEIDDLTKEDEATIHKRIIDREIEKYQRKFVRENDKRKFEKEELLPESQLKEWLEKVDEKKQEFEKELKTGEVELKSSWNSVEKIKAQVEKLEQRIQTSSIQLKDKEENSQVSLGTSKINYIDPRLSVVFCKKYDVPIEKIFTKTLREKFKWAIESVDENWRF

SEQ ID NO: 22349 - protein, 293 aa, Saccharomyces cerevisiae
MESTSGERSENIHEDQGIPKVILPADFNKCSRTDLVVLISRMLVSLIAINENSATKKSDDQITLTRYHSKIPPNISIFNYFIRLTKFSSLEHCVLMTSLYYIDLLQTVYPDFTLNSLTAHRFLLTATTVATKGLCDSFSTNAHYAKVGGVRCHELNILENDFLKRVNYRIIPRDHNITLCSIEQKQKKFVIDKNALGSLDLDSYSYVNRPKSGYNVLDKYYRRIVQLVGSFNASPDKSRKVDYVLPPNIDIVSESGSQTTQLKGSSSPNSHSSQKRYSEAKDAHIYNKRSKPD

SEQ ID NO: 22350 - protein, 378 aa, Saccharomyces cerevisiae
MRPNKTSLLLALLSILSQANAYEYVNCFSSLPSDFSKADSYNWQSSSHCNSECSAKGASYFALYNHSECYCGDTNPSGSESTSSSCNTYCFGYSSEMCGGEDAYSVYQLDSDTNSNSISSSDSSTESTSASSSTTSSTTSSTTSTTSSTTSSTTSSMASSSTVQNSPESTQAAASISTSQSSSTVTSESSLTSDTLATSSTSSQSQDATSIIYSTTFHTEGGSTIFVTNTITASAQNSGSATGTAGSDSTSGSKTHKKKANVGAIVGGVVGGVVGAVAIALCILLIVRHINMKREQDRMEKEYQEAIKPVEYPDKLYASSFSSNHGPSSGSFEEEHTKGQTDINPFDDSRRISNGTFINGGPGGKNNVLTVVNPDEAD

SEQ ID NO: 22351 - protein, 487 aa, Saccharomyces cerevisiae
MAYSKITLLAALAAIAYAQTQAQINELNVVLDDVKTNIADYITLSYTPNSGFSLDQMPAGIMDIAAQLVANPSDDSYTTLYSEVDFSAVEHMLTMVPWYSSRLLPELEAMDASLTTSSSAATSSSEVASSSIASSTSSSVAPSSSEVVSSSVAPSSSEVVSSSVAPSSSEVVSSSVASSSSEVASSSVAPSSSEVVSSSVASSSSEVASSSVAPSSSEVVSSSVAPSSSEVVSSSVASSSSEVASSSVAPSSSEVVSSSVASSTSEATSSSAVTSSSAVSSSTESVSSSSVSSSSAVSSSEAVSSSPVSSVVSSSAGPASSSVAPYNSTIASSSSTAQTSISTIAPYNSTTTTTPASSASSVIISTRNGTTVTETDNTLVTKETTVCDYSSTSAVPASTTGYNNSTKVSTATICSTCKEGTSTATDFSTLKTTVTVCDSACQAKKSATVVSVQSKTTGIVEQTENGAAKAVIGMGAGALAAVAAMLL

SEQ ID NO: 22352 - protein, 251 aa, Saccharomyces cerevisiae
MAYIKIALLAAIAALASAQTQEEIDELNVILNDVKSNLQEYISLAEDSSSGFSLSSLPSGVLDIGLALASATDDSYTTLYSEVDFAAVSKMLTMVPWYSSRLLPELESLLGTSTTAASSTEASSAATSSAVASSSETTSSAVASSSEATSSAVASSSEASSSAATSSAVASSSEATSSTVASSTKAASSTKASSSAVSSAVASSTKASAISQISDGQVQATSTVSEQTENGAAKAVIGMGAGVMAAAAMLL

SEQ ID NO: 22353 - protein, 1394 aa, Saccharomyces cerevisiae
MSISKYFTPVADGSLTFNGANIQFGADAQGESKKSYDAEDSMPNPANQLNDITFQAEAGEMVLVLGYPTSTLFKTLFHGKTSLSYSPPGSIKFKNNEFKSFSEKCPHQIIYNNEQDVHFPFLTVEQTIDFALSCKFDIPKGERDQIRNELLREFGLSHVLKTIVGNDFFRGVSGGERKRISIIETFIANGSVYLWDNSTKGLDSATALDFLEILRKMAKATRSVNLVRISQASDKIVDKFDKILMLSDSYQLFYGTVDECLTYFRDTLGIEKDPNDCIIEYLTSILNFQFKNKNLGNLSNSSSASVLKTATGEVTKYTYNSDFDLYDQWKHSSYYRNIKQQIQGSSIDDSIKEVDPSDVSPIFNIPLKKQLLFCTKRAFQRSLGDKAYMTAQFISVVIQSLVIGSLFYEIPLTTIGSYSRGSLTFFSILFFTFLSLADMPIAFQRQPVVKKQSQLHFYTNWVETLSTTVFDYCFKLCLVIVFSIILYFLAHLQYKAARFFIFLLFLSFYNFCMVSLFALTTLVAPTISVANLFAGILLLAIAMYASYVIYLKNMHPWFVWIAYLNPAMYAMEAILSNELYNLKLDCSETIVPRGPTYNDVPFSHKACAWQGATLGNDYVRGRDYLKQGLSYTYHHVWRNFGIIIGFLVFFIACTLFASQYIKPYFNKDEIERNNSRLTRWLPFLNKKRGTRSSARNDSKYVGIPKSHSVSSSSSSLSAVPYQISPSNKEMALNDYNEQPITETVETQKHIISWKNINYTVGTKKLINNASGFISSGLTALMGESGAGKTTLLNVLSQRVETGVVSGEILIDGHPLTDEDAFKRSIGFVQQQDLHLDLLSVKESLEISCLLRGDGDRAYLDTVSNLLKLPSDILVADLNPTQRKLLSIGVELVTKPSLLLFLDEPTSGLDAEAALTIVKFLKQLSLQGQAIFCTIHQPSKSVISHFDNIFLLKRGGECVFFGPMDDACGYFMSHDNTLVYDKEHDNPADFVIDAVGNSNSSAGKDTAEEALTLNKEAIDWSALWESSVEKKLVKKETARLEDDARASGVDYTTSLWKQPSYLQQLALITRRQYICTKRDMTYVMAKYCLNGGAGLFIGFSFWHIKHNIIGLQDSIFFCFMALCVSSPLINQIQDKALKTKEVYVAREARSNTYHWTVLLLSQSIIELPLALTSSTLFFVCAFFSCGFNNAGWSAGVFFLNYMLFAAYYSTLGLWLIYTAPNLQTAAVFVAFIYSFTASFCGVMQPYSLFPTFWKFMYRVSPYTYFVETFVSILLHNWEIKCDMSEMVPGQPLTGQSCGQFMEAFIEEYGGYLHNKNTFTVCAYCTYTVGDDFLKNENMSYDHVWRNFGIEWAFVGFNFFAMFAGYYLTYVARIWPKVFKIITKVIPHRGKKPVQN

SEQ ID NO: 22354 - protein, 757 aa, Saccharomyces cerevisiae
MMRGFKQRLIKKTTGSSSSSSSKKKDKEKEKEKSSTTSSTSKKPASASSSSHGTTHSSASSTGSKSTTEKGKQSGSVPSQGKHHSSSTSKTKTATTPSSSSSSSRSSSVSRSGSSSTKKTSSRKGQEQSKQSQQPSQSQKQGSSSSSAAIMNPTPVLTVTKDDKSTSGEDHAHPTLLGAVSAVPSSPISNASGTAVSSDVENGNSNNNNMNINTSNTQDANHASSQSIDIPRSSHSFERLPTPTKLNPDTDLELIKTPQRHSSSRFEPSRYTPLTKLPNFNEVSPEERIPLFIAKVDQCNTMFDFNDPSFDIQGKEIKRSTLDELIEFLVTNRFTYTNEMYAHVVNMFKINLFRPIPPPVNPVGDIYDPDEDEPVNELAWPHMQAVYEFFLRFVESPDFNHQIAKQYIDQDFILKLLELFDSEDIRERDCLKTTLHRIYGKFLSLRSFIRRSMNNIFLQFIYETEKFNGVAELLEILGSIINGFALPLKEEHKVFLVRILIPLHKVRCLSLYHPQLAYCIVQFLEKDPLLTEEVVMGLLRYWPKINSTKEIMFLNEIEDIFEVIEPLEFIKVEVPLFVQLAKCISSPHFQVAEKVLSYWNNEYFLNLCIENAEVILPIIFPALYELTSQLELDTANGEDSISDPYMLVEQAINSGSWNRAIHAMAFKALKIFLETNPVLYENCNALYLSSVKETQQRKVQREENWSKLEEYVKNLRINNDKDQYTIKNPELRNSFNTASENNTLNEENENDCDSEIQ

SEQ ID NO: 22355 - protein, 106 aa, Saccharomyces cerevisiae
MSTLLKSAKSIVPLMDRVLVQRIKAQAKTASGLYLPEKNVEKLNQAEVVAVGPGFTDANGNKVVPQVKVGDQVLIPQFGGSTIKLGNDDEVILFRDAEILAKIAKD

SEQ ID NO: 22356 - protein, 341 aa, Saccharomyces cerevisiae
MQIVQIEQAPKDYISDIKIIPSKSLLLITSWDGSLTVYKFDIQAKNVDLLQSLRYKHPLLCCNFIDNTDLQIYVGTVQGEILKVDLIGSPSFQALTNNEANLGICRICKYGDDKLIAASWDGLIEVIDPRNYGDGVIAVKNLNSNNTKVKNKIFTMDTNSSRLIVGMNNSQVQWFRLPLCEDDNGTIEESGLKYQIRDVALLPKEQEGYACSSIDGRVAVEFFDDQGDDYNSSKRFAFRCHRLNLKDTNLAYPVNSIEFSPRHKFLYTAGSDGIISCWNLQTRKKIKNFAKFNEDSVVKIACSDNILCLATSDDTFKTNAAIDQTIELNASSIYIIFDYEN

SEQ ID NO: 22357 - protein, 589 aa, Saccharomyces cerevisiae
MSLTADEYKQQGNAAFTAKDYDKAIELFTKAIEVSETPNHVLYSNRSACYTSLKKFSDALNDANECVKINPSWSKGYNRLGAAHLGLGDLDEAESNYKKALELDASNKAAKEGLDQVHRTQQARQAQPDLGLTQLFADPNLIENLKKNPKTSEMMKDPQLVAKLIGYKQNPQAIGQDLFTDPRLMTIMATLMGVDLNMDDINQSNSMPKEPETSKSTEQKKDAEPQSDSTTSKENSSKAPQKEESKESEPMEVDEDDSKIEADKEKAEGNKFYKARQFDEAIEHYNKAWELHKDITYLNNRAAAEYEKGEYETAISTLNDAVEQGREMRADYKVISKSFARIGNAYHKLGDLKKTIEYYQKSLTEHRTADILTKLRNAEKELKKAEAEAYVNPEKAEEARLEGKEYFTKSDWPNAVKAYTEMIKRAPEDARGYSNRAAALAKLMSFPEAIADCNKAIEKDPNFVRAYIRKATAQIAVKEYASALETLDAARTKDAEVNNGSSAREIDQLYYKASQQRFQPGTSNETPEETYQRAMKDPEVAAIMQDPVMQSILQQAQQNPAALQEHMKNPEVFKKIQTLIAAGIIRTGR

SEQ ID NO: 22358 - protein, 702 aa, Saccharomyces cerevisiae
MGIQGLLPQLKPIQNPVSLRRYEGEVLAIDGYAWLHRAACSCAYELAMGKPTDKYLQFFIKRFSLLKTFKVEPYLVFDGDAIPVKKSTESKRRDKRKENKAIAERLWACGEKKNAMDYFQKCVDITPEMAKCIICYCKLNGIRYIVAPFEADSQMVYLEQKNIVQGIISEDSDLLVFGCRRLITKLNDYGECLEICRDNFIKLPKKFPLGSLTNEEIITMVCLSGCDYTNGIPKVGLITAMKLVRRFNTIERIILSIQREGKLMIPDTYINEYEAAVLAFQFQRVFCPIRKKIVSLNEIPLYLKDTESKRKRLYACIGFVIHRETQKKQIVHFDDDIDHHLHLKIAQGDLNPYDFHQPLANREHKLQLASKSNIEFGKTNTTNSEAKVKPIESFFQKMTKLDHNPKVANNIHSLRQAEDKLTMAIKRRKLSNANVVQETLKDTRSKFFNKPSMTVVENFKEKGDSIQDFKEDTNSQSLEEPVSESQLSTQIPSSFITTNLEDDDNLSEEVSEVVSDIEEDRKNSEGKTIGNEIYNTDDDGDGDTSEDYSETAESRVPTSSTTSFPGSSQRSISGCTKVLQKFRYSSSFSGVNANRQPLFPRHVNQKSRGMVYVNQNRDDDCDDNDGKNQITQRPSLRKSLIGARSQRIVIDMKSVDERKSFNSSPILHEESKKRDIETTKSSQARPAVRSISLLSQFVYKGK

SEQ ID NO: 22359 - protein, 749 aa, Saccharomyces cerevisiae
MTSMSIIDDENVKKTSNGAAVVTDVAQHAVSDSDNNKAQLLGDGSNTEYVVDIFIEAAKDGDLKVVKDVVESGAVDINNDRIDELSGLHWACINNRFSVAKFLLLRGANPNQAAGPGGATALHWAARYGNIYIVDLLLKHGADPTLKDEQGLNIMHFSVYSSNILLVVYVLYFVVNNNDNVDIDSKDNNNRTPLLWAAYQGDFLTVELLLKFGSTVAWTDNRGFNALHCALVGGDQRVICDLILSGANFYERNNQKQDCFDLAEGMGTKSLFEQALQHHGYDRLGNQKDKLFKKSSHAQFTIFLSPFLLMVYIYLISLVLSPVLAIMLSLLVTVVMVNTLKKFVLPCLPRKNTYKVSLTRTPFFSGLFLSTFCFLIYIWTKKLYPYSVSDYTMKNVQFLVTSFLTVVLFLRLVRSDPGCLKTDDSLTSIQETIKQLIDLGKFDRENFCVETLERKPLRSKYSFFSGALVARYDHYCPWIYNDVGLKNHKLFVFFAVTVQYHMFLFMWLCLAYFKKTNYIYEQVEEYARCALLKNETLCKGSNYDPSTFFLFIWISVNFIWLGAMLIVQFFQILKGITTPELFILIKEEHKAKFINLIPFENSIYTSESKGVEDSDMIPEGPSATTITHTISIDGLEPRNRRRAILSACFSMMGINQWLVTIKEIVGITHILHGQVPQQHHSSLLRSFLVTNHWKTNLTDFWLNSDVTAPLWQRFFYSSDTSKAMLGGTEVDYYELYEYPAREGEVLRPN

SEQ ID NO: 22360 - protein, 258 aa, Saccharomyces cerevisiae
MGSRSENVGTVTREGSRVEQDDVLMDDDSDSSEYVDMWIDLFLGRKGHEYFCDVDPEYITDRFNLMNLQKTVSKFSYVVQYIVDDLDDSILENMTHARLEQLESDSRKLYGLIHARYIITIKGLQKMYAKYKEADFGRCPRVYCNLQQLLPVGLHDIPGIDCVKLYCPSCEDLYIPKSSRHSSIDGAYFGTSFPGMFLQAFPDMVPKHPTKRYVPKIFGFELHKQAQLTRWQELQRLKLVEKLESKDVDLTKSGGFKT

SEQ ID NO: 22361 - protein, 285 aa, Saccharomyces cerevisiae
MKFLLQQIRNMHVKPIKMRWLTGGVNYSYLLSTEDRRNSWLIDPAEPLEVSPKLSAEEKKSIDAIVNTHHHYDHSGGNLALYSILCQENSGHDIKIIGGSKSSPGVTEVPDNLQQYHLGNLRVTCIRTPCHTKDSICYYIKDLETGEQCIFTGDTLFIAGCGRFFEGTGRDMDMALNQIMLRAVGETNWNKVKIYPGHEYTKGNVSFIRAKIYSDIGQNKEFDALEQYCKSNECTTGHFTLRDELGYNPFMRLDDRAVRLAVGDTAGTYPRSVVMQELRKLKNAM

SEQ ID NO: 22362 - protein, 482 aa, Saccharomyces cerevisiae
MSDTKRDPADLLASLKIDNEKEDTSEVSTKETVKSQPEKTADSIKPAEKLVPKVEEKKTKQEDSNLISSEYEVKVKLADIQADPNSPLYSAKSFDELGLAPELLKGIYAMKFQKPSKIQERALPLLLHNPPRNMIAQSQSGTGKTAAFSLTMLTRVNPEDASPQAICLAPSRELARQTLEVVQEMGKFTKITSQLIVPDSFEKNKQINAQVIVGTPGTVLDLMRRKLMQLQKIKIFVLDEADNMLDQQGLGDQCIRVKRFLPKDTQLVLFSATFADAVRQYAKKIVPNANTLELQTNEVNVDAIKQLYMDCKNEADKFDVLTELYGLMTIGSSIIFVATKKTANVLYGKLKSEGHEVSILHGDLQTQERDRLIDDFREGRSKVLITTNVLARGIDIPTVSMVVNYDLPTLANGQADPATYIHRIGRTGRFGRKGVAISFVHDKNSFNILSAIQKYFGDIEMTRVPTDDWDEVEKIVKKVLKD

SEQ ID NO: 22363 - protein, 885 aa, Saccharomyces cerevisiae
METATSSPLPIKSRRNSENSGSTTVIPHMNPSLATPLTVSTMVNQSNSKEFMKLTPVRIRDFGSPLKNVSTNYHFLDSENGKGNTMDNMYRENFILISKDLEKLLENLNVIYQNIGYSNTEIITKEKIIFTTISNSIKQFFEQADEELKRLSAENGIEQDILNNILERINDPSGIKTIPDLYIRNAILLQESKTVPQSPKKPLSLLSKKAALDTAKKFVLGSFLPRLRDYLKSLITLKHLIQSVKENLPGLTEADNEAIAEFPELSTLTAYLLQIENGKGDIGLSMKFIIDNRKDILKGSAFKTINEESVKHMNEVIKIYEEEYERRFKSVLTKKVSISSICEQLGTPLATLIGEDFEQDLRSYGEEENSTSEIPNFHPVDRERMSKIDITLEKLQAIHKERADKKRLLMEQCQKLWTRLKISQEYIKTFMRNNSSLSTESLGRISKEVMRLEAMKKKLIKKLISDSWDKIQELWRTLQYSEESRSKFIIVFEELRNSATTLQEDELLLETCENELKRLEEKLTLYKPILKLISDFESLQEDQEFLERSSKDSSRLLSRNSHKILLTEEKMRKRITRHFPRVINDLRIKLEEADGLFDQPFLFKGKPLSEAIDIQQQEIEAKYPRCRVRMQRSKKGKCGANKENKVIKNTFKATESSIRVPIGLNLNDANITYKTPSKKTIQGLTKNDLSQENSLARHMQGTTKLSSPNRRATRLLAPTVISRNSKGNIERPTLNRNRSSDLSSSPRINHTHGEHAVKPRQLFPIPLNKVDTKGSHIPQLTKEKALELLKRSTGTTGKENVRSPERKSSLEDYAQKLSSPYKEPEHSIYKLSMSPEGKFQLNIQQKDIESGFDDTSMMEDENDKDFITWKNEQVSKLNGFSFTDI

SEQ ID NO: 22364 - protein, 339 aa, Saccharomyces cerevisiae
MPLPPSTLNQKSNRVYSVARVYKNACEERPQEYWDYEQGVTIDWGKISNYEIINKIGRGKYSEVFSGRCIVNNQKCVIKVLKPVKMKKIYRELKILTNLTGGPNVVGLYDIVQDADSKIPALIFEEIKNVDFRTLYPTFKLPDIQYYFTQLLIALDYCHSMGIMHRDVKPQNVMIDPTERKLRLIDWGLAEFYHPGVDYNVRVASRYHKGPELLVNLNQYDYSLDLWSVGCMLAAIVFKKEPFFKGSSNPDQLVKIATVLGTKELLGYLGKYGLHLPSEYDNIMRDFTKKSWTHFITSETKLAVPEVVDLIDNLLRYDHQERLTAKEAMDHKFFKTKFE

SEQ ID NO: 22365 - protein, 210 aa, Saccharomyces cerevisiae
MNTSVTSIKLVLLGEAAVGKSSIVLRFVSNDFAENKEPTIGAAFLTQRVTINEHTVKFEIWDTAGQERFASLAPMYYRNAQAALVVYDVTKPQSFIKARHWVKELHEQASKDIIIALVGNKIDMLQEGGERKVAREEGEKLAEEKGLLFFETSAKTGENVNDVFLGIGEKIPLKTAEEQNSASNERESNNQRVDLNAANDGTSANSACSC

SEQ ID NO: 22366 - protein, 183 aa, Saccharomyces cerevisiae
MGNSISKVLGKLFGSKEMKILMLGLDKAGKTTILYKLKLNKIKTSTPTVGFNVETVTYKNVKFNMWDVGGQQRLRPLWRHYFPATTALIFVIDSSARNRMEEAKEELYSIIGEKEMENVVLLVWANKQDLKDAMKPQEVSDFLELEKNLKNQPWCVIGSNALSGQGLVEGLSWISNNTNVPKK

SEQ ID NO: 22367 - protein, 393 aa, Saccharomyces cerevisiae
MAKIMIPASKQPVYKKLGLLLVAVFTVYVFFHGAQYARGSAPSPKYSTVLSSGSGYKYSKVELPKYTGPREKATFVTLVRNRDLYSLAESIKSVEDRFNSKFNYDWVFLNDEEFTDEFKNVTSALVSGTTKYGVIPKEHWSFPEWIDEEKAAQVRKEMGEKRIIYGDSISYRHMCRFESGFFYRHPLMDDYDWYWRVEPDIKLHCDIDYDVFKFMKDNKKKYAFAISIKEYEATIPTLWETTRKFMEAHPELIHENNMLDFVSDDQGLSYNLCHFWSNFEIAALDLWRSPAYSAYFDYLDREGGFFYERWGDAPVHSIGAALFLDRSEIHHFGDIGYYHVPFHSCPIDTSIRLANKCDCDPSKDFTWHSYSCTTKFYNINKLPKPAGWQNHIG

SEQ ID NO: 22368 - protein, 327 aa, Saccharomyces cerevisiae
MSSDTSLSESSLLKEESGSLTKSRPPIKSNPVRENIKSFVAGGVGGVCAVFTGHPFDLIKVRCQNGQANSTVHAITNIIKEAKTQVKGTLFTNSVKGFYKGVIPPLLGVTPIFAVSFWGYDVGKKLVTFNNKQGGSNELTMGQMAAAGFISAIPTTLVTAPTERVKVVLQTSSKGSFIQAAKTIVKEGGIASLFKGSLATLARDGPGSALYFASYEISKNYLNSRQPRQDAGKDEPVNILNVCLAGGIAGMSMWLAVFPIDTIKTKLQASSTRQNMLSATKEIYLQRGGIKGFFPGLGPALLRSFPANAATFLGVEMTHSLFKKYGI

SEQ ID NO: 22369 - protein, 309 aa, Saccharomyces cerevisiae
MQGNKSTIREYKIVVVGGGGVGKSALTIQFIQSYFVDEYDPTIEDSYRKQVVIDDKVSILDILDTAGQEEYSAMREQYMRTGEGFLLVYSVTSRNSFDELLSYYQQIQRVKDSDYIPVVVVGNKLDLENERQVSYEDGLRLAKQLNAPFLETSAKQAINVDEAFYSLIRLVRDDGGKYNSMNRQLDNTNEIRDSELTSSATADREKKNNGSYVLDNSLTNAGTGSSSKSAVNHNGETTKRTDEKNYVNQNNNNEGNTKYSSNGNGNRSDISRGNQNNALNSRSKQSAEPQKNSSANARKESSGGCCIIC

SEQ ID NO: 22370 - protein, 1460 aa, Saccharomyces cerevisiae
MKEVVVSETPKRIKGLEFSALSAADIVAQSEVEVSTRDLFDLEKDRAPKANGALDPKMGVSSSSLECATCHGNLASCHGHFGHLKLALPVFHIGYFKATIQILQGICKNCSAILLSETDKRQFLHELRRPGVDNLRRMGILKKILDQCKKQRRCLHCGALNGVVKKAAAGAGSAALKIIHDTFRWVGKKSAPEKDIWVGEWKEVLAHNPELERYVKRCMDDLNPLKTLNLFKQIKSADCELLGIDATVPSGRPETYIWRYLPAPPVCIRPSVMMQDSPASNEDDLTVKLTEIVWTSSLIKAGLDKGISINNMMEHWDYLQLTVAMYINSDSVNPAMLPGSSNGGGKVKPIRGFCQRLKGKQGRFRGNLSGKRVDFSGRTVISPDPNLSIDEVAVPDRVAKVLTYPEKVTRYNRHKLQELIVNGPNVHPGANYLLKRNEDARRNLRYGDRMKLAKNLQIGDVVERHLEDGDVVLFNRQPSLHRLSILSHYAKIRPWRTFRLNECVCTPYNADFDGDEMNLHVPQTEEARAEAINLMGVKNNLLTPKSGEPIIAATQDFITGSYLISHKDSFYDRATLTQLLSMMSDGIEHFDIPPPAIMKPYYLWTGKQVFSLLIKPNHNSPVVINLDAKNKVFVPPKSKSLPNEMSQNDGFVIIRGSQILSGVMDKSVLGDGKKHSVFYTILRDYGPQEAANAMNRMAKLCARFLGNRGFSIGINDVTPADDLKQKKEELVEIAYHKCDELITLFNKGELETQPGCNEEQTLEAKIGGLLSKVREEVGDVCINELDNWNAPLIMATCGSKGSTLNVSQMVAVVGQQIISGNRVPDGFQDRSLPHFPKNSKTPQSKGFVRNSFFSGLSPPEFLFHAISGREGLVDTAVKTAETGYMSRRLMKSLEDLSCQYDNTVRTSANGIVQFTYGGDGLDPLEMEGNAQPVNFNRSWDHAYNITFNNQDKGLLPYAIMETANEILGPLEERLVRYDNSGCLVKREDLNKAEYVDQYDAERDFYHSLREYINGKATALANLRKSRGMLGLLEPPAKELQGIDPDETVPDNVKTSVSQLYRISEKSVRKFLEIALFKYRKARLEPGTAIGAIGAQSIGEPGTQMTLKTFHFAGVASMNVTLGVPRIKEIINASKVISTPIINAVLVNDNDERAARVVKGRVEKTLLSDVAFYVQDVYKDNLSFIQVRIDLGTIDKLQLELTIEDIAVAITRASKLKIQASDVNIIGKDRIAINVFPEGYKAKSISTSAKEPSENDVFYRMQQLRRALPDVVVKGLPDISRAVINIRDDGKRELLVEGYGLRDVMCTDGVIGSRTTTNHVLEVFSVLGIEAARYSIIREINYTMSNHGMSVDPRHIQLLGDVMTYKGEVLGITRFGLSKMRDSVLQLASFEKTTDHLFDAAFYMKKDAVEGVSECIILGQTMSIGTGSFKVVKGTNISEKDLVPKRCLFESLSNEAALKAN

SEQ ID NO: 22371 - protein, 434 aa, Saccharomyces cerevisiae
MATLEELDAQTLPGDDELDQEILNLSTQELQTRAKLLDNEIRIFRSELQRLSHENNVMLEKIKDNKEKIKNNRQLPYLVANVVEVMDMNEIEDKENSESTTQGGNVNLDNTAVGKAAVVKTSSRQTVFLPMVGLVDPDKLKPNDLVGVNKDSYLILDTLPSEFDSRVKAMEVDEKPTETYSDVGGLDKQIEELVEAIVLPMKRADKFKDMGIRAPKGALMYGPPGTGKTLLARACAAQTNATFLKLAAPQLVQMYIGEGAKLVRDAFALAKEKAPTIIFIDELDAIGTKRFDSEKSGDREVQRTMLELLNQLDGFSSDDRVKVLAATNRVDVLDPALLRSGRLDRKIEFPLPSEDSRAQILQIHSRKMTTDDDINWQELARSTDEFNGAQLKAVTVEAGMIALRNGQSSVKHEDFVEGISEVQARKSKSVSFYA

SEQ ID NO: 22372 - protein, 312 aa, Saccharomyces cerevisiae
MPATLHDSTKILSLNTGAQIPQIGLGTWQSKENDAYKAVLTALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIKTNRKIFTLSTEDFEAINNISKEKGEKRVVHPNWSPFEVFK

SEQ ID NO: 22373 - protein, 126 aa, Saccharomyces cerevisiae
MSWQAYTDNLIGTGKVDKAVIYSRAGDAVWATSGGLSLQPNEIGEIVQGFDNPAGLQSNGLHIQGQKFMLLRADDRSIYGRHDAEGVVCVRTKQTVIIAHYPPTVQAGEATKIVEQLADYLIGVQY

SEQ ID NO: 22374 - protein, 1272 aa, Saccharomyces cerevisiae
MPNEDNELQKAIENHHNQLLNQDKENADRNGSVIEDLPLYGTSINQQSTPGDVDDGKHLLYPDIATNLPLKTSDRLLDDILCDTIFLNSTDPKVMQKGLQSRGILKESMLSYSTFRSSIRPNCLGSLTDQVVFQTKSEYDSISCPKYNKIHVFQAVIFNPSLAEQQISTFDDIVKIPIYHLKVSVKVRQELERLKKHVGVTQFHSLDHLHEYDRVDLSTFDSSDPNLLDYGIYVSDDTNKLILIEIFKPEFNSPEEHESFTADAIKKRYNAMCVKNESLDKSETPSQVDCFYTLFKIFKGPLTRKSKAEPTKTIDSGNLALNTHLNPEWLTSKYGFQASSEIDEETNEIFTEYVPPDMVDYVNDLETRKIRESFVRKCLQLIFWGQLSTSLLAPNSPLKNTKSVKGMSSLQTSFSTLPWFHLLGESRARILLNSNEQTHSPLDAEPHFINLSVSHYYTDRDIIRNYESLSSLDPENIGLYFDALTYIANRKGAYQLIAYCGKQDIIGQEALENALLMFKINPKECNISELNEATLLSIYKYETSNKSQVTSNHLTNLKNALRLLAKYTKSDKLKFYVDHEPYRALSQAYDTLSIDESVDEDIIKTAYSVKINDSPGLKLDCDRALYTIAISKRSLDLFNFLTEECPQFSNYYGPEKLDYQEALKLLQVNENASDETILKIFKQKWFDENVYEPDQFLILRAALTKISIERNSTLITNFLLTGTIDPNSLPPENWPTGINNIGNTCYLNSLLQYYFSIAPLRRYVLEYQKTVENFNDHLSNSGHIRRIGGREISRGEVERSIQFIYQLRNLFYAMVHTRERCVTPSKELAYLAFAPSNVEVEFEVEGNKVVDQTGVLSDSKKETTDDAFTTKIKDTSLIDLEMEDGLNGDVGTDANRKKNESNDAEVSENEDTTGLTSPTRVAKISSDQLENALEMGRQQDVTECIGNVLFQIESGSEPIRYDEDNEQYDLVKQLFYGTTKQSIVPLSATNKVRTKVERFLSLLINIGDHPKDIYDAFDSYFKDEYLTMEEYGDVIRTVAVTTFPTILQVQIQRVYYDRERLMPFKSIEPLPFKEVIYMDRYADTENPLLLAKKKETEEMKQKLKVMKNRQRELLSRDDSGLTRKDAFLESIKLLESDTIKKTPLKIEAANDVIKTLRNNVQNIDNELMKLYNDINSLEEKISHQFDDFKEYGYSLFSVFIHRGEASYGHYWIYIKDRNRNGIWRKYNDETISEVQEEEVFNFNEGNTATPYFLVYVKQGQEGDIEPLKRILK

SEQ ID NO: 22375 - protein, 1007 aa, Saccharomyces cerevisiae
MASTAPNEQFPSCVRCKEFITTGHAYELGCDRWHTHCFACYKCEKPLSCESDFLVLGTGALICFDCSDSCKNCGKKIDDLAIILSSSNEAYCSDCFKCCKCGENIADLRYAKTKRGLFCLSCHEKLLAKRKYYEEKKRRLKKNLPSLPTPVIDNGHTDEVSASAVLPEKTFSRPASLVNEIPSGSEPSKDIETNSSDIVPHFITGYNDSDDNSGSSKFGSNVSIDVIGPEENSTEHVNDDVKEEAEAPSANMSLNVATDPTLSCKEPPSHSRNLLNKTPLRNSSGQYLAKSPSSYRQGIIVNDSLEESDQIDPPNNSSRNASELLTSVLHSPVSVNMKNPKGSNTDIFNTGEISQMDPSLSRKVLNNIVEETNALQRPVVEVVKEDRSVPDLAGVQQEQAEKYSYSNNSGKGRKISRSLSRRSKDLMINLKSRATGKQDSNVKLSPASKVTSRRSQDLMRDNDSHTGLDTPNSNSTSLDILVNNQKSLNYKRFTDNGTLRVTSGKETALEEQKNHSFKSPSPIDHLLQSPATPSNVSMYRTPPLDSSLTFDRRNGSSYSNQNYSIPSWQKTPKTQLENSDNFEEQKETLYENSESRNDPSLDKEIVTAEHYLKQLKINLKELESQREELMKEITEMKSMKEALRRHIESYNSEKNKLYLDSNELSNNPPMINEISLGESPPVKHVATASSVARSSVKPKFWKFFSSAKPQTEQSIQGVSTNNTNSIVKSAPVLLSAPSSGSNSGRLEISPPVLQNPNEFSDVRLVPIENDANMGQSKDGEEYLDGSNLYGSSLVARCNYENNEIPMILSVCIDFIESDEENMRSEGIYRKSGSQLVIEEIEKQFSAWKVQQNTETPNILTEQDLNVVTGVLKRYLRKLPNPIFTFQIYEPLMRLVKSKKMMENLPFVGGKLSLEAKNSDTYMSSKSALKNILEDLPREHYRVLRVLSEHIEKVTRYSHWNRMTLYNLALVFAPGLIRDFSGEKDIIDMKERNYIVAFIFGNYKDILT

SEQ ID NO: 22376 - protein, 292 aa, Saccharomyces cerevisiae
MEDSKKKGLIEGAILDIINGSIAGACGKVIEFPFDTVKVRLQTQASNVFPTTWSCIKFTYQNEGIARGFFQGIASPLVGACLENATLFVSYNQCSKFLEKHTNVFPLGQILISGGVAGSCASLVLTPVELVKCKLQVANLQVASAKTKHTKVLPTIKAIITERGLAGLWQGQSGTFIRESFGGVAWFATYEIVKKSLKDRHSLDDPKRDESKIWELLISGGSAGLAFNASIFPADTVKSVMQTEHISLTNAVKKIFGKFGLKGFYRGLGITLFRAVPANAAVFYIFETLSAL

SEQ ID NO: 22377 - protein, 369 aa, Saccharomyces cerevisiae
MLRNTFFRNTSRRFLATVKQPSIGRYTGKPNPSTGKYTVSFIEGDGIGPEISKSVKKIFSAANVPIEWESCDVSPIFVNGLTTIPDPAVQSITKNLVALKGPLATPIGKGHRSLNLTLRKTFGLFANVRPAKSIEGFKTTYENVDLVLIRENTEGEYSGIEHIVCPGVVQSIKLITRDASERVIRYAFEYARAIGRPRVIVVHKSTIQRLADGLFVNVAKELSKEYPDLTLETELIDNSVLKVVTNPSAYTDAVSVCPNLYGDILSDLNSGLSAGSLGLTPSANIGHKISIFEAVHGSAPDIAGQDKANPTALLLSSVMMLNHMGLTNHADQIQNAVLSTIASGPENRTGDLAGTATTSSFTEAVIKRL

SEQ ID NO: 22378 - protein, 329 aa, Saccharomyces cerevisiae
MLRSTVSKASLKICRHFHRESIPYDKTIKNLLLPKDTKVIFQGFTGKQGTFHASISQEYGTNVVGGTNPKKAGQTHLGQPVFASVKDAIKETGATASAIFVPPPIAAAAIKESIEAEIPLAVCITEGIPQHDMLYIAEMLQTQDKTRLVGPNCPGIINPATKVRIGIQPPKIFQAGKIGIISRSGTLTYEAVQQTTKTDLGQSLVIGMGGDAFPGTDFIDALKLFLEDETTEGIIMLGEIGGKAEIEAAQFLKEYNFSRSKPMPVASFIAGTVAGQMKGVRMGHSGAIVEGSGTDAESKKQALRDVGVAVVESPGYLGQALLDQFAKFK

SEQ ID NO: 22379 - protein, 1224 aa, Saccharomyces cerevisiae
MSDLANSEKYYDEDPYGFEDESAPITAEDSWAVISAFFREKGLVSQQLDSFNQFVDYTLQDIICEDSTLILEQLAQHTTESDNISRKYEISFGKIYVTKPMVNESDGVTHALYPQEARLRNLTYSSGLFVDVKKRTYEAIDVPGRELKYELIAEESEDDSESGKVFIGRLPIMLRSKNCYLSEATESDLYKLKECPFDMGGYFIINGSEKVLIAQERSAGNIVQVFKKAAPSPISHVAEIRSALEKGSRFISTLQVKLYGREGSSARTIKATLPYIKQDIPIVIIFRALGIIPDGEILEHICYDVNDWQMLEMLKPCVEDGFVIQDRETALDFIGRRGTALGIKKEKRIQYAKDILQKEFLPHITQLEGFESRKAFFLGYMINRLLLCALDRKDQDDRDHFGKKRLDLAGPLLAQLFKTLFKKLTKDIFRYMQRTVEEAHDFNMKLAINAKTITSGLKYALATGNWGEQKKAMSSRAGVSQVLNRYTYSSTLSHLRRTNTPIGRDGKLAKPRQLHNTHWGLVCPAETPEGQACGLVKNLSLMSCISVGTDPMPIITFLSEWGMEPLEDYVPHQSPDATRVFVNGVWHGVHRNPARLMETLRTLRRKGDINPEVSMIRDIREKELKIFTDAGRVYRPLFIVEDDESLGHKELKVRKGHIAKLMATEYQDIEGGFEDVEEYTWSSLLNEGLVEYIDAEEEESILIAMQPEDLEPAEANEENDLDVDPAKRIRVSHHATTFTHCEIHPSMILGVAASIIPFPDHNQSPRNTYQSAMGKQAMGVFLTNYNVRMDTMANILYYPQKPLGTTRAMEYLKFRELPAGQNAIVAIACYSGYNQEDSMIMNQSSIDRGLFRSLFFRSYMDQEKKYGMSITETFEKPQRTNTLRMKHGTYDKLDDDGLIAPGVRVSGEDVIIGKTTPISPDEEELGQRTAYHSKRDASTPLRSTENGIVDQVLVTTNQDGLKFVKVRVRTTKIPQIGDKFASRHGQKGTIGITYRREDMPFTAEGIVPDLIINPHAIPSRMTVAHLIECLLSKVAALSGNEGDASPFTDITVEGISKLLREHGYQSRGFEVMYNGHTGKKLMAQIFFGPTYYQRLRHMVDDKIHARARGPMQVLTRQPVEGRSRDGGLRFGEMERDCMIAHGAASFLKERLMEASDAFRVHICGICGLMTVIAKLNHNQFECKGCDNKIDIYQIHIPYAAKLLFQELMAMNITPRLYTDRSRDF

SEQ ID NO: 22380 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 22381 - protein, 261 aa, Saccharomyces cerevisiae
MAGLSFDNYQRNNFLAENSHTQPKATSTGTTIVGVKFNNGVVIAADTRSTQGPIVADKNCAKLHRISPKIWCAGAGTAADTEAVTQLIGSNIELHSLYTSREPRVVSALQMLKQHLFKYQGHIGAYLIVAGVDPTGSHLFSIHAHGSTDVGYYLSLGSGSLAAMAVLESHWKQDLTKEEAIKLASDAIQAGIWNDLGSGSNVDVCVMEIGKDAEYLRNYLTPNVREEKQKSYKFPRGTTAVLKESIVNICDIQEEQVDITA

SEQ ID NO: 22382 - protein, 393 aa, Saccharomyces cerevisiae
MLSRTIRTQGSFLRRSQLTITRSFSVTFNMQNAQKRSPTGIVLMNMGGPSKVEETYDFLYQLFADNDLIPISAKYQKTIAKYIAKFRTPKIEKQYREIGGGSPIRKWSEYQATEVCKILDKTCPETAPHKPYVAFRYAKPLTAETYKQMLKDGVKKAVAFSQYPHFSYSTTGSSINELWRQIKALDSERSISWSVIDRWPTNEGLIKAFSENITKKLQEFPQPVRDKVVLLFSAHSLPMDVVNTGDAYPAEVAATVYNIMQKLKFKNPYRLVWQSQVGPKPWLGAQTAEIAEFLGPKVDGLMFIPIAFTSDHIETLHEIDLGVIGESEYKDKFKRCESLNGNQTFIEGMADLVKSHLQSNQLYSNQLPLDFALGKSNDPVKDLSLVFGNHEST

SEQ ID NO: 22383 - protein, 464 aa, Saccharomyces cerevisiae
MPEDTSYSNSFEDYYNNSHAISPYKDSFYKEMTPSKPNVRFGDDDVNIFDQRKKVNEINKNNTVKRSIPSSISTTITPNKSSLKSPRGKRASKNSFDNETKLESKNETLKEVNDAVNRCYALCNIPTKHVSINSISDLAQTFETLAVGITHETNRKAECERSKNAIDSLYYHEQLEKKELNEKSLQMAIDHLLKVTKQNLRQADDGNKLKETEALKSFIEEIEEVDDNKISINSLQQQLLEEKTANNILRRDYYKLQERGRRLCHEFQELQDDYSKQMKQKEYEVQKLKNEIKVLLNMNDNLKAEKAHYSQKEKQYFQKYTYIEKYMNHVKEEYNRKEDECKKLNFIIDKSMKKIEHLERSLQTQFTAQNSFSTAMIQEEGPKDAHLKDRYHKVKEFMEQKLQTSKINDPSCSEAEALDNVLCLIESSMKTLDKNSKCYPIATKKCIKYVTDSPRLKENEHVTN

SEQ ID NO: 22384 - protein, 793 aa, Saccharomyces cerevisiae
MVIQTATTLSPAKARPSFPHNDLIKSMSDSLISRPTHPPIRKLKSSLKISHPEPISRSKSEIFCTSPEKNVRFAIELTTVKRFDKNAEPSSISNENSPTLSPVDSNTAADDVQLFNNEDCWFNDSSLVTNLLKNEKKFRYMNSLNNMFKLDLYDSEDEDDIDEHINSQAEYGYTYNSLSTRGKTSENKSATSSLATQATNICDWKLHCTDLVPFKIAPPLFTKTLSASDLQGQLTKYLNGQNVKLHSLTQLGDDSSKITGLVYVKNLSFEKYLEIKFTFNSWRDIHYVTANFNRTINSNVDEFKFTIDLNSLKYILLIKRIITMEKNTSSCPLNIELCCRYDVNNETYYDNNNGKNYHLFMTTFKKGGETKEKIPVVVEPASQTDAAMSPKEMKARFVSSNPTLSRFLPQSRKFSEDTDYYNTSPLKHLYHNDTTSWVKPKRLNVVLDKLENATPPPPSSALANDTARTGKITKDKNNVLAPPTASNSIDLPILGSQHQSLYSGSSSYSSSSSSISSSLSFASSNNSSTNSSSASCSFPLTELDNFDYANLYEPNDTFTTANLFNHSLNSLMPEISTPSFFGGFRNENTINNNDSKNLVTSLEDSYEDKQSVITDTTMDENNKTSTINNSTDTLIKPSKENGTVKENKSSANSTSAPSSSQNRASTILNDHSNGKSDLKYVNYQSLLDSHCFYNHPSSPNLQSTSFSSAAPFSGISQASDIFDYENEDSDSNQIAGEIDNNSFPPHFYLDEDDKSACLSDDALIDHHRNTNPFINTFSSSPPILSQEVDRWRL

SEQ ID NO: 22385 - protein, 633 aa, Saccharomyces cerevisiae
MGLLNSSDKEIIKRALPKASNKIIDVTVARLYIAYPDKNEWQYTGLSGALALVDDLVGNTFFLKLVDINGHRGVIWDQELYVNFEYYQDRTFFHTFEMEECFAGLLFVDINEASHFLKRVQKRERYANRKTLLNKNAVALTKKVREEQKSQVVHGPRGESLIDNQRKRYNYEDVDTIPTTKHKAPPPPPPTAETFDSDQTSSFSDINSTTASAPTTPAPALPPASPEVRKEETHPKHSLPPLPNQFAPLPDPPQHNSPPQNNAPSQPQSNPFPFPIPEIPSTQSATNPFPFPVPQQQFNQAPSMGIPQQNRPLPQLPNRNNRPVPPPPPMRTTTEGSGVRLPAPPPPPRRGPAPPPPPHRHVTSNTLNSAGGNSLLPQATGRRGPAPPPPPRASRPTPNVTMQQNPQQYNNSNRPFGYQTNSNMSSPPPPPVTTFNTLTPQMTAATGQPAVPLPQNTQAPSQATNVPVAPPPPPASLGQSQIPQSAPSAPIPPTLPSTTSAAPPPPPAFLTQQPQSGGAPAPPPPPQMPATSTSGGGSFAETTGDAGRDALLASIRGAGGIGALRKVDKSQLDKPSVLLQEARGESASPPAAAGNGGTPGGPPASLADALAAALNKRKTKVGAHDDMDNGDDW

SEQ ID NO: 22386 - protein, 395 aa, Saccharomyces cerevisiae
MSLEREEPQHFGAGPAQMPTPVLQQAAKDLINFNDIGLGIGEISHRSKDATKVIEDSKKHLIELLNIPDTHEVFYLQGGGTTGFSSVATNLAAAYVGKHGKIAPAGYLVTGSWSQKSFEEAKRLHVPAEVIFNAKDYNNGKFGKIPDESLWEDKIKGKAFSYVYLCENETVHGVEWPELPKCLVNDPNIEIVADLSSDILSRKIDVSQYGVIMAGAQKNIGLAGLTLYIIKKSILKNISGASDETLHELGVPITPIAFDYPTVVKNNSAYNTIPIFTLHVMDLVFQHILKKGGVEAQQAENEEKAKILYEALDANSDFYNVPVDPKCRSKMNVVFTLKKDGLDDQFLKEAAARHLTGLKGHRSVGGFRASIYNALSVKAVQNLVDFIKEFAEKNA

SEQ ID NO: 22387 - protein, 220 aa, Saccharomyces cerevisiae
MSAPAQNNAEVPTFKLVLVGDGGTGKTTFVKRHLTGEFEKKYIATIGVEVHPLSFYTNFGEIKFDVWDTAGQEKFGGLRDGYYINAQCAIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMHQYQQEMDQATALPLPDEDDADL

SEQ ID NO: 22388 - protein, 470 aa, Saccharomyces cerevisiae
MSSQQHKFKRPDVSVRDKKLDTLNVQLKKIDTEIGLIRKQIDQHQVNDTTQQERKKLQDKNKEIIKIQADLKTRRSNIHDSIKQLDAQIKRKNNQIEEKLGKKAKFSSTAEAKQRINEIEESIASGDLSLVQEKLLVKEMQSLNKLIKDLVNIEPIRKSVDADKAKINQLKEELNGLNPKDVSNQFEENQQKLNDIHSKTQGVYDKRQTLFNKRAALYKKRDELYSQIRQIRADFDNEFKSFRAKLDKERLKREEEQRLSKLLEQKDVDMGKLQEKLTHAKIPAFTYEIGAIENSLLVLDPTYVKPKKNILPDLSSNALETKPARKVVADDLVLVTPKKDDFVNVAPSKSKKYKKKNQQKNTENEQPASIFNKVDGKFTLEPTLIATLAELDVTVPINSDDVKITVEQLKKKHEELLSKQEEQTKQNIESVEKEIEKLNLDYSNKEQQVKKELEEKRLKEQEESEKDKEN

SEQ ID NO: 22389 - protein, 220 aa, Saccharomyces cerevisiae [sequence omitted]

SEQ ID NO: 22390 - protein, 604 aa, Saccharomyces cerevisiae
MAELSEQVQNLSINDNNENGYVPPHLRGKPRSARNNSSNYNNNNGGYNGGRGGGSFFSNNRRGGYGNGGFFGGNNGGSRSNGRSGGRWIDGKHVPAPRNEKAEIAIFGVPEDPNFQSSGINFDNYDDIPVDASGKDVPEPITEFTSPPLDGLLLENIKLARFTKPTPVQKYSVPIVANGRDLMACAQTGSGKTGGFLFPVLSESFKTGPSPQPESQGSFYQRKAYPTAVIMAPTRELATQIFDEAKKFTYRSWVKACVVYGGSPIGNQLREIERGCDLLVATPGRLNDLLERGKISLANVKYLVLDEADRMLDMGFEPQIRHIVEDCDMTPVGERQTLMFSATFPADIQHLARDFLSDYIFLSVGRVGSTSENITQKVLYVENQDKKSALLDLLSASTDGLTLIFVETKRMADQLTDFLIMQNFRATAIHGDRTQSERERALAAFRSGAATLLVATAVAARGLDIPNVTHVINYDLPSDVDDYVHRIGRTGRAGNTGLATAFFNSENSNIVKGLHEILTEANQEVPSFLKDAMMSAPGSRSNSRRGGFGRNNNRDYRKAGGASAGGWGSSRSRDNSFRGGSGWGSDSKSSGWGNSGGSNNSSWW

SEQ ID NO: 22391 - protein, 1149 aa, Saccharomyces cerevisiae
MVAATKRRKTHIHKHVKDEAFDDLLKPVYKGKKLTDEINTAQDKWHLLPAFLKVKGLVKQHLDSFNYFVDTDLKKIIKANQLILSDVDPEFYLKYVDIRVGKKSSSSTKDYLTPPHECRLRDMTYSAPIYVDIEYTRGRNIIMHKDVEIGRMPIMLRSNKCILYDADESKMAKLNECPLDPGGYFIVNGTEKVILVQEQLSKNRIIVEADEKKGIVQASVTSSTHERKSKTYVITKNGKIYLKHNSIAEEIPIAIVLKACGILSDLEIMQLVCGNDSSYQDIFAVNLEESSKLDIYTQQQALEYIGAKVKTMRRQKLTILQEGIEAIATTVIAHLTVEALDFREKALYIAMMTRRVVMAMYNPKMIDDRDYVGNKRLELAGQLISLLFEDLFKKFNNDFKLSIDKVLKKPNRAMEYDALLSINVHSNNITSGLNRAISTGNWSLKRFKMERAGVTHVLSRLSYISALGMMTRISSQFEKSRKVSGPRALQPSQFGMLCTADTPEGEACGLVKNLALMTHITTDDEEEPIKKLCYVLGVEDITLIDSASLHLNYGVYLNGTLIGSIRFPTKFVTQFRHLRRTGKVSEFISIYSNSHQMAVHIATDGGRICRPLIIVSDGQSRVKDIHLRKLLDGELDFDDFLKLGLVEYLDVNEENDSYIALYEKDIVPSMTHLEIEPFTILGAVAGLIPYPHHNQSPRNTYQCAMGKQAIGAIAYNQFKRIDTLLYLMTYPQQPMVKTKTIELIDYDKLPAGQNATVAVMSYSGYDIEDALVLNKSSIDRGFGRCETRRKTTTVLKRYANHTQDIIGGMRVDENGDPIWQHQSLGPDGLGEVGMKVQSGQIYINKSVPTNSADAPNPNNVNVQTQYREAPVIYRGPEPSHIDQVMMSVSDNDQALIKVLLRQNRRPELGDKFSSRHGQKGVCGIIVKQEDMPFNDQGIVPDIIMNPHGFPSRMTVGKMIELISGKAGVLNGTLEYGTCFGGSKLEDMSKILVDQGFNYSGKDMLYSGITGECLQAYIFFGPIYYQKLKHMVLDKMHARARGPRAVLTRQPTEGRSRDGGLRLGEMERDCVIAYGASQLLLERLMISSDAFEVDVCDKCGLMGYSGWCTTCKSAENIIKMTIPYAAKLLFQELLSMNIAPRLRLEDIFQQ

SEQ ID NO: 22392 - protein, 750 aa, Saccharomyces cerevisiae
MDRIAQQYRNGKRDNNGNRMASSAISEKGHIQVNQTRTPGQMPVYRGETINLSNLPQNQIKPCKDLDDVNIRRNNSNRHSKILLLDLCAGPNTNSFLGNTNAKDITVLSLPLPSTLVKRSNYPFENLLKNYLGSDEKYIEFTKIIKDYDIFIFSDSFSRISSCLKTTFCLIEKFKKFICHFFPSPYLKFFLLEGSLNDSKAPSLGKNKKNCILPKLDLNLNVNLTSRSTLNLRINIPPPNDSNKIFLQSLKKDLIHYSPNSLQKFFQFNMPADLAPNDTILPNWLKFCSVKENEKVILKKLFNNFETLENFEMQRLEKCLKFKKKPLHQKQLSQKQRGPQSTDDSKLYSLTSLQRQYKSSLKSNIQKNQKLKLIIPKNNTSSSPSPLSSDDTIMSPINDYELTEGIQSFTKNRYSNILPYEHSRVKLPHSPKPPAVSEASTTETKTDKSYPMCPVDAKNHSCKPNDYINANYLKLTQINPDFKYIATQAPLPSTMDDFWKVITLNKVKVIISLNSDDELNLRKWDIYWNNLSYSNHTIKLQNTWENICNINGCVLRVFQVKKTAPQNDNISQDCDLPHNGDLTSITMAVSEPFIVYQLQYKNWLDSCGVDMNDIIKLHKVKNSLLFNPQSFITSLEKDVCKPDLIDDNNSELHLDTANSSPLLVHCSAGCGRTGVFVTLDFLLSILSPTTNHSNKIDVWNMTQDLIFIIVNELRKQRISMVQNLTQYIACYEALLNYFALQKQIKNALPC

SEQ ID NO: 22393 - protein, 902 aa, Saccharomyces cerevisiae
MSNSTSLRAIPRVANYNTLVRMNASPVRLLILRRQLATHPAILYSSPYIKSPLVHLHSRMSNVHRSAHANALSFVITRRSISHFPKIISKIIRLPIYVGGGMAAAGSYIAYKMEEASSFTKDKLDRIKDLGESMKEKFNKMFSGDKSQDGGHGNDGTVPTATLIAATSLDDDESKRQGDPKDDDDEDDDDEDDENDSVDTTQDEMLNLTKQMIEIRTILNKVDSSSAHLTLPSIVVIGSQSSGKSSVLESIVGREFLPKGSNMVTRRPIELTLVNTPNSNNVTADFPSMRLYNIKDFKEVKRMLMELNMAVPTSEAVSEEPIQLTIKSSRVPDLSLVDLPGYIQVEAADQPIELKTKIRDLCEKYLTAPNIILAISAADVDLANSSALKASKAADPKGLRTIGVITKLDLVDPEKARSILNNKKYPLSMGYVGVITKTPSSINRKHLGLFGEAPSSSLSGIFSKGQHGQSSGEENTNGLKQIVSHQFEKAYFKENKKYFTNCQVSTKKLREKLIKILEISMSNALEPTSTLIQQELDDTSYLFKVEFNDRHLTPKSYLLNNIDVLKLGIKEFQEKFHRNELKSILRAELDQKVLDVLATRYWKDDNLQDLSSSKLESDTDMLYWHKKLELASSGLTKMGIGRLSTMLTTNAILKELDNILESTQLKNHELIKDLVSNTAINVLNSKYYSTADQVENCIKPFKYEIDLEERDWSLARQHSINLIKEELRQCNSRYQAIKNAVGSKKLANVMGYLENESNLQKETLGMSKLLLERGSEAIFLDKRCKVLSFRLKMLKNKCHSTIEKDRCPEVFLSAVSDKLTSTAVLFLNVELLSDFFYNFPIELDRRLTLLGDEQVEMFAKEDPKISRHIELQKRKELLELALEKIDSILVFKKSYKGVSKNL

SEQ ID NO: 22394 - protein, 423 aa, Saccharomyces cerevisiae
MAAHQMDSITYSNNVTQQYIQPQSLQDISAVEDEIQNKIEAARQESKQLHAQINKAKHKIQDASLFQMANKVTSLTKNKINLKPNIVLKGHNNKISDFRWSRDSKRILSASQDGFMLIWDSASGLKQNAIPLDSQWVLSCAISPSSTLVASAGLNNNCTIYRVSKENRVAQNVASIFKGHTCYISDIEFTDNAHILTASGDMTCALWDIPKAKRVREYSDHLGDVLALAIPEEPNSENSSNTFASCGSDGYTYIWDSRSPSAVQSFYVNDSDINALRFFKDGMSIVAGSDNGAINMYDLRSDCSIATFSLFRGYEERTPTPTYMAANMEYNTAQSPQTLKSTSSSYLDNQGVVSLDFSASGRLMYSCYTDIGCVVWDVLKGEIVGKLEGHGGRVTGVRSSPDGLAVCTGSWDSTMKIWSPGYQ

SEQ ID NO: 22395 - protein, 248 aa, Saccharomyces cerevisiae
MDHSIEVTFRVKTQQVIIPEQNIRGNELPLRRWQMELLMLDATGKEVEPTILSKCIYHLHSSFKQPKRRLNSLPFFIKETGWGEFNLKIECFFIGNAGKFSIEHDLTFEDDAYAVDYTVDVPHEFSHLNSELSKYFDLPWKVVSPEEEMSLRIADLPWIKSLALIDEDMMTDVVQMILNDPAVQRAIENHPRREQFFMFITQLPDDLLMKIQAFLKLPNKNSTKQERTNFGSDAIHKDEPVKAHNKLK

SEQ ID NO: 22396 - protein, 861 aa, Saccharomyces cerevisiae
MVNISDFFGKNKKSVRSSTSRPTRQVGSSKPEVIDLDTESDQESTNKTPKKMPVSNVIDVSETPEGEKKLPLPAKRKASSPTVKPASSKKTKPSSKSSDSASNITAQDVLDKIPSLDLSNVHVKENAKFDFKSANSNADPDEIVSEIGSFPEGKPNCLLGLTIVFTGVLPTLERGASEALAKRYGARVTKSISSKTSVVVLGDEAGPKKLEKIKQLKIKAIDEEGFKQLIAGMPAEGGDGEAAEKARRKLEEQHNIATKEAELLVKKEEERSKKLAATRVSGGHLERDNVVREEDKLWTVKYAPTNLQQVCGNKGSVMKLKNWLANWENSKKNSFKHAGKDGSGVFRAAMLYGPPGIGKTTAAHLVAQELGYDILEQNASDVRSKTLLNAGVKNALDNMSVVGYFKHNEEAQNLNGKHFVIIMDEVDGMSGGDRGGVGQLAQFCRKTSTPLILICNERNLPKMRPFDRVCLDIQFRRPDANSIKSRLMTIAIREKFKLDPNVIDRLIQTTRGDIRQVINLLSTISTTTKTINHENINEISKAWEKNIALKPFDIAHKMLDGQIYSDIGSRNFTLNDKIALYFDDFDFTPLMIQENYLSTRPSVLKPGQSHLEAVAEAANCISLGDIVEKKIRSSEQLWSLLPLHAVLSSVYPASKVAGHMAGRINFTAWLGQNSKSAKYYRLLQEIHYHTRLGTSTDKIGLRLDYLPTFRKRLLDPFLKQGADAISSVIEVMDDYYLTKEDWDSIMEFFVGPDVTTAIIKKIPATVKSGFTRKYNSMTHPVAIYRTGSTIGGGGVGTSTSTPDFEDVVDADDNPVPADDEETQDSSTDLKKDKLIKQKAKPTKRKTATSKPGGSKKRKTKA

SEQ ID NO: 22397 - protein, 931 aa, Saccharomyces cerevisiae
MSASTHSHKRKNSHLFPQRKSSNSSMDKPFFPNNDSVANTDPQSNENGHTINEIRPTEATIDVTDVPQTPFLQEQYSMRPRRESFQFNDIENQHHTHSFFSVNKFNRRWGEWSLPEKRSYVLVFTLIALSVLVLLVILIPSKLLPTKITRPKTSAGDSSLGKRSFSIENVLNGDFAIPEDTFHFIDPPQRLLGQDSDPGLYFTTKEIDGHTNFIAKQLFDETFEVNLGGNRFLYEGVEFTVSTVQINYKLDKLIFGTNLESEFRHSSKGFYWIKDLNTGNIEPILPPEKSDDNYELGLSKLSYAHFSPAYNYIYFVYENNLFLQQVNSGVAKKVTEDGSKDIFNAKPDWIYEEEVLASDQAIWWAPDDSKAVFARFNDTSVDDIRLNRYTNMNEAYLSDTKIKYPKPGFQNPQFDLFLVNLQNGIIYSINTGGQKDSILYNGKWISPDTFRFEITDRNSKILDVKVYDIPSSQMLTVRNTNSNLFNGWIEKTKDILSIPPKPELKRMDYGYIDIHADSRGFSHLFYYPTVFAKEPIQLTKGNWEVTGNGIVGYEYETDTIFFTANEIGVMSQHLYSISLTDSTTQNTFQSLQNPSDKYDFYDFELSSSARYAISKKLGPDTPIKVAGPLTRVLNVAEIHDDSILQLTKDEKFKEKIKNYDLPITSYKTMVLDDGVEINYIEIKPANLNPKKKYPILVNIYGGPGSQTFTTKSSLAFEQAVVSGLDVIVLQIEPRGTGGKGWSFRSWAREKLGYWEPRDITEVTKKFIQRNSQHIDESKIAIWGWSYGGFTSLKTVELDNGDTFKYAMAVAPVTNWTLYDSVYTERYMNQPSENHEGYFEVSTIQNFKSFESLKRLFIVHGTFDDNVHIQNTFRLVDQLNLLGLTNYDMHIFPDSDHSIRYHNAQRIVFQKLYYWLRDAFAERFDNTEVLHL

SEQ ID NO: 22398 - protein, 307 aa, Saccharomyces cerevisiae
MSSDSNAKPLPFIYQFISGAVAGISELTVMYPLDVVKTRFQLEVTTPTAAAVGKQVERYNGVIDCLKKIVKKEGFSRLYRGISSPMLMEAPKRATKFACNDQYQKIFKNLFNTNETTQKISIAAGASAGMTEAAVIVPFELIKIRMQDVKSSYLGPMDCLKKTIKNEGIMGLYKGIESTMWRNALWNGGYFGVIYQVRNSMPVAKTKGQKTRNDLIAGAIGGTVGTMLNTPFDVVKSRIQSVDAVSSAVKKYNWCLPSLLVIYREEGFRALYKGFVPKVCRLAPGGSLMLVVFTGMMNFFRDLKYGH

SEQ ID NO: 22399 - protein, 1246 aa, Saccharomyces cerevisiae
MSSKLKYTDIDVPLDWLYKGKRRNRTKSAASTRTSEATTTSVKKTATLPSTAAVPTKTIASPQRPLSGQNVNNELSNSKPAVSAEKVSQQGQVPTRRTRSHSVSYGLLQKKNNNDDTTDSPKISRIRTAQDQPVKETKSSTLAEPIVSKKGRSRSSSISTSLNERSKKSLFGSLFGRRPSTTPSHVVERPLSSQNDHKKSTELPPIDTRQSKISTPTSTPTTASSKPSSSGGNRHSDGSLTSKLLSIPHNILETSSTNFNAHHHIQSHHSSGREQDSPHSESSDLPPILEKETTQKQLQKVSKVNLKRVTIAVQEFNSDPPQQLPSRKPKRGNVLIPEDMISAPPLISLGITNSSDQSSFQSNISPSYSKDSKEYKLALENFKKAAKEAEKHQKDAYYVAERMAQEVANYKARQLKTSPLTGATNSAADSATDQESSSLDARASKLHIDKPINVGAHPFETHQDDNIKYSSHLEQTLDVAYTRCCHLREILPIPSTLRQVKGKTAPLQTLKFLNPKPTLVDILSFCDFIAITPIHNIIFDNVSLTHDMFKIVICSLVTSPVVEKLGLRNVVINEQSWKLLCKFLLQNKTLIKLDISQTKARTDLNDSNYRDQMDWELFCEVLRNREGRPLEELLLNGLRFDKMSFSHFKNILLTFAQMNPKNPIRLGMANVEFSTECFDFLFNWMSEYNVQGVDLAYNNLESLAKRMIKKLARLPYKHLEYFTLNSTNITSVDDMSYILKYLSRLPSIKFLDLSNLPQLFPGILTSGYKYFPQFPQLKRIHFDFDDLSIKETTMLVSILAKCETLSHVSLIGQSPMPDASKISDSTDEPDKSKDEKKEQIVFMRNTLWASLYAFVRDSHNLVSLDVDYDQVPDEIQSRIALCLMHNMKRIMDSSFKLDELTVQDDLIFDGSLITETAEEVLKRLNDKSLLQNDVGKKYLLKKYFEKMEKVHHNVQNTIDSMFEKRKSGELPLQEKENLLRLLLLEKNLSNILDIFASMPNIADVVPFSKADNSFPNIGDSTVSANYNDGIRPSLKHLDSDRLINDVSIPENDSSIRPHLMATDSGRIIDVTTGKALLFKSSSNTSLAGKRQEEEEGELHKWGVFVQHQSSRHNSGLPSSANSSRISGSLTPDSSVAGGKKGESSRTSGTRPKILPKIPTGAELRDAIIKAKGIDSVDDLIKNVTSEKVGLESLYGDELNSRSPSNDSLQESQQKAPLQRPLVEDETVTKKYDKLLNDLSNVRHSKT

SEQ ID NO: 22400 - protein, 508 aa, Saccharomyces cerevisiae
MASLFRPPESAKCNPNSPRLKLPLLRNNQVDENNIYLTSNGSSTTAYSSHTPEPLTSSTSTLFSQTRLHPSDSSMTLNTMKKRPAPPSLPSLSINSQSKCKTLPELVPIADVSDGKHDLGLKQRVIAENELSGNSDLTPSSMASPFSHTNTSSPYLRNDLSNSVGSDFSNLISAYEQSSSPIKSSSQPKSSSESYIDLNSVRDVDQLDENGWKYANLKDRIETLGILGEGAGGSVSKCKLKNGSKIFALKVINTLNTDPEYQKQIFRELQFNRSFQSEYIVRYYGMFTDDENSSIYIAMEYMGGRSLDAIYKNLLERGGRISEKVLGKIAEAVLRGLSYLHEKKVIHRDIKPQNILLNENGQVKLCDFGVSGEAVNSLATTFTGTSFYMAPERIQGQPYSVTSDVWSLGLTILEVANGKFPCSSEKMAANIAPFELLMWILTFTPELKDEPESNIIWSPSFKSFIDYCLKKDSRERPSPRQMINHPWIKGQMKKNVNMEKFVRKCWKD

SEQ ID NO: 22401 - protein, 800 aa, Saccharomyces cerevisiae
MASVPKRHTYGGNVVTDRDRHSLQRNNEILHPIHKNQRKHATFGPYIIGSTLGEGEFGKVKLGWTKASSSNEVPKQVAIKLIRRDTIKKDADKEIKIYREINALKHLTHPNIIYLEEVLQNSKYIGIVLEFVSGGEFYKYIQRKRRLKESSACRLFAQLISGVNYMHYKGLVHRDLKLENLLLDKHENLVITDFGFVNEFFEDNELMKTSCGSPCYAAPELVVSTKAYEARKADVWSCGVILYAMLAGYLPWDDDHENPTGDDIARLYKYITQTPLKFPEYITPIPRDLLRRILVPNPRRRINLQTIKRHVWLKPHEAFLSIQPNYWDEHLQKERPKPPNKGDVGRHSTYSSSASSYSKSRDRNSLIIESTLEQHRMSPQLATSRPASPTFSTGSKVVLNDTKNDMKESNINGERTSASCRYTRDSKGNGQTQIEQVSARHSSRGNKHTSVAGLVTIPGSPTTARTRNAPSSKLTEHVKDSSQTSFTQEEFHRIGNYHVPRSRPRPTSYYPGLSRNTADNSLADIPVNKLGSNGRLTDAKDPVPLNAIHDTNKATISNNSIMLLSEGPAAKTSPVDYHYAIGDLNHGDKPITEVIDKINKDLTHKAAENGFPRESIDPESTSTILVTKEPTNSTDEDHVESQLENVGHSSNKSDASSDKDSKKIYEKKRFSFMSLYSSLNGSRSTVESRTSKGNAPPVSSRNPSGQSNRSNIKITQQQPRNLSDRVPNPDKKINDNRIRDNAPSYAESENPGRSVRASVMVSTLREENRSELSNEGNNVEAQTSTARKVLNFFKRRSMRV

SEQ ID NO: 22402 - protein, 211 aa, Saccharomyces cerevisiae
MAGGKIPIVGIVACLQPEMGIGFRGGLPWRLPSEMKYFRQVTSLTKDPNKKNALIMGRKTWESIPPKFRPLPNRMNVIISRSFKDDFVHDKERSIVQSNSLANAIMNLESNFKEHLERIYVIGGGEVYSQIFSITDHWLITKINPLDKNATPAMDTFLDAKKLEEVFSEQDPAQLKEFLPPKVELPETDCDQRYSLEEKGYCFEFTLYNRK

SEQ ID NO: 22403 - protein, 548 aa, Saccharomyces cerevisiae
MHKGKKNYPNLITSFRMNLKKIILNHDRFSHPERWKTNALLRFTFVYIKFLFDLMIIKNPLRMVGKTYRDAVTALNSLQSNYANIMAIRQTGDRKNTMTLLEMHEWSRRIGYSASDFNKLNIVHITGTKGKGSTAAFTSSILGQYKEQLPRIGLYTSPHLKSVRERIRINGEPISEEKFAKYFFEVWDRLDSTTSSLDKFPHMIPGSKPGYFKFLTLLSFHTFIQEDCKSCVYEVGVGGELDSTNIIEKPIVCGVTLLGIDHTFMLGDTIEEIAWNKGGIFKSGAPAFTVEKQPPQGLTILKERAEERKTTLTEVPPFKQLENVKLGIAGEFQKSNASLAVMLASEILHTSNILEEKIKCSSNASIPEKFIIGLQNTKWEGRCQVLEKGKNVWYIDGAHTKDSMVAASTWFRDMVRLSKRKKILLFNQQSRDANALVNNLYSSVSPEITFDDVIFTTNVTWKSGSYSADLVSMNTSQEDVEKLKVQESLVKNWNKIDDNRAKTHVTASIEEANELIETLYDEPADIFVTGSLHLVGGLLVVFDRIDVK

SEQ ID NO: 22404 - protein, 304 aa, Saccharomyces cerevisiae
MPLFDLISPKAFVKLVASEKVHRIVPVDATWYLPSWKLDNKVDFLTKPRIPNSIFFDIDAISDKKSPYPHMFPTKKVFDDAMSNLGVQKDDILVVYDRVGNFSSPRCAWTLGVMGHPKVYLLNNFNQYREFKYPLDSSKVAAFSPYPKSHYESSESFQDKEIVDYEEMFQLVKSGELAKKFNAFDARSLGRFEGTEPEPRSDIPSGHIPGTQPLPYGSLLDPETKTYPEAGEAIHATLEKALKDFHCTLDPSKPTICSCGTGVSGVIIKTALELAGVPNVRLYDGSWTEWVLKSGPEWIAENRD

SEQ ID NO: 22405 - protein, 663 aa, Saccharomyces cerevisiae
MPTNYEYDEASETWPSFILTGLLMVVGPMTLLQIYQIFFGANAEDGNSGKSKEFNEEVFKNLNEEYTSDEIKQFRRKFDKNSNKKSKIWSRRNIIIIVGWILVAILLQRINSNDAIKDAATKLFDPYEILGISTSASDRDIKSAYRKLSVKFHPDKLAKGLTPDEKSVMEETYVQITKAYESLTDELVRQNYLKYGHPDGPQSTSHGIALPRFLVDGSASPLLVVCYVALLGLILPYFVSRWWARTQSYTKKGIHNVTASNFVSNLVNYKPSEIVTTDLILHWLSFAHEFKQFFPDLQPTDFEKLLQDHINRRDSGKLNNAKFRIVAKCHSLLHGLLDIACGFRNLDIALGAINTFKCIVQAVPLTPNCQILQLPNVDKEHFITKTGDIHTLGKLFTLEDAKIGEVLGIKDQAKLNETLRVASHIPNLKIIKADFLVPGENQVTPSSTPYISLKVLVRSAKQPLIPTSLIPEENLTEPQDFESQRDPFAMMSKQPLVPYSFAPFFPTKRRGSWCCLVSSQKDGKILQTPIIIEKLSYKNLNDDKDFFDKRIKMDLTKHEKFDINDWEIGTIKIPLGQPAPETVGDFFFRVIVKSTDYFTTDLDITMNMKVRDSPAVEQVEVYSEEDDEYSTDDDETESDDESDASDYTDIDTDTEAEDDESPE

SEQ ID NO: 22406 - protein, 161 aa, Saccharomyces cerevisiae
MSKNRSSLQSGPLNSELLEEQKQEIYEAFSLFDMNNDGFLDYHELKVAMKALGFELPKREILDLIDEYDSEGRHLMKYDDFYIVMGEKILKRDPLDEIKRAFQLFDDDHTGKISIKNLRRVAKELGETLTDEELRAMIEEFDLDGDGEINENEFIAICTDS

SEQ ID NO: 22407 - protein, 437 aa, Saccharomyces cerevisiae
MSEEQDPLLAGLGETSGDNHTQQSHEQQPEQPQETEEHHEEEPSRVDPEQEAHNKALNQFKRKLLEHRRYDDQLKQRRQNIRDLEKLYDKTENDIKALQSIGQLIGEVMKELSEEKYIVKASSGPRYIVGVRNSVDRSKLKKGVRVTLDITTLTIMRILPRETDPLVYNMTSFEQGEITFDGIGGLTEQIRELREVIELPLKNPEIFQRVGIKPPKGVLLYGPPGTGKTLLAKAVAATIGANFIFSPASGIVDKYIGESARIIREMFAYAKEHEPCIIFMDEVDAIGGRRFSEGTSADREIQRTLMELLTQMDGFDNLGQTKIIMATNRPDTLDPALLRPGRLDRKVEIPLPNEAGRLEIFKIHTAKVKKTGEFDFEAAVKMSDGFNGADIRNCATEAGFFAIRDDRDHINPDDLMKAVRKVAEVKKLEGTIEYQKL

SEQ ID NO: 22408 - protein, 338 aa, Saccharomyces cerevisiae
MSLQHEKVTIAPLVLLSALDHYERTQTKENKRCVGVILGDANSSTIRVTNSFALPFEEDEKNSDVWFLDHNYIENMNEMCKKINAKEKLIGWYHSGPKLRASDLKINELFKKYTQNNPLLLIVDVKQQGVGLPTDAYVAIEQVKDDGTSTEKTFLHLPCTIEAEEAEEIGVEHLLRDVRDQAAGGLSIRLTNQLKSLKGLQSKLKDVVEYLDKVINKELPINHTILGKLQDVFNLLPNLGTPDDDEIDVENHDRINISNNLQKALTVKTNDELMVIYISNLVRSIIAFDDLIENKIQNKKIQEQRVKDKQSKVSDDSESESGDKEATAPLIQRKNKKN

SEQ ID NO: 22409 - protein, 840 aa, Saccharomyces cerevisiae
MAEKEEAIFRSAEMALVQFYIPQEISRDSAYTLGQLGLVQFRDLNSKVRAFQRTFVNEIRRLDNVERQYRYFYSLLKKHDIKLYEGDTDKYLDGSGELYVPPSGSVIDDYVRNASYLEERLIQMEDATDQIEVQKNDLEQYRFILQSGDEFFLKGDNTDSTSYMDEDMIDANGENIAAAIGASVNYVTGVIARDKVATLEQILWRVLRGNLFFKTVEIEQPVYDVKTREYKHKNAFIVFSHGDLIIKRIRKIAESLDANLYDVDSSNEGRSQQLAKVNKNLSDLYTVLKTTSTTLESELYAIAKELDSWFQDVTREKAIFEILNKSNYDTNRKILIAEGWIPRDELATLQARLGEMIARLGIDVPSIIQVLDTNHTPPTFHRTNKFTAGFQSICDCYGIAQYREINAGLPTIVTFPFMFAIMFGDMGHGFLMTLAALSLVLNEKKINKMKRGEIFDMAFTGRYIILLMGVFSMYTGFLYNDIFSKTMTIFKSGWKWPDHWKKGESITATSVGTYPIGLDWAWHGTENALLFSNSYKMKLSILMGFIHMTYSYFFSLANHLYFNSMIDIIGNFIPGLLFMQGIFGYLSVCIVYKWAVDWVKDGKPAPGLLNMLINMFLSPGTIDDELYPHQAKVQVFLLLMALVCIPWLLLVKPLHFKFTHKKKSHEPLPSTEADASSEDLEAQQLISAMDADDAEEEEVGSGSHGEDFGDIMIHQVIHTIEFCLNCVSHTASYLRLWALSLAHAQLSSVLWTMTIQIAFGFRGFVGVFMTVALFAMWFALTCAVLVLMEGTSAMLHSLRLHWVESMSKFFVGEGLPYEPFAFEYKDMEVAVASASSSASS

SEQ ID NO: 22410 - protein, 275 aa, Saccharomyces cerevisiae
MSSRKKVRVLLLKNKTVPIDKYELECRSKAFEPIFVPLIKHTHVIQDFRNVLNTIPNYLNTINYIIITSQRTVESLNEAIIPTLTSEQKAALLSKTVYTVGPATANFIRRSGFINVKGGEDAGNGSILADIIIDDLSTDIKACPPSELLFLVGEIRRDIIPKKLHSKGIKVREVVTYKTEELSDGFKRFIHAMKECDEDEVFSDWVVVFSPQGTKEITQYLGDSNRLPGSHLRVASIGPTTKKYLDDNDVTSDVVSPKPDPKSLLDAIELYQRHK

SEQ ID NO: 22411 - protein, 139 aa, Saccharomyces cerevisiae
MWKAVMNAWNGTESQSKNVSNIQSYSFEDMKRIVGKHDPNVVLVDVREPSEYSIVHIPASINVPYRSHPDAFALDPLEFEKQIGIPKPDSAKELIFYCASGKRGGEAQKVASSHGYSNTSLYPGSMNDWVSHGGDKLDL

SEQ ID NO: 22412 - protein, 149 aa, Saccharomyces cerevisiae
MFKHSTGILSRTVSARSPTLVLRTFTTKAPKIYTFDQVRNLVEHPNDKKLLVDVREPKEVKDYKMPTTINIPVNSAPGALGLPEKEFHKVFQFAKPPHDKELIFLCAKGVRAKTAEELARSYGYENTGIYPGSITEWLAKGGADVKPKK

SEQ ID NO: 22413 - protein, 1703 aa, Saccharomyces cerevisiae
MNIPQRQFSNEEVNRCYLRWQHLRNEHGMNAPSVPEFIYLTKVLQFAAKQRQELQMQRQQQGISGSQQNIVPNSSDQAELPNNASSHISASASPHLAPNMQLNGNETFSTSAHQSPIMQTQMPLNSNGGNNMLPQRQSSVGSLNATNFSPTPANNGENAAEKPDNSNHNNLNLNNSELQPQNRSLQEHNIQDSNVMPGSQINSPMPQQAQMQQAQFQAQQAQQAQQAQQAQQAQARLQQGRRLPMTMFTAEQSELLKAQITSLKCLVNRKPIPFEFQAVIQKSINHPPDFKRMLLSLSEFARRRQPTDQNNQSNLNGGNNTQQPGTNSHYNNTNTDNVSGLTRNAPLDSKDENFASVSPAGPSSVHNAKNGTLDKNSQTVSGTPITQTESKKEENETISNVAKTAPNSNKTHTEQNNPPKPQKPVPLNVLQDQYKEGIKVVDIDDPDMMVDSFTMPNISHSNIDYQTLLANSDHAKFTIEPGVLPVGIDTHTATDIYQTLIALNLDTTVNDCLDKLLNDECTESTRENALYDYYALQLLPLQKAVRGHVLQFEWHQNSLLTNTHPNFLSKIRNINVQDALLTNQLYKNHELLKLERKKTEAVARLKSMNKSAINQYNRRQDKKNKRLKFGHRLIATHTNLERDEQKRAEKKAKERLQALKANDEEAYIKLLDQTKDTRITHLLRQTNAFLDSLTRAVKDQQKYTKEMIDSHIKEASEEVDDLSMVPKMKDEEYDDDDDNSNVDYYNVAHRIKEDIKKQPSILVGGTLKDYQIKGLQWMVSLFNNHLNGILADEMGLGKTIQTISLLTYLYEMKNIRGPYLVIVPLSTLSNWSSEFAKWAPTLRTISFKGSPNERKAKQAKIRAGEFDVVLTTFEYIIKERALLSKVKWVHMIIDEGHRMKNAQSKLSLTLNTHYHADYRLILTGTPLQNNLPELWALLNFVLPKIFNSVKSFDEWFNTPFANTGGQDKIELSEEETLLVIRRLHKVLRPFLLRRLKKDVEKELPDKVEKVVKCKMSALQQIMYQQMLKYRRLFIGDQNNKKMVGLRGFNNQIMQLKKICNHPFVFEEVEDQINPTRETNDDIWRVAGKFELLDRILPKLKATGHRVLIFFQMTQIMDIMEDFLRYINIKYLRLDGHTKSDERSELLRLFNAPDSEYLCFILSTRAGGLGLNLQTADTVIIFDTDWNPHQDLQAQDRAHRIGQKNEVRILRLITTNSVEEVILERAYKKLDIDGKVIQAGKFDNKSTSEEQEALLRSLLDAEEERRKKRESGVEEEEELKDSEINEILARNDEEMAVLTRMDEDRSKKEEELGVKSRLLEKSELPDIYSRDIGAELKREESESAAVYNGRGARERKTATYNDNMSEEQWLRQFEVSDDEKNDKQARKQRTKKEDKSEAIDGNGEIKGENIDADNDGPRINNISAEDRADTDLAMNDDDFLSKKRKAGRPRGRPKKVKLEGSENSEPPALESSPVTGDNSPSEDFMDIPKPRTAGKTSVKSARTSTRGRGRGRGRGRGRGRGRGRPPKARNGLDYVRTPAAATSPIDIREKVAKQALDLYHFALNYENEAGRKLSDIFLSKPSKALYPDYYMIIKYPVAFDNINTHIETLAYNSLKETLQDFHLIFSNARIYNTEGSVVYEDSLELEKVVTKKYCEIMGDNSQLDFTEFDEQYGTRPLVLPPVVTSSVAESFTDEADSSMTEASV

SEQ ID NO: 22414 - protein, 192 aa, Saccharomyces cerevisiae
MLLFPGLKPVLNASTVIVNPVRAVFPGLVLSTKRSFYSINRLNAENKINDIANTSKEASSSVQMFKPPEFSQFKDSYQKDYERIAKYTLIPLTMVPFYASFTGGVINPLLDASLSSIFLIYLQYGFTSCIIDYIPKGKYPRWHKLALYCLYGGSMLSLYGIYELETKNNGFVDLVKKLWNENDDHLYIFGRN

SEQ ID NO: 22415 - protein, 411 aa, Saccharomyces cerevisiae
MSSAATKATFCIQNGPSFEGISFGANKSVAGETVFTTSLVGYPESMTDPSYRGQILVFTQPLIGNYGVPSGEARDEYNLLKYFESPHIHVVGIVVAEYAYQYSHWTAVESLAQWCQREGVAAITGVDTRELVQYLREQGSSLGRITLADHDPVPYVNPMKTNLVAQVTTKKPFHVSALPGKAKANVALIDCGVKENIIRCLVKRGANVTVFPYDYRIQDVASEFDGIFLSNGPGNPELCQATISNVRELLNNPVYDCIPIFGICLGHQLLALASGASTHKLKYGNRAHNIPAMDLTTGQCHITSQNHGYAVDPETLPKDQWKPYFVNLNDKSNEGMIHLQRPIFSTQFHPEAKGGPLDTAILFDKFFDNIEKYQLQSQAKSSISLKVTYSTDKSRLQSINVTKLAKERVLF

SEQ ID NO: 22416 - protein, 1120 aa, Saccharomyces cerevisiae
MTTQQEEQRSDTKNSKSESPSEVLVDTLDSKSNGSSDDDNIGQSEELSDKEIYTVEDRPPEYWAQRKKKFVLDVDPKYAKQKDKSDTYKRFKYLLGVTDLFRHFIGIKAKHDKNIQKLLKQLDSDANKLSKSHSTVSSSSRHHRKTEKEEDAELMADEEEEIVDTYQEDIFVSESPSFVKSGKLRDYQVQGLNWLISLHENKLSGILADEMGLGKTLQTISFLGYLRYVKQIEGPFLIIVPKSTLDNWRREFLKWTPNVNVLVLHGDKDTRADIVRNIILEARFDVLITSYEMVIREKNALKRLAWQYIVIDEAHRIKNEQSALSQIIRLFYSKNRLLITGTPLQNNLHELWALLNFLLPDIFGDSELFDEWFEQNNSEQDQEIVIQQLHSVLNPFLLRRVKADVEKSLLPKIETNVYVGMTDMQIQWYKSLLEKDIDAVNGAVGKREGKTRLLNIVMQLRKCCNHPYLFEGAEPGPPYTTDEHLIFNSGKMIILDKLLKRLKEKGSRVLIFSQMSRLLDILEDYCYFRDFEYCRIDGSTSHEERIEAIDEYNKPNSEKFVFLLTTRAGGLGINLVTADTVILFDSDWNPQADLQAMDRAHRIGQKKQVHVYRFVTENAIEEKVIERAAQKLRLDQLVIQQGTGKKTASLGNSKDDLLDMIQFGAKNMFEKKASKVTVDADIDDILKKGEQKTQELNAKYQSLGLDDLQKFNGIENQSAYEWNGKSFQKKSNDKVVEWINPSRRERRREQTTYSVDDYYKEIIGGGSKSASKQTPQPKAPRAPKVIHGQDFQFFPKELDALQEKEQLYFKKKVNYKVTSYDITGDIRNEGSDAEEEEGEYKNAANTEGHKGHEELKRRIEEEQEKINSAPDFTQEDELRKQELISKAFTNWNKRDFMAFINACAKYGRDDMENIKKSIDSKTPEEVEVYAKIFWERLKEINGWEKYLHNVELGEKKNEKLKFQETLLRQKIEQCKHPLHELIIQYPPNNARRTYNTLEDKFLLLAVNKYGLRADKLYEKLKQEIMMSDLFTFDWFIKTRTVHELSKRVHTLLTLIVREYEQPDANKKKRSRTSATREDTPLSQNESTRASTVPNLPTTMVTNQKDTNDHVDKRTKIDQEA

SEQ ID NO: 22417 - protein, 521 aa, Saccharomyces cerevisiae
MSSDSLTPKDTIVPEEQTNQLRQPDLDEDSIHYDPEADDLESLETTASYASTSVSAKVYTKKEVNKGTDIESQPHWGENTSSTHDSDKEEDSNEEIESFPEGGFKAWVVTFGCFLGLIACFGLLNSTGVIESHLQDNQLSSESVSTIGWLFSLFLFVCSASCIISGTYFDRNGFRTIMIVGTVFHVAGLFATANSTKYWHFILSFAIVCGFGNGIVLSPLVSVPAHYFFKRRGTALAMATIGGSVGGVVFPIMLRSFFSMKSDTDPTYGFVWGIRTLGFLDLALLTLSIILVKERLPHVIENSKDGESRWRYILRVYILQCFDAKAFLDMKYLFCVLGTVFSELSINSALTYYGSYATSHGISANDAYTLIMIINVCGIPGRWVPGYLSDKFGRFNVAIATLLTLFIVMFVGWLPFGTNLTNMYVISALYGFCSGSVFSLLPVCCGQISKTEEFGKRYSTMYFVVGFGTLVGIPITGAIISIKTTADYQHYIIFSGLATFVSAVCYIISRAYCVGFKWVRF

SEQ ID NO: 22418 - protein, 453 aa, Saccharomyces cerevisiae
MIQTQSTAIKRRNSVHKNLFDPSLYQIPEPPRGGFQHQKKEYSKETFSNQVFGYDITSLKKRFTQLFPSNIQGYLPEVDLRITIICSIWYVTSSISSNLSKAILRTFNHPIALTELQFLVSAVLCVGFASIVNLFRLPRLKHTKFSKALNSFPDGILPEYLDGNFRSSILHKFLVPSKLVLMTTFPMGIFQFIGHITSHKAVSMIPVSLVHSVKALSPIITVGYYKFFEHRYYNSMTYYTLLLLIFGVMTTCWSTHGSKRASDNKSGSSLIGLLFAFISMIIFVAQNIFAKNILTIRRKVGILPSSSTDDVTSKEGQPSLDKTRFSPLQVDKITILFYCSCIGFSLTLLPFLTGELMHGGSVINDLTLETVALVAIHGIAHFFQAMLAFQLIGLLSSINYSVANIMKRIVVISVALFWETKLNFFQVFGVILTIAGLYGYDKWGLSKKDGRQA

SEQ ID NO: 22419 - protein, 700 aa, Saccharomyces cerevisiae
MVAQYTVPVGKAANEHETAPRRNYQCREKPLVRPPNTKCSTVYEFVLECFQKNKNSNAMGWRDVKEIHEESKSVMKKVDGKETSVEKKWMYYELSHYHYNSFDQLTDIMHEIGRGLVKIGLKPNDDDKLHLYAATSHKWMKMFLGAQSQGIPVVTAYDTLGEKGLIHSLVQTGSKAIFTDNSLLPSLIKPVQAAQDVKYIIHFDSISSEDRRQSGKIYQSAHDAINRIKEVRPDIKTFSFDDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGALGNLVFKKIRTATGGQLRYLLNGGSPISRDAQEFITNLICPMLIGYGLTETCASTTILDPANFELGVAGDLTGCVTVKLVDVEELGYFAKNNQGEVWITGANVTPEYYKNEEETSQALTSDGWFKTGDIGEWEANGHLKIIDRKKNLVKTMNGEYIALEKLESVYRSNEYVANICVYADQSKTKPVGIIVPNHAPLTKLAKKLGIMEQKDSSINIENYLEDAKLIKAVYSDLLKTGKDQGLVGIELLAGIVFFDGEWTPQNGFVTSAQKLKRKDILNAVKDKVDAVYSSS

SEQ ID NO: 22420 - protein, 456 aa, Saccharomyces cerevisiae
MSSSQQIAKNARKAGNILKTISNEGRSDILYKIHDALKANAHAIEEANKIDLAVAKETGLADSLLKRLDLFKGDKFEVMLQGIKDVAELEDPVGKVKMARELDDGLTLYQVTAPVGVLLVIFESRPEVIANITALSIKSGNAAILKGGKESVNTFREMAKIVNDTIAQFQSETGVPVGSVQLIETRQDVSDLLDQDEYIDLVVPRGSNALVRKIKDTTKIPVLGHADGICSIYLDEDADLIKAKRISLDAKTNYPAGCNAMETLLINPKFSKWWEVLENLTLEGGVTIHATKDLKTAYFDKLNELGKLTEAIQCKTVDADEEQDFDKEFLSLDLAAKFVTSTESAIQHINTHSSRHTDAIVTENKANAEKFMKGVDSSGVYWNASTRFADGFRYGFGAEVGISTSKIHARGPVGLDGLVSYQYQIRGDGQVASDYLGAGGNKAFVHKDLDIKTVTL

SEQ ID NO: 22421 - protein, 602 aa, Saccharomyces cerevisiae
MNLLIDRMENPGSRNCTLLPPSFPRGFCKGRRASSGDAVKIKESGLQPQPQPEPLQAKTNVAHFSKSSSRLPVIAVNDNPVVPRPSTEVNLGSLLQKEREKEKEEQPALHDRRHLYVTKNRAHGVRQRSLEMTSLPVLGSTKTGKFSDFLFEDDIDNRVGRHSRSYSGASSLDDPFRVSPKTDFNSNRARLSCLSKGRRGSMSVFQSCHTGLAFNQIQGSSSSQRRSSAGSFDYERKRLVNQFLQPSLGNSDPFDTLRESVVFEPSSTAGGIKLGNMHSQSQISVNSSPSTSLFYHDLDGSAVNDSSSFLYSRSNVPAFLSSSAFSSTSSTSSDSEDVDRRSLNGVYPSLGYLTNQRKPRNSSGSSTAPGTDTLGFKYLLNRQKSADSSTRFKSVLKVNNNNGSAATPDSSSNSISKSNSNLNDNIDELNYYQNHISTLLVKIENEMRRNLNDTIIKNENNVQKTIQKYDLLSGELTLLLDEMTTLRTTVINQFLVKLKSDFDEDDNKAFINELKISVEESVAQLQGLERRMEVCQERLNKQKSSLREMDSLIELKNVLNKSKNNTKSIYLYRYFIIDIIAFLLMGGFIVYVKNLLTRFFTR

SEQ ID NO: 22422 - protein, 1574 aa, Saccharomyces cerevisiae
MSFEVGTRCWYPHKELGWIGAEVIKNEFNDGKYHLELQLEDDEIVSVDTKDLNNDKDQSLPLLRNPPILEATEDLTSLSYLNEPAVLHAIKQRYSQLNIYTYSGIVLIATNPFDRVDQLYTQDMIQAYAGKRRGELEPHLFAIAEEAYRLMKNDKQNQTIVVSGESGAGKTVSAKYIMRYFASVEEENSATVQHQVEMSETEQKILATNPIMEAFGNAKTTRNDNSSRFGKYLEILFDKDTSIIGARIRTYLLERSRLVYQPPIERNYHIFYQLMAGLPAQTKEELHLTDASDYFYMNQGGDTKINGIDDAKEYKITVDALTLVGITKETQHQIFKILAALLHIGNIEIKKTRNDASLSADEPNLKLACELLGIDAYNFAKWVTKKQIITRSEKIVSNLNYSQALVAKDSVAKFIYSALFDWLVENINTVLCNPAVNDQISSFIGVLDIYGFEHFEKNSFEQFCINYANEKLQQEFNQHVFKLEQEEYVKEEIEWSFIEFNDNQPCIDLIENKLGILSLLDEESRLPAGSDESWTQKLYQTLDKSPTNKVFSKPRFGQTKFIVSHYALDVAYDVEGFIEKNRDTVSDGHLEVLKASTNETLINILEGLEKAAKKLEEAKKLELEQAGSKKPGPIRTVNRKPTLGSMFKQSLIELMNTINSTNVHYIRCIKPNADKEAWQFDNLMVLSQLRACGVLETIRISCAGFPSRWTFEEFVLRYYILIPHEQWDLIFKKKETTEEDIISVVKMILDATVKDKSKYQIGNTKIFFKAGMLAYLEKLRSNKMHNSIVMIQKKIRAKYYRKQYLQISQAIKYLQNNIKGFIIRQRVNDEMKVNCATLLQAAYRGHSIRANVFSVLRTITNLQKKIRKELKQRQLKQEHEYNAAVTIQSKVRTFEPRSRFLRTKKDTVVVQSLIRRRAAQRKLKQLKADAKSVNHLKEVSYKLENKVIELTQNLASKVKENKEMTERIKELQVQVEESAKLQETLENMKKEHLIDIDNQKSKDMELQKTIENNLQSTEQTLKDAQLELEDMVKQHDELKEESKKQLEELEQTKKTLVEYQTLNGDLQNEVKSLKEEIARLQTAMSLGTVTTSVLPQTPLKDVMGGGASNFNNMMLENSDLSPNDLNLKSRSTPSSGNNHIDSLSVDRENGVNATQINEELYRLLEDTEILNQEITEGLLKGFEVPDAGVAIQLSKRDVVYPARILIIVLSEMWRFGLTKQSESFLAQVLTTIQKVVTQLKGNDLIPSGVFWLANVRELYSFVVFALNSILTEETFKNGMTDEEYKEYVSLVTELKDDFEALSYNIYNIWLKKLQKQLQKKAINAVVISESLPGFSAGETSGFLNKIFANTEEYTMDDILTFFNSIYWCMKSFHIENEVFHAVVTTLLNYVDAICFNELIMKRNFLSWKRGLQLNYNVTRLEEWCKTHGLTDGTECLQHLIQTAKLLQVRKYTIEDIDILRGICYSLTPAQLQKLISQYQVADYESPIPQEILRYVADIVKKEAALSSSGNDSKGHEHSSSIFITPETGPFTDPFSLIKTRKFDQVEAYIPAWLSLPSTKRIVDLVAQQVVQDGH

SEQ ID NO: 22423 - protein, 115 aa, Saccharomyces cerevisiae
MSSSVPYDPYVPPEESNSGANPNSQNKTAALRQEIDDTVGIMRDNINKVAERGERLTSIEDKADNLAISAQGFKRGANRVRKQMWWKDLKMRMCLFLVVIILLVVIIVPIVVHFS

SEQ ID NO: 22424 - protein, 1564 aa, Saccharomyces cerevisiae
MLQAPSSSNSGLNQGNAAPDGPPNETQPYEGLDAAAQEEIKELARTLTSQSSLLSQEKRITGTGDPNTLTAASSSSLSRSIFASDIKGVNPILLDVNDPDYDETLDPRSENFSSVRWVRNMAQICENDSDFYKPFSLGCAWKDLSASGDSADITYQGTFGNMPIKYLKMSWRCISRRLFHRTHGKSEDNDSGFQILKPMDGCINPGELLVVLGRPGAGCTTLLKSISVNTHGFKISPDTIITYNGFSNKEIKNHYRGEVVYNAESDIHIPHLTVFQTLYTVARLKTPRNRIKGVDRDTFAKHMTEVAMATYGLSHTADTKVGNDFVRGVSGGERKRVSIAEVSICGSKFQCWDNATRGLDSATALEFIKALKTQATITKSAATVAIYQCSKDAYDLFDKVCVLYDGYQIFFGPSKQAKKYFQRMGYVCPERQTTADYLTSITSPSERIKDKDMVKHGIMIPQTAYEMNQYWIQSEEYKQLQVQVNKHLDTDSSQQREQIKNAHIAKQSKRARPSSPYTVSFFLQVKYILIRDIWRIKNDPSIQLFTVLSHAAMALILGSMFYEVMLSTTTTTFYYRGAAIFFAILFNAFSSLLEIFSLYETRPITEKHKTYSLYRPSADAFASTFSDVPTKLATAVTFNIPYYFLINLKRDAGAFFFYFLINIITVFAMSHLFRCIGSVSKTLPQAMVPASVLLLAFAMYTGFAIPRVQMLGWSKWISYINPLSYLFESLMINEFHGRNFPCAQYIPSGPNYVNATGDEVTCSALGSIPGNNYVSGDDFIQTNYGYRHKNKWRSVGIGLAYIIFFLFLYLFFCEYNEGAKQNGEMLVFPHSVVKKMKKKGIVSEKKKKNQPTLSTSDAEKDVEMNNNSSATDSRFLRDSDAAIMGNDKTVAKEHYSSPSSSASQSNSFSKSDDIELSKSQAIFHWKNLCYDIPIKNGKRRILDNVDGWVKPGTLTALIGASGAGKTTLLDCLAERTTMGLITGDVFVDGRPRDQSFPRSIGYCQQQDLHLKTATVRESLRFSAYLRQADDVSIEEKDKYVEEVIEVLEMKLYADAIVGVPGEGLNVEQRKRLTIGVELAAKPKLLVFLDEPTSGLDSQTAWSTCQLMKKLASRGQAILCTIHQPSALLMQEFDRLLFLQEGGQTVYFGELGKGCKTMINYFEAHGAHKCPPDANPAEWMLEIVGAAPGTHASQDYFAIWRDSEEYREMQKELDWMERELPKRTEGSSNEEQKEFATSTLYQIKLVSYRLFHQYWRTPFYLWSKFFSTIVSELFIGFTFFKANTSLQGLQNQMLAIFMFTVVFNPILQQYLPLFVQQRELYEARERPSRTFSWKAFIVSQILVEIPWNLLAGTIAFFVYYYPVGFYRNASYANQLHERGALFWLFACAFYVYISSMGVLVISCIEIAENAANLASLFFIMSLSFCGVLATPNILPRFWIFMYRVSPLTYLIDALLSVGLANASVVCSSNELLKIVPPSGMTCSEYMEPYMQSTGTGYLLDGSSETECHFCQFSSTNDYLATVSSSYSRRWMNYGIFSAYIVFDYCAAIFLYWLVRVPKKSKKLKK

SEQ ID NO: 22425 - protein, 233 aa, Saccharomyces cerevisiae
MSSAITALTPNQVNDELNKMQAFIRKEAEEKAKEIQLKADQEYEIEKTNIVRNETNNIDGNFKSKLKKAMLSQQITKSTIANKMRLKVLSAREQSLDGIFEETKEKLSGIANNRDEYKPILQSLIVEALLKLLEPKAIVKALERDVDLIESMKDDIMREYGEKAQRAPLEEIVISNDYLNKDLVSGGVVVSNASDKIEINNTLEERLKLLSEEALPAIRLELYGPSKTRKFFD

SEQ ID NO: 22426 - protein, 363 aa, Saccharomyces cerevisiae
MLDNMQFHSPAPEHPQLNGGINKIPASHKIGYKLNQQVQRLAVVRNNIEERLNSMESSHGQISDSSVVRAIDASIDDFLIPSPPLSPKLRQCPIISQPQLVNVESDHRELIMLTPVWEAGLNSQKYNHNTRNFLSQYSFFRDMKTTKRIPNKENRKLKVVKSVVNSEALPKRRRYDRKIKRRSRELYEDDGNRSENYDEESAQEVPVRSVTPIRQVKRSLHTISSPLASQGVVNNVPKYIPSMSWEKLPDYSPPLHTLPNSNNKVLKVEWKGSPMDLNHDPLKQRLHPAELVLAQILRLPCDLYLDSKRRFFLEKVHRFKKGLPFRRTDAQKACRIDVNKASRLFAAFEKVGWLQDKHFEKYL

SEQ ID NO: 22427 - protein, 156 aa, Saccharomyces cerevisiae
MAVEEGGCVTKRLQNELLQLLSSTTESISAFPVDDNDLTYWVGYITGPKDTPYSGLKFKVSLKFPQNYPFHPPMIKFLSPMWHPNVDKSGNICLDILKEKWSAVYNVETILLSLQSLLGEPNNRSPLNAVAAELWDADMEEYRKKVLACYEEIDDY

SEQ ID NO: 22428 - protein, 1664 aa, Saccharomyces cerevisiae
MDISKPVGSEITSVDFGILTAKEIRNLSAKQITNPTVLDNLGHPVSGGLYDLALGAFLRNLCSTCGLDEKFCPGHQGHIELPVPCYNPLFFNQLYIYLRASCLFCHHFRLKSVEVHRYACKLRLLQYGLIDESYKLDEITLGSLNSSMYTDDEAIEDNEDEMDGEGSKQSKDISSTLLNELKSKRSEYVDMAIAKALSDGRTTERGSFTATVNDERKKLVHEFHKKLLSRGKCDNCGMFSPKFRKDGFTKIFETALNEKQITNNRVKGFIRQDMIKKQKQAKKLDGSNEASANDEESFDVGRNPTTRPKTGSTYILSTEVKNILDTVFRKEQCVLQYVFHSRPNLSRKLVKADSFFMDVLVVPPTRFRLPSKLGEEVHENSQNQLLSKVLTTSLLIRDLNDDLSKLQKDKVSLEDRRVIFSRLMNAFVTIQNDVNAFIDSTKAQGRTSGKVPIPGVKQALEKKEGLFRKHMMGKRVNYAARSVISPDPNIETNEIGVPPVFAVKLTYPEPVTAYNIAELRQAVINGPDKWPGATQIQNEDGSLVSLIGMSVEQRKALANQLLTPSSNVSTHTLNKKVYRHIKNRDVVLMNRQPTLHKASMMGHKVRVLPNEKTLRLHYANTGAYNADFDGDEMNMHFPQNENARAEALNLANTDSQYLTPTSGSPVRGLIQDHISAGVWLTSKDSFFTREQYQQYIYGCIRPEDGHTTRSKIVTLPPTIFKPYPLWTGKQIITTVLLNVTPPDMPGINLISKNKIKNEYWGKGSLENEVLFKDGALLCGILDKSQYGASKYGIVHSLHEVYGPEVAAKVLSVLGRLFTNYITATAFTCGMDDLRLTAEGNKWRTDILKTSVDTGREAAAEVTNLDKDTPADDPELLKRLQEILRDNNKSGILDAVTSSKVNAITSQVVSKCVPDGTMKKFPCNSMQAMALSGAKGSNVNVSQIMCLLGQQALEGRRVPVMVSGKTLPSFKPYETDAMAGGYVKGRFYSGIKPQEYYFHCMAGREGLIDTAVKTSRSGYLQRCLTKQLEGVHVSYDNSIRDADGTLVQFMYGGDAIDITKESHMTQFEFCLDNYYALLKKYNPSALIEHLDVESALKYSKKTLKYRKKHSKEPHYKQSVKYDPVLAKYNPAKYLGSVSENFQDKLESFLDKNSKLFKSSDGVNEKKFRALMQLKYMRSLINPGEAVGIIASQSVGEPSTQMTLNTFHFAGHGAANVTLGIPRLREIVMTASAAIKTPQMTLPIWNDVSDEQADTFCKSISKVLLSEVIDKVIVTETTGTSNTAGGNAARSYVIHMRFFDNNEYSEEYDVSKEELQNVISNQFIHLLEAAIVKEIKKQKRTTGPDIGVAVPRLQTDVANSSSNSKRLEEDNDEEQSHKKTKQAVSYDEPDEDEIETMREAEKSSDEEGIDSDKESDSDSEDEDVDMNEQINKSIVEANNNMNKVQRDRQSAIISHHRFITKYNFDDESGKWCEFKLELAADTEKLLMVNIVEEICRKSIIRQIPHIDRCVHPEPENGKRVLVTEGVNFQAMWDQEAFIDVDGITSNDVAAVLKTYGVEAARNTIVNEINNVFSRYAISVSFRHLDLIADMMTRQGTYLAFNRQGMETSTSSFMKMSYETTCQFLTKAVLDNEREQLDSPSARIVVGKLNNVGTGSFDVLAKVPNAA

SEQ ID NO: 22429 - protein, 319 aa, Saccharomyces cerevisiae
MTILEELNDSSIPQRLDNHIFFGSVHSLTHTDFLVENNIRFFINVDLSTELISHIYHEVRSKFAHEIVIVNIDNDSQIPIESDLVRSFHWHNTSLLQQLIHHLDFLSGINNHGEPLTPPPESHYRNAYVQFDHPSDSVSILDKLLYGNKSEYSRTNIFQVTNEAKFQVFNDLITIFKYSIAQGGNTNSNILVLSENGSTDENLISLLMSTVLKENPTFNVYQALQFVKSIAVIPDTVRDEKILWVTGFINYQELIKKNEMYWGLGSQKGRKLTSFASPISKVERKQRRRDDQNIMRSKLPQQRQNPFCSTERPKRARCD

SEQ ID NO: 22430 - protein, 506 aa, Saccharomyces cerevisiae
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGVGHSNTLRISTVGQEF

SEQ ID NO: 22431 - protein, 627 aa, Saccharomyces cerevisiae
MVNILPFHKNNRHSAGVVTCADDVSGDGSGGDTKKEEDVVQVTESPSSGSRNNHRSDNEKDDAIRMEKISKNQSASSNGTIREDLIMDVDLEKSPSVDGDSEPHKLKQGLQSRHVQLIALGGAIGTGLLVGTSSTLHTCGPAGLFISYIIISAVIYPIMCALGEMVCFLPGDGSDSAGSTANLVTRYVDPSLGFATGWNYFYCYVILVAAECTAASGVVEYWTTAVPKGVWITIFLCVVVILNFSAVKVYGESEFWFASIKILCIVGLIILSFILFWGGGPNHDRLGFRYWQHPGAFAHHLTGGSLGNFTDIYTGIIKGAFAFILGPELVCMTSAECADQRRNIAKASRRFVWRLIFFYVLGTLAISVIVPYNDPTLVNALAQGKPGAGSSPFVIGIQNAGIKVLPHIINGCILTSAWSAANAFMFASTRSLLTMAQTGQAPKCLGRINKWGVPYVAVGVSFLCSCLAYLNVSSSTADVFNWFSNISTISGFLGWMCGCIAYLRFRKAIFYNGLYDRLPFKTWGQPYTVWFSLIVIGIITITNGYAIFIPKYWRVADFIAAYITLPIFLVLWFGHKLYTRTWRQWWLPVSEIDVTTGLVEIEEKSREIEEMRLPPTGFKDKFLDALL

SEQ ID NO: 22432 - protein, 497 aa, Saccharomyces cerevisiae
MRPLYSCNLATKDDIEMAGGVAPAHLEVNVGGYNTEQTIPIVKHQLVKVGRNDKECQLVLTNPSISSVHCVFWCVFFDEDSIPMFYVKDCSLNGTYLNGLLLKRDKTYLLKHCDVIELSQGSEENDIKKTRLVFMINDDLQSSLDPKLLDQMGFLREVDQWEITNRIVGNGTFGHVLITHNSKERDEDVCYHPENYAVKIIKLKPNKFDKEARILLRLDHPNIIKVYHTFCDRNNHLYIFQDLIPGGDLFSYLAKGDCLTSMSETESLLIVFQILQALNYLHDQDIVHRDLKLDNILLCTPEPCTRIVLADFGIAKDLNSNKERMHTVVGTPEYCAPEVGFRANRKAYQSFSRAATLEQRGYDSKCDLWSLGVITHIMLTGISPFYGDGSERSIIQNAKIGKLNFKLKQWDIVSDNAKSFVKDLLQTDVVKRLNSKQGLKHIWIAKHLSQLERLYYKKILCNNEGPKLESINSDWKRKLPKSVIISQAIPKKKKVLE

SEQ ID NO: 22433 - protein, 288 aa, Saccharomyces cerevisiae
MTSIGTGYDLSNSVFSPDGRNFQVEYAVKAVENGTTSIGIKCNDGVVFAVEKLITSKLLVPQKNVKIQVVDRHIGCVYSGLIPDGRHLVNRGREEAASFKKLYKTPIPIPAFADRLGQYVQAHTLYNSVRPFGVSTIFGGVDKNGAHLYMLEPSGSYWGYKGAATGKGRQSAKAELEKLVDHHPEGLSAREAVKQAAKIIYLAHEDNKEKDFELEISWCSLSETNGLHKFVKGDLLQEAIDFAQKEINGDDDEDEDDSDNVMSSDDENAPVATNANATTDQEGDIHLE

SEQ ID NO: 22434 - protein, 996 aa, Saccharomyces cerevisiae
MYFTDESSPAMNRVGKKRNRLSFVCQACRKAKTKCDQEKPRCGRCTKQNLFCIYDVARQAAPRNPNKDATIARLKKEIRYWRNKTVDLTQEKKDFYTALKRPTEELAARRTCKSLQENSFPISLYKTHPRLIMTKVMKREINPLSEKYLIFQDTFLKTLIASVLLSCSRNSMIPALNADISRSRTQPCVKNNVVKMREVLLKNSKYESQRKSINEFTDRLLQRKNPEEQIAVNKVISLLYSNRESSYLEDTCPTENDYSDLLKGYINEIEKTLPPKAIIEQYLSHFFEHIFHLIPFASKEMLEESIHTTVQYNELGEVRLSMGTTLIRNKMENLCILLLILRIAYISLTFIEDKIEDYSPYITKEMLEQYPIQSEVIFLAQQILASENWCACANENTISCLLYIWCAFVFSPTEGDFLLEQPSDVIINLVILIGTSIGLHRDPSDFPALNHPEASDKRLLNLRRIQWLSIISMATLESSLKGRLLVSPLSMIDLFIDVRDPNCVEIYKKRVKKDLTGSESDEQLLEIHEIFFHRAQLALFLSDLNNITISYSGSVPMDTLETLRVKANELLKNKFQLRSVDINIYDEEKTFQKLTFNSILNSISLSGQILGKLMMLRASIALMLYFETLAMERSECLSFFYKYFFQCCADTISLIRFFFLYFNGSYEKVLSSLVCFITTKVIQLAVPTTMFTLLVIIMRVELAKNMLLVKCNECNARGDISDLPEIKEKIKSLDTIKENFERLLLEVYLLASQNLRFKYFYIFKMLTLFDVFIQRLRKGQLFSGLFVKVDKDLTTKKIATMLELTLGINLDKSDHLIDRLKGKNLTVNFTLDQLYQIIKEFDRIKNIGVADPQNSLNPSKPNMKDNTPTIELLLNSSVENESVPPYSSSNDPTNVGNASTYSLAHNISNQNNEENMPPSIGSSESNRAAPNLNFMPINNNYNNSGSNINNNDNVKLPSNFKNYYDPPMSSLDISMDVPDIFGSLDFFDYDLLFQND

SEQ ID NO: 22435 - protein, 703 aa, Saccharomyces cerevisiae
MLPIKVFSLSRIFVLLAIFRQIHAISINSSTFQVSNSFTLLNNASTLFPVPFDAYTKEYLRTSALLTCAKDSQFSASYFEAAFFPRNNTLFFNVEAQTIMSENITIKAELIAYGLNVYTKVFDLCGIQDNLLCPLKPGNIELMGSYYVEAAVASQIPSITYNIPDLDAYIVVTAYSTIDKEFTKPLACVQVMLSNGRTVQTEYLSWNLVILTISGIMFSVVYSLQGYTVTSTRLASYSISLLLYFQNLAILAMISVSFLPPIVAAWTQNFQWSMGIIRINFMQRLFDWYVVATSGSPTVVYRNKEVLSISVQKRSLNSKIISASSNLNGIESSQKNDLLYTSNLRNSNDYLSKILVLRGIKRVSYKAGIEISNFFLTGFSFFIIFICMIILAFIIFKTFLKVLQKFKVKTIRYLHFHTHWSALLQGTLYRAVFIIYSEISLLALWEFTQTDSAATLVEAIVVFILITVLLSSASVRIWRKMIKSKKIFGQPSYLLFSSSKFLNKFGFLSSQFKSTKVWWLMATSAHMLIRSILVGSLQAHGKSQSIGIFLNEAIYLILLCWMQPYMDKTTNFFNISIHSLNLVNAFFFLFFSNLFQQPIAVSSFMGLIFFFLNAAFSLYLFIFILICFTMAIYYKHPDTRYKPIDDQRRSFLKGEMDDDAVYESVPELHEMKKAVLECNGIQKPQINKIDLCKQNSNCEYLYM

SEQ ID NO: 22436 - protein, 200 aa, Saccharomyces cerevisiae
MSYDKKADVTSLDEDLRQLRESKFSPEAIQNIKIWVYKSVLKEIAPPGDLLECLKDGTVLCKLANILYEADTGEANHISWKSSKMPFVQMDQISQFLSFSRKYGVPEDELFQTIDLFEKKDPAIVFQTLKSLSRYANKKHTDRFPVLGPQLSTKKPRPPVKSKPKHLQDGTGWSTFEYGYMKGASQATEGVVLGQRRDIV

SEQ ID NO: 22437 - protein, 897 aa, Saccharomyces cerevisiae
MPQASTFGSHSLEAHPLHIQPAVHIKLSKEERSHYREQYDSLKYISNYVSVFDQALSDNIDSRIRKENEALLKKYYESRKPFTFTSFRQGSVISSSDSSTGFTERTKTYCFLNDFVSNCVNEVDPYTLKMTVRNRNTALNMENLDDERKSKDDIYDFEDNTDDECNAKCHGAFHYSSERLEILRSRSTISYFKYYKKLLTVDLRDSDVLKRHNLWMPMITRRFRFLLVSSSKPEDVRLTTPIPTFSESDLDIFKNKTCPLFINGTDCVPRSYDTFSGSSVIASIFSEYKLPSLSYHCSVELNDQLFIVGGLMACHRYDEEAPDLKDFYVDGIKNLPPPLIPELINNPSMIPNPHLYCFSLTSSRLTRPDISGYIPPPLVCTQGCKLTERHIFLYGGFEIKSETQVDDKGRYFIRKRAFLNNTGYILDTVTFNFSKIELVAPPYQFAIYNNFSPRFGHMQASISNSNNNVSNENTTTSAKGRRSISPYRQGNGDHKIDDLVGSPGSTDYLEDDAIPPVTNPRSTDSLSSKHCSTATHICSSVNTILIFGGYSQTGDDKYEAMNDMWKINIPVVSRGKRNYYKFADTVTATKIPIIDDPELWPSRRAFSACCVPDYFTKDVEPIETRLLRNLKNDFSIDLEIRPGNKPSQPLFPNIPHSRKEKKSGRDSMHISNSNNSTSEDTSSKSTRNTTSSPPTSPKHTPPLNPSKKCASIGRTIAFHGGSDGYDVCSDMWWFDFDSETWTKIDLYAKTQEESDGLVPINLCMVGHSMTTVGHKVVLIGGLRQGDVDRIYRDETLPEEVISGVPLGSGVINVVDLNTQCLQGCKLIRNDGDTKESVIMDPHVGTPHQVLAVAGTIELVKGTMTLIGGVVAGREDISSLYLRGAVLQFILPSMNLAN

SEQ ID NO: 22438 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 22439 - protein, 454 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 22440 - protein, 437 aa, Saccharomyces cerevisiae
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 22441 - protein, 437 aa, Saccharomyces cerevisiae; identical to SEQ ID NO: 22440

SEQ ID NO: 22442 - protein, 587 aa, Saccharomyces cerevisiae
MDILKRGNESDKFTKIETESTTIPNDSDRSGSLIRRMKDSFKQSNLHVIPEDLENSEQTEQEKIQWKLASQPYQKVLSQRHLTMIAIGGTLGTGLFIGLGYSLASGPAALLIGFLLVGTSMFCVVQSAAELSCQFPVSGSYATHVSRFIDESVGFTVATNYALAWLISFPSELIGCALTISYWNQTVNPAVWVAIFYVFIMVLNLFGVRGFAETEFALSIIKVIAIFIFIIIGIVLIAGGGPNSTGYIGAKYWHDPGAFAKPVFKNLCNTFVSAAFSFGGSELVLLTSTESKNISAISRAAKGTFWRIAIFYITTVVIIGCLVPYNDPRLLSGSNSEDVSASPFVIALSNTGSMGAKVSNFMNVVILVAVVSVCNSCVYASSRLIQALGASGQLPSVCSYMDRKGRPLVGIGISGAFGLLGFLVASKKEDEVFTWLFALCSISSFFTWFCICMSQIRFRMALKAQGRSNDEIAYKSILGVYGGILGCVLNALLIAGEIYVSAAPVGSPSSAEAFFEYCLSIPIMIVVYFAHRFYRRDWKHFYIKRSEIDLDTGCSVENLELFKAQKEAEEQLIASKPFYYKIYRFWC

SEQ ID NO: 22443 - protein, 325 aa, Saccharomyces cerevisiae
MARLPLKQFLADNPKKVLVLDGGQGTELENRGIKVANPVWSTIPFISESFWSDESSANRKIVKEMFNDFLNAGAEILMTTTYQTSYKSVSENTPIRTLSEYNNLLNRIVDFSRNCIGEDKYLIGCIGPWGAHICREFTGDYGAEPENIDFYQYFKPQLENFNKNDKLDLIGFETIPNIHELKAILSWDESILSRPFYIGLSVHEHGVLRDGTTMEEIAQVIKDLGDKINPNFSFLGINCVSFNQSPDILESLHQALPNMALLAYPNSGEVYDTEKKIWLPNSDKLNSWDTVVKQYISSGARIIGGCCRTSPKDIQEISAAVKKYT

SEQ ID NO: 22444 - protein, 820 aa, Saccharomyces cerevisiae
MKTYVLLYGKLIMTTMILNTGRFEEWYKVCIIALKEKEIYVPSSPIAMLNGRLPLLRLGICRNMLSRPRLAKLPSIRFRSLVTPSSSQLIPLSRLCLRSPAVGKSLILQSFRCNSSKTVPETSLPSASPISKGSARSAHAKEQSKTDDYKDIIRLFMLAKRDWKLLLTAILLLTISCSIGMSIPKVIGIVLDTLKTSSGSDFFDLKIPIFSLPLYEFLSFFTVALLIGCAANFGRFILLRILSERVVARLRANVIKKTLHQDAEFFDNHKVGDLISRLGSDAYVVSRSMTQKVSDGVKALICGVVGVGMMCSLSPQLSILLLFFTPPVLFSASVFGKQIRNTSKDLQEATGQLTRVAEEQLSGIKTVQSFVAEGNELSRYNVAIRDIFQVGKTAAFTNAKFFTTTSLLGDLSFLTVLAYGSYLVLQSQLSIGDLTAFMLYTEYTGNAVFGLSTFYSEIMQGAGAASRLFELTDRKPSISPTVGHKYKPDRGVIEFKDVSFSYPTRPSVQIFKNLNFKIAPGSSVCIVGPSGRGKSTIALLLLRYYNPTTGTITIDNQDISKLNCKSLRRHIGIVQQEPVLMSGTIRDNITYGLTYTPTKEEIRSVAKQCFCHNFITKFPNTYDTVIGPHGTLLSGGQKQRIAIARALIKKPTILILDEATSALDVESEGAINYTFGQLMKSKSMTIVSIAHRLSTIRRSENVIVLGHDGSVVEMGKFKELYANPTSALSQLLNEKAAPGPSDQQLQIEKVIEKEDLNESKEHDDQKKDDNDDNDNNHDNDSNNQSPETKDNNSDDIEKSVEHLLKDAAKEANPIKITPQP

SEQ ID NO: 22445 - protein, 644 aa, Saccharomyces cerevisiae
MDNDGPRSMTIGDDFQENFCERLERIHNTLHSINDCNSLNESTTSISETLLVQFYDDLENVASVIPDLVNKKRLGKDDILLFMDWLLLKKYMLYQFISDVHNIEEGFAHLLDLLEDEFSKDDQDSDKYNRFSPMFDVIEESTQIKTQLEPWLTNLKELLDTSLEFNEISKDHMDTLHKIINSNISYCLEIQEERFASPIRHTPSFTLEQLVKLLGTHTETTEPKVPKFSPAEDILSRKFLNLKKNIPPIEKSLTDILPQRIVQFGHRNITNITTLQTILQKKYELIMKDYRFMNSEFRELKVELIDKRWNILFINLNHELLYILDEIERLQSKLLTTKYTKDITIRLERQLERKSKTVSKTFNIIYRALEFSLLDAGVASKTNELAQRWLNIKPTADKILIKSSASNKIATSKKKIPKPKSLGFGRPNSVIGTITQDFQERVAINEGDSNKTPENSTTVALKGKKLGKALLQKMNIKPATSPNSSNAINPFFDPESPNKGKLILSSVPPLPYDETDETTLRVSRGENEKSPDSFITSRHENKVQITETPLMAKNKSVLDIEKDKWNHYRSLPSRIPIYKDKVVKVTVENTPIAKVFQTPPTKITTPNSQVWVPSTRRRTRLRPPTPLSQLLSPREGRLDKTPTY

SEQ ID NO: 22446 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDTASTYQEEVDPKRLRSDSKLWIAIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHADIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 22447 - protein, 608 aa, Saccharomyces cerevisiae
MKMPLKKMFTSTSPRNSSSLDSDHDAYYSKQNPDNFPVKEQEIYNIDLEENNVSSRSSTSTSPSARDDSFAVPDGKDENTRLRKDLKARHISMIAIGGSLGTGLLIGTGTALLTGGPVAMLIAYAFVGLLVFYTMACLGEMASYIPLDGFTSYASRYVDPALGFAIGYTYLFKYFILPPNQLTAAALVIQYWISRDRVNPGVWITIFLVVIVAINVVGVKFFGEFEFWLSSFKVMVMLGLILLLFIIMLGGGPNHDRLGFRYWRDPGAFKEYSTAITGGKGKFVSFVAVFVYSLFSYTGIELTGIVCSEAENPRKSVPKAIKLTVYRIIVFYLCTVFLLGMCVAYNDPRLLSTKGKSMSAAASPFVVAIQNSGIEVLPHIFNACVLVFVFSACNSDLYVSSRNLYALAIDGKAPKIFAKTSRWGVPYNALILSVLFCGLAYMNVSSGSAKIFNYFVNVVSMFGILSWITILIVYIYFDKACRAQGIDKSKFAYVAPGQRYGAYFALFFCILIALIKNFTVFLGHKFDYKTFITGYIGLPVYIISWAGYKLIYKTKVIKSTDVDLYTFKEIYDREEEEGRMKDQEKEERLKSNGKNMEWFYEKFLGNIF

SEQ ID NO: 22448 - protein, 488 aa, Saccharomyces cerevisiae
MLRFTNCSCKTFVKSSYKLNIRRMNSSFRTETDAFGEIHVPADKYWGAQTQRSFQNFKIGGARERMPLPLVHAFGVLKKSAAIVNESLGGLDPKISKAIQQAADEVASGKLDDHFPLVVFQTGSGTQSNMNANEVISNRAIEILGGKIGSKQVHPNNHCNQSQSSNDTFPTVMHIAASLQIQNELIPELTNLKNALEAKSKEFDHIVKIGRTHLQDATPLTLGQEFSGYVQQVENGIQRVAHSLKTLSFLAQGGTAVGTGLNTKPGFDVKIAEQISKETGLKFQTAPNKFEALAAHDAIVECSGALNTLACSLFKIAQDIRYLGSGPRCGYHELMLPENEPGSSIMPGKVNPTQNEALTQVCVQVMGNNAAITFAGSQGQFELNVFKPVMIANLLNSIRLITDAAYSFRVHCVEGIKANEPRIHELLTKSLMLVTALNPKIGYDAASKVAKNAHKKGITLKESALELGVLTEKEFDEWVVPEHMLGPK

SEQ ID NO: 22449 - protein, 545 aa, Saccharomyces cerevisiae
MASAEPRPRMGLVINAKPDYYPIELSNAELLSHFEMLQEYHQEISTNVIAQSCKFKPNPKLIDQQPEMNPVETRSNIITFLFELSVVTRVTNGIFFHSVRLYDRYCSKRIVLRDQAKLVVATCLWLAAKTWGGCNHIINNVVIPTGGRFYGPNPRARIPRLSELVHYCGDGQVFDESMFLQMERHILDTLNWNIYEPMINDYVLNVDENCLMQYELYENQVTYDKQCSEKRQSQLSQDSDATVDERPYQNEEEEEEDLKLKIKLINLKKFLIDVSAWQYDLLRYELFEVSHGIFSIINQFTNQDHGPFLMTPMTSESKNGEILSTLMNGIVSIPNSLMEVYKTVNGVLPFINQVKEYHLDLQRKLQIASNLNISRKLTISTPSCSFENSNSTSIPSPASSSQSHTPMRNMSSLSDNSVFSRNMEQSSPITPSMYQFGQQQSNSICGSTVSVNSLVNTNNKQRIYEQITGPNSNNATNDYIDLLNLNESNKENQNPATAHYLNGGPPKTSFINHGMFPSPTGTINSGKSSSASSLISFGMGNTQVI

SEQ ID NO: 22450 - protein, 647 aa, Saccharomyces cerevisiae
MASQQNKHAFLSKNRIFHNPDNVSSSKSRNLMDITNTTNTMNGSRPSSMKSSLALPPVKDSFPSVSRSASLNINMSKIKDLKDRQDKIRFQRHTLRTQLIECEREIKTIKFRDLNKSRFELYKKKSKQAKYLKQVRDLTQNLNSKDGERADLIKKNKSALATLQAELDQNLILKRQESQELYNNKLIFWENELQIMENVEPDHEITEEISQLKKTLQELNINWANLQKQNLERQVNHESQLRKDFIAFKEAKLKSMENLTNKHRELLDQIATLQSESEKLHKEIMDIDRQAEYSEQNISEINENIKQLELANNPLISKSLQNSQDLEHLQNQMENLKEMASKQEKFYNDTYNTVEKELLRSRRLENSIIEQKGTMRCYAYVMEQNLPENLLFDYENGVITQGLSEHVYKFNRVIPHLKVSEDKFFTQEYSVYHDMCLNQKKNFNLISLSTTPHGSLRESLIKFLAEKDTIYQKQYVITLQFVFLSDDEFSQDMLLDYSHNDKDSIKLKFEKHSISLDSKLVIIENGLEDLPLNFSCDEHPNLPHSGMGIIKVQFFPRDSKSDGNNDPVPVDFYFIELNNLKSIEQFDKSIFKKESCETPIALVLKKLISDTKSFFLLNLNDSKNVNKLLTISEEVQTQLCKRKKKLT

SEQ ID NO: 22451 - protein, 881 aa, Saccharomyces cerevisiae
MKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSIDSAAHHDNSTIPLDFMPRDALHGFDWSEEDDMSDGLPFLKTDPNNNGFFGDGSLLCILRSIGFKPENYTNSNVNRLPTMITDRYTLASRSTTSRLLQSYLNNFHPYCPIVHSPTLMMLYNNQIEIASKDQWQILFNCILAIGAWCIEGESTDIDVFYYQNAKSHLTSKVFESGSIILVTALHLLSRYTQWRQKTNTSYNFHSFSIRMAISLGLNRDLPSSFSDSSILEQRRRIWWSVYSWEIQLSLLYGRSIQLSQNTISFPSSVDDVQRTTTGPTIYHGIIETARLLQVFTKIYELDKTVTAEKSPICAKKCLMICNEIEEVSRQAPKFLQMDISTTALTNLLKEHPWLSFTRFELKWKQLSLIIYVLRDFFTNFTQKKSQLEQDQNDHQSYEVKRCSIMLSDAAQRTVMSVSSYMDNHNVTPYFAWNCSYYLFNAVLVPIKTLLSNSKSNAENNETAQLLQQINTVLMLLKKLATFKIQTCEKYIQVLEEVCAPFLLSQCAIPLPHISYNNSNGSAIKNIVGSATIAQYPTLPEENVNNISVKYVSPGSVGPSPVPLKSGASFSDLVKLLSNRPPSRNSPVTIPRSTPSHRSVTPFLGQQQQLQSLVPLTPSALFGGANFNQSGNIADSSLSFTFTNSSNGPNLITTQTNSQALSQPIASSNVHDNFMNNEITASKIDDGNNSKPLSPGWTDQTAYNAFGITTGMFNTTTMDDVYNYLFDDEDTPPNPKKE

SEQ ID NO: 22452 - protein, 709 aa, Saccharomyces cerevisiae [sequence omitted]

SEQ ID NO: 22453 - protein, 285 aa, Saccharomyces cerevisiae
MSSDLAAELGFDPALKKKKKTKKVIPDDFDAAVNGKENGSGDDLFAGLKKKKKKSKSVSADAEAEKEPTDDIAEALGELSLKKKKKKTKDSSVDAFEKELAKAGLDNVDAESKEGTPSANSSIQQEVGLPYSELLSRFFNILRTNNPELAGDRSGPKFRIPPPVCLRDGKKTIFSNIQDIAEKLHRSPEHLIQYLFAELGTSGSVDGQKRLVIKGKFQSKQMENVLRRYILEYVTCKTCKSINTELKREQSNRLFFMVCKSCGSTRSVSSIKTGFQATVGKRRRM

SEQ ID NO: 22454 - protein, 164 aa, Saccharomyces cerevisiae
MSTQLASNIYAPLYAPFFGFAGCAAAMVLSCLGAAIGTAKSGIGIAGIGTFKPELIMKSLIPVVMSGILAIYGLVVAVLIAGNLSPTEDYTLFNGFMHLSCGLCVGFACLSSGYAIGMVGDVGVRKYMHQPRLFVGIVLILIFSEVLGLYGMIVALILNTRGSE

SEQ ID NO: 22455 - protein, 1887 aa, Saccharomyces cerevisiae
MKPEVEQELAHILLTELLAYQFASPVRWIETQDVFLKDFNTERVVEIGPSPTLAGMAQRTLKNKYESYDAALSLHREILCYSKDAKEIYYTPDPSELAAKEEPAKEEAPAPTPAASAPAPAAAAPAPVAAAAPAAAAAEIADEPVKASLLLHVLVAHKLKKSLDSIPMSKTIKDLVGGKSTVQNEILGDLGKEFGTTPEKPEETPLEELAETFQDTFSGALGKQSSSLLSRLISSKMPGGFTITVARKYLQTRWGLPSGRQDGVLLVALSNEPAARLGSEADAKAFLDSMAQKYASIVGVDLSSAASASGAAGAGAAAGAAMIDAGALEEITKDHKVLARQQLQVLARYLKMDLDNGERKFLKEKDTVAELQAQLDYLNAELGEFFVNGVATSFSRKKARTFDSSWNWAKQSLLSLYFEIIHGVLKNVDREVVSEAINIMNRSNDALIKFMEYHISNTDETKGENYQLVKTLGEQLIENCKQVLDVDPVYKDVAKPTGPKTAIDKNGNITYSEEPREKVRKLSQYVQEMALGGPITKESQPTIEEDLTRVYKAISAQADKQDISSSTRVEFEKLYSDLMKFLESSKEIDPSQTTQLAGMDVEDALDKDSTKEVASLPNKSTISKTVSSTIPRETIPFLHLRKKTPAGDWKYDRQLSSLFLDGLEKAAFNGVTFKDKYVLITGAGKGSIGAEVLQGLLQGGAKVVVTTSRFSKQVTDYYQSIYAKYGAKGSTLIVVPFNQGSKQDVEALIEFIYDTEKNGGLGWDLDAIIPFAAIPEQGIELEHIDSKSEFAHRIMLTNILRMMGCVKKQKSARGIETRPAQVILPMSPNHGTFGGDGMYSESKLSLETLFNRWHSESWANQLTVCGAIIGWTRGTGLMSANNIIAEGIEKMGVRTFSQKEMAFNLLGLLTPEVVELCQKSPVMADLNGGLQFVPELKEFTAKLRKELVETSEVRKAVSIETALEHKVVNGNSADAAYAQVEIQPRANIQLDFPELKPYKQVKQIAPAELEGLLDLERVIVVTGFAEVGPWGSARTRWEMEAFGEFSLEGCVEMAWIMGFISYHNGNLKGRPYTGWVDSKTKEPVDDKDVKAKYETSILEHSGIRLIEPELFNGYNPEKKEMIQEVIVEEDLEPFEASKETAEQFKHQHGDKVDIFEIPETGEYSVKLLKGATLYIPKALRFDRLVAGQIPTGWNAKTYGISDDIISQVDPITLFVLVSVVEAFIASGITDPYEMYKYVHVSEVGNCSGSGMGGVSALRGMFKDRFKDEPVQNDILQESFINTMSAWVNMLLISSSGPIKTPVGACATSVESVDIGVETILSGKARICIVGGYDDFQEEGSFEFGNMKATSNTLEEFEHGRTPAEMSRPATTTRNGFMEAQGAGIQIIMQADLALKMGVPIYGIVAMAATATDKIGRSVPAPGKGILTTAREHHSSVKYASPNLNMKYRKRQLVTREAQIKDWVENELEALKLEAEEIPSEDQNEFLLERTREIHNEAESQLRAAQQQWGNDFYKRDPRIAPLRGALATYGLTIDDLGVASFHGTSTKANDKNESATINEMMKHLGRSEGNPVIGVFQKFLTGHPKGAAGAWMMNGALQILNSGIIPGNRNADNVDKILEQFEYVLYPSKTLKTDGVRAVSITSFGFGQKGGQAIVVHPDYLYGAITEDRYNEYVAKVSAREKSAYKFFHNGMIYNKLFVSKEHAPYTDELEEDVYLDPLARVSKDKKSGSLTFNSKNIQSKDSYINANTIETAKMIENMTKEKVSNGGVGVDVELITSINVENDTFIERNFTPQEIEYCSAQPSVQSSFAGTWSAKEAVFKSLGVKSLGGGAALKDIEIVRVNKNAPAVELHGNAKKAAEEAGVTDVKVSISHDDLQAVAVAVSTKK

SEQ ID NO: 22456 - protein, 793 aa, Saccharomyces cerevisiae
MQVLVTLWCLICTCLVLPVAAKKRTLTASSLVTCMENSQLSANSFDVSFSPDDRSLHYDLDMTTQIDSYIYAYVDVYAYGFKIITENFDVCSMGWKQFCPVHPGNIQIDSIEYIAQKYVKMIPGIAYQVPDIDAYVRLNIYNNVSENLACIQVFFSNGKTVSQIGVKWVTAVIAGIGLLTSAVLSTFGNSTAASHISANTMSLFLYFQSVAVVAMQHVDSVPPIAAAWSENLAWSMGLIRITFMQKIFRWYVEATGGSASLYLTATTMSVLTQRGLDYLKNTSVYKRAENVLYGNSNTLIFRGIKRMGYRMKIENTAIVCTGFTFFVLCGYFLAGFIMACKYSIELCIRCGWMRSDRFYQFRKNWRSVLKGSLLRYIYIGFTQLTILSFWEFTERDSAGVIVIACLFIVLSCGLMAWAAYRTIFFASKSVEMYNNPAALLYGDEYVLNKYGFFYTMFNAKHYWWNALLTTYILVKALFVGFAQASGKTQALAIFIIDLAYFVAIIRYKPYLDRPTNIVNIFICTVTLVNSFLFMFFSNLFNQKYAVSAIMGWVFFIMNAAFSLLLLLMILAFTTIILFSKNPDSRFKPAKDDRASFQKHAIPHEGALNKSVANELMALGNVAKDHTENWEYELKSQEGKSEDNLFGVEYDDEKTGTNSENAESSSKETTRPTFSEKVLRSLSIKRNKSKLGSFKRSAPDKITQQEVSPDRASSSPNSKSYPGVSHTRQESEANNGLINAYEDEQFSLMEPSILEDAASSTQMHAMPARDLSLSSVANAQDVTKKANILDPDYL

SEQ ID NO: 22457 - protein, 492 aa, Saccharomyces cerevisiae
MANDQDPNKSLINDALTRSMSEFYDDDDDNDSDMCRANDEGEDVFDLPLKVGVSQSRNFSEVNDVLDPLSSLHGPSKKVRFEQQKQQQQHQQLHNDFNTDFNLKSPSSKKMGVEQLIQSANEINDYLANNIDKVNSFNSELLSGSGKLPGRVKSDTATQGTGRLDSMSNFALSDTELDNDDDNYLLDPLANASSTTPTVEHHGYSLLDKALSTSDKEKIYTNKVNSNSQIDTDNHSHESGNTTNNETDENESSEILDYTKFDSFPYPPSSAPNGEPPDLKVLSIECEQENEKELRRISLLLDHYESIPKIPELSDDEALSKFRENIELILQLSKKINDNANTLAISSEDPQKFVNFVMKNPPSLSFRDFIDRIQNKCMFGAVVYLGATYLLQLVFLTRDEMDGPIKLKAKLQEDQAHRIIISTIRIATKLLEDFVHSQNYICKVFGISKRLLTKLEISFMASVNFDGLMITCEKLEKTLHILDDTRQALGNT

SEQ ID NO: 22458 - protein, 190 aa, Saccharomyces cerevisiae
MAGWDIFGWFRDVLASLGLWNKHGKLLFLGLDNAGKTTLLHMLKNDRLATLQPTWHPTSEELAIGNIKFTTFDLGGHIQARRLWKDYFPEVNGIVFLVDAADPERFDEARVELDALFNIAELKDVPFVILGNKIDAPNAVSEAELRSALGLLNTTGSQRIEGQRPVEVFMCSVVMRNGYLEAFQWLSQYI

SEQ ID NO: 22459 - protein, 367 aa, Saccharomyces cerevisiae
MQRNSLVNIKLNANSPSKKTTTRPNTSRINKPWRISHSPQQRNPNSKIPSPVREKLNRLPVNNKKFLDMESSKIPSPIRKATSSKMIHENKKLPKFKSLSLDDFELGKKLGKGKFGKVYCVRHRSTGYICALKVMEKEEIIKYNLQKQFRREVEIQTSLNHPNLTKSYGYFHDEKRVYLLMEYLVNGEMYKLLRLHGPFNDILASDYIYQIANALDYMHKKNIIHRDIKPENILIGFNNVIKLTDFGWSIINPPENRRKTVCGTIDYLSPEMVESREYDHTIDAWALGVLAFELLTGAPPFEEEMKDTTYKRIAALDIKMPSNISQDAQDLILKLLKYDPKDRMRLGDVKMHPWILRNKPFWENKRL

SEQ ID NO: 22460 - protein, 494 aa, Saccharomyces cerevisiae
MDLRVGRKFRIGRKIGSGSFGDIYHGTNLISGEEVAIKLESIRSRHPQLDYESRVYRYLSGGVGIPFIRWFGREGEYNAMVIDLLGPSLEDLFNYCHRRFSFKTVIMLALQMFCRIQYIHGRSFIHRDIKPDNFLMGVGRRGSTVHVIDFGLSKKYRDFNTHRHIPYRENKSLTGTARYASVNTHLGIEQSRRDDLESLGYVLIYFCKGSLPWQGLKATTKKQKYDRIMEKKLNVSVETLCSGLPLEFQEYMAYCKNLKFDEKPDYLFLARLFKDLSIKLEYHNDHLFDWTMLRYTKAMVEKQRDLLIEKGDLNANSNAASASNSTDNKSETFNKIKLLAMKKFPTHFHYYKNEDKHNPSPEEIKQQTILNNNAASSLPEELLNALDKGMENLRQQQPQQQVQSSQPQPQPQQLQQQPNGQRPNYYPEPLLQQQQRDSQEQQQQVPMATTRATQYPPQINSNNFNTNQASVPPQMRSNPQQPPQDKPAGQSIWL

SEQ ID NO: 22461 - protein, 380 aa, Saccharomyces cerevisiae
MEFVAERAQPVGQTIQQQNVNTYGQGVLQPHHDLQQRQQQQQQRQHQQLLTSQLPQKSLVSKGKYTLHDFQIMRTLGTGSFGRVHLVRSVHNGRYYAIKVLKKQQVVKMKQVEHTNDERRMLKLVEHPFLIRMWGTFQDARNIFMVMDYIEGGELFSLLRKSQRFPNPVAKFYAAEVILALEYLHAHNIIYRDLKPENILLDRNGHIKITDFGFAKEVQTVTWTLCGTPDYIAPEVITTKPYNKSVDWWSLGVLIYEMLAGYTPFYDTTPMKTYEKILQGKVVYPPYFHPDVVDLLSKLITADLTRRIGNLQSGSRDIKAHPWFSEVVWERLLAKDIETPYEPPITSGIGDTSLFDQYPEEQLDYGIQGDDPYAEYFQDF

SEQ ID NO: 22462 - protein, 802 aa, Saccharomyces cerevisiae
MSDENHNSDVQDIPSPELSVDSNSNENELMNNSSADDGIEFDAPEEEREAEREEENEEQHELEDVNDEEEEDKEEKGEENGEVINTEEEEEEEHQQKGGNDDDDDDNEEEEEEEEDDDDDDDDDDDDEEEEEEEEEEGNDNSSVGSDSAAEDGEDEEDKKDKTKDKEVELRRETLEKEQKDVDEAIKKITREENDNTHFPTNMENVNYDLLQKQVKYIMDSNMLNLPQFQHLPQEEKMSAILAMLNSNSDTALSVPPHDSTISTTASASATSGARSNDQRKPPLSDAQRRMRFPRADLSKPITEEEHDRYAAYLHGENKITEMHNIPPKSRLFIGNLPLKNVSKEDLFRIFSPYGHIMQINIKNAFGFIQFDNPQSVRDAIECESQEMNFGKKLILEVSSSNARPQFDHGDHGTNSSSTFISSAKRPFQTESGDMYNDDNGAGYKKSRRHTVSCNIFVKRTADRTYAIEVFNRFRDGTGLETDMIFLKPRMELGKLINDAAYNGVWGVVLVNKTHNVDVQTFYKGSQGETKFDEYISISADDAVAIFNNIKNNRNNSRPTDYRAMSHQQNIYGAPPLPVPNGPAVGPPPQTNYYQGYSMPPPQQQQQQPYGNYGMPPPSHDQGYGSQPPIPMNQSYGRYQTSIPPPPPQQQIPQGYGRYQAGPPPQPPSQTPMDQQQLLSAIQNLPPNVVSNLLSMAQQQQQQPHAQQQLVGLIQSMQGQAPQQQQQQLGGYSSMNSSSPPPMSTNYNGQNISAKPSAPPMSHQPPPPQQQQQQQQQQQQQQQQPAGNNVQSLLDSLAKLQK

SEQ ID NO: 22463 - protein, 549 aa, Saccharomyces cerevisiae
MRRSPSRSNNNFAVPNCSTNSNSSQQQLTTPSDDLNSNEPNDPDDSRSLPTIKKFNNKHSINNYNTLASAGKNNNNKRASNDNLLIPGENAHKQKIYTKDENLKSLYLDIDVSVAKALSSSATAPKLINTARTSSTTTATTSNNILTSPSYRESNYSSPSSYSFSSYYSSATSASSSTSSFLKSSGLSSRVKSPSSSVKAGSFGAPSSPTSGIPNPKSSKKPIFLRRYSHDTSSNEGLDIDVAIEKLLQVGESREITKTSKKKNFPFHSWEIQLICYHAREIFLNQPTLLRLQAPIKVVGDVHGQFNDLLRILKLSGVPSDTNYLFLGDYVDRGKNSLETILLLLCYKIKYKDNFFMLRGNHESANVTKMYGFYDECKRRLSSKVWKMFVDVFNTLPLAAIIQDKIFCVHGGISPDLHDMKQIEKVARPTDIPESGLVTDLLWSDPDPQVTDWSENDRGVSYTFSKRNVLDFCAKFKFDLILRGHMVVEDGYEFFARKKFVTIFSAPNYCGEFHNWGAVMSVTTGMMCSFELLKPRALKNKKKLYKTKV

SEQ ID NO: 22464 - protein, 461 aa, Saccharomyces cerevisiae
MSSSHKVESYNNENRMLCDFFYPQLGGVEFHIYHLSQKLIDLGHSVVIITHAYKDRVGVRHLTNGLKVYHVPFFVIFRETTFPTVFSTFPIIRNILLREQIQIVHSHGSASTFAHEGILHANTMGLRTVFTDHSLYGFNNLTSIWVNKLLTFTLTNIDRVICVSNTCKENMIVRTELSPDIISVIPNAVVSEDFKPRDPTGGTKRKQSRDKIVIVVIGRLFPNKGSDLLTRIIPKVCSSHEDVEFIVAGDGPKFIDFQQMIESHRLQKRVQLLGSVPHEKVRDVLCQGDIYLHASLTEAFGTILVEAASCNLLIVTTQVGGIPEVLPNEMTVYAEQTSVSDLVQATNKAINIIRSKALDTSSFHDSVSKMYDWMDVAKRTVEIYTNISSTSSADDKDWMKMVANLYKRDGIWAKHLYLLCGIVEYMLFFLLEWLYPRDEIDLAPKWPKKTVSNETKEARET

SEQ ID NO: 22465 - protein, 868 aa, Saccharomyces cerevisiae
MRNAGVQVDTNMQKISLQDTVLVNEMKGRVKFIGETQFAKGIWYGIELDKPLGKNDGSANGIRYFDIDLKKANSNGGYYGLFCKKDTLQFYKPDDDEHSLLNGNAAQETIKNLQVKCESLASKLNKIKIENHELKTSVEKLSTNETVLLSKISRLDKLVKELKVENGNMKTHLDNFNHLLDASDSVMAPDLDKGTLLERSHLLQGLLDQTKLSYDKAMKVQEDLLEENTQLLEENAVLSKKISDLGLQLQQTNNTIGDLALQIEAQSKSSNIVDKLTNDNILLTSNIKALNNELEELQAKEKLDENLRITYEQLEQELRLQLSNLQSALENEKEIAGTYIEENSRLKATLESIEAKTSHKFQSLELKVNTLQEELYQNKLLKKFYQIYEPFAQPHLAALSSQLQYLAEVIESENFGKLENIEIHIILKVLSSISYALHIYTIKNTPDHLETTLQCFKVNIAPISMWLSEFLQRKFSSKQETAFSICQFLEDNKFLDKDVTLILKILHPILETTVPKLLAFLRTNSNFNDNDTLCLIGSLYERSLSLIARIDKLIGKEEISKQDNRLFLYPSCDITLSSILTILFSDALFLRQDYKRISSLKKLEVFFQGIESLLENITIFPEQPSQQTSDSESQCNIKEGNFSNSLLSDRLNEENIRLKEVLVQKENMLTELETKIKIIIGRDLERKTLEENIKTLKVELNNKNEENCGKTEILNKLKEENFNLVNRLKNMELKLYQIKDNNTLNKIYLDREKVDRVNLVSEIMELRETIRRQIKEQKRVSIDFSWLDELPAVENKQPFKEHINHSLDTLGIEMFNFVSTSRILDLKLDQPLAEDELWHERDHSYISYLKRKRKNIRLKSQNVVTYYK

SEQ ID NO: 22466 - protein, 1504 aa, Saccharomyces cerevisiae
MSRESNDTIQSDTVRSSSKSDYFRIQLNNQDYYMSKPTFLDPSHGESLPLNQFSQVPNIRVFGALPTGHQVLCHVHGILPYMFIKYDGQITDTSTLRHQRCAQVHKTLEVKIRASFKRKKDDKHDLAGDKLGNLNFVADVSVVKGIPFYGYHVGWNLFYKISLLNPSCLSRISELIRDGKIFGKKFEIYESHIPYLLQWTADFNLFGCSWINVDRCYFRSPVLNSILDIDKLTINDDLQLLLDRFCDFKCNVLSRRDFPRVGNGLIEIDILPQFIKNREKLQHRDIHHDFLEKLGDISDIPVKPYVSSARDMINELTMQREELSLKEYKEPPETKRHVSGHQWQSSGEFEAFYKKAQHKTSTFDGQIPNFENFIDKNQKFSAINTPYEALPQLWPRLPQIEINNNSMQDKKNDDQVNASFTEYEICGVDNENEGVKGSNIKSRSYSWLPESIASPKDSTILLDHQTKYHNTINFSMDCAMTQNMASKRKLRSSVSANKTSLLSRKRKKVMAAGLRYGKRAFVYGEPPFGYQDILNKLEDEGFPKIDYKDPFFSNPVDLENKPYAYAGKRFEISSTHVSTRIPVQFGGETVSVYNKPTFDMFSSWKYALKPPTYDAVQKWYNKVPSMGNKKTESQISMHTPHSKFLYKFASDVSGKQKRKKSSVHDSLTHLTLEIHANTRSDKIPDPAIDEVSMIIWCLEEETFPLDLDIAYEGIMIVHKASEDSTFPTKIQHCINEIPVMFYESEFEMFEALTDLVLLLDPDILSGFEIHNFSWGYIIERCQKIHQFDIVRELARVKCQIKTKLSDTWGYAHSSGIMITGRHMINIWRALRSDVNLTQYTIESAAFNILHKRLPHFSFESLTNMWNAKKSTTELKTVLNYWLSRAQINIQLLRKQDYIARNIEQARLIGIDFHSVYYRGSQFKVESFLIRICKSESFILLSPGKKDVRKQKALECVPLVMEPESAFYKSPLIVLDFQSLYPSIMIGYNYCYSTMIGRVREINLTENNLGVSKFSLPRNILALLKNDVTIAPNGVVYAKTSVRKSTLSKMLTDILDVRVMIKKTMNEIGDDNTTLKRLLNNKQLALKLLANVTYGYTSASFSGRMPCSDLADSIVQTGRETLEKAIDIIEKDETWNAKVVYGDTDSLFVYLPGKTAIEAFSIGHAMAERVTQNNPKPIFLKFEKVYHPSILISKKRYVGFSYESPSQTLPIFDAKGIETVRRDGIPAQQKIIEKCIRLLFQTKDLSKIKKYLQNEFFKIQIGKVSAQDFCFAKEVKLGAYKSEKTAPAGAVVVKRRINEDHRAEPQYKERIPYLVVKGKQGQLLRERCVSPEEFLEGENLELDSEYYINKILIPPLDRLFNLIGINVGNWAQEIVKSKRASTTTTKVENITRVGTSATCCNCGEELTKICSLQLCDDCLEKRSTTTLSFLIKKLKRQKEYQTLKTVCRTCSYRYTSDAGIENDHIASKCNSYDCPVFYSRVKAERYLRDNQSVQREEALISLNDW

SEQ ID NO: 22467 - protein, 715 aa, Saccharomyces cerevisiae
MSQHIRKLDSDVSERLKSQACTVSLASAVREIVQNSVDAHATTIDVMIDLPNLSFAVYDDGIGLTRSDLNILATQNYTSKIRKMNDLVTMKTYGYRGDALYSISNVSNLFVCSKKKDYNSAWMRKFPSKSVMLSENTILPIDPFWKICPWSRTKSGTVVIVEDMLYNLPVRRRILKEEPPFKTFNTIKADMLQILVMHPMISLNVQYTDKLRINTEVLFRSKNITEGLTKHQQMSQVLRNVFGAIIPPDMLKKVSLKFNEYQIEGIISKMPVGLKDLQFIYINGRRYADSAFQGYVDSLFQAQDFGEKGMSLLKTKSVGKPYRSHPVFILDVRCPQTIDDLLQDPAKKIVKPSHIRTIEPLIVKTIRSFLTFQGYLTPDKSDSSFEIVNCSQKTATLPDSRIQISKRNQVLNSKMKIARINSYIGKPAVNGCRINNSTINYEKIKNIRIDGQKSRLRNKLSSRPYDSGFTEDYDSIGKTITDFSISRSVLAKYEVINQVDKKFILIRCLDQSIHNCPLLVLVDQHACDERIRLEELFYSLLTEVVTGTFVARDLKDCCIEVDRTEADLFKHYQSEFKKWGIGYETIEGTMETSLLEIKTLPEMLTSKYNGDKDYLKMVLLQHAHDLKDFKKLPMDLSHFENYTSVDKLYWWKYSSCVPTVFHEILNSKACRSAVMFGDELTRQECIILISKLSRCHNPFECAHGRPSMVPIAELK

SEQ ID NO: 22468 - protein, 633 aa, Saccharomyces cerevisiae
MDYEEILFGLQPILNASSIKDVPMNDVYLGSYLAVMDQLAVSLREPSNRDIVGKTGLLLNLVRVLEQALDICFHDTSISINDKIAFYEISSEVIRCIANAIIDNDDNREILLDSGGKKLLNYYIGGVLQLDEISSDKSEDSLVDKLQMRSVVLLRNFCIGNLKYTENLAPFIRGPLFVLLKTTQYSYLSSPEKVVLGSDLLNDILKVNYSNVQISDLFFLSQYIKKISSNVQNKELQAMEDGAVEAYSNTETQKFAGQGNQEYIEKEEEDDEEDVNCELLLNLSTCLETIVAKDETINFTNEEQLVLSMQKNLILSLVCLESKTFNNKLIVMRRLISCAGNISANLTNSNKREQSLCIETIKSSASSYALAAALMILCNSVASKSDAVALLKLISLSELIQVGSLLQDPLQYQGFLDLLRKLLNLENTMWLDIKDLFTLFQIMRRCHEQTKYYNNLRSLLTNLLNKTLTVLPSSKIHNSISSDPTIISFIAEHGTLTSCIAMDKLLVSKKALPKEAITSLWDSIFKFQNLGQAEQLSISDLFHITKTVGIYLKDSSVTADVNPIENILFKDYIQKLTLILETILSFKENKDKGSESCFNNGKFIAGIILNIVKNTKCLTPEEQNLEALAKSFF

SEQ ID NO: 22469 - protein, 706 aa, Saccharomyces cerevisiae
MIQKMSPSLRRPSTRSSSGSSNIPQSPSVRSTSSFSNLTRNSIRSTSNSGSQSISASSTRSNSPLRSVSAKSDPFLHPGRIRIRRSDSINNNSRKNDTYTGSITVTIRPKPRSVGTSRDHVGLKSPRYSQPRSNSHHGSNTFVRDPWFITNDKTIVHEEIGEFKFDHVFASHCTNLEVYERTSKPMIDKLLMGFNATIFAYGMTGSGKTFTMSGNEQELGLIPLSVSYLFTNIMEQSMNGDKKFDVIISYLEIYNERIYDLLESGLEESGSRISTPSRLYMSKSNSNGLGVELKIRDDSQYGVKVIGLTERRCESSEELLRWIAVGDKSRKIGETDYNARSSRSHAIVLIRLTSTNVKNGTSRSSTLSLCDLAGSERATGQQERRKEGSFINKSLLALGTVISKLSADKMNSVGSNIPSPSASGSSSSSGNATNNGTSPSNHIPYRDSKLTRLLQPALSGDSIVTTICTVDTRNDAAAETMNTLRFASRAKNVALHVSKKSIISNGNNDGDKDRTIELLRRQLEEQRRMISELKNRSNIGEPLTKSSNESTYKDIKATGNDGDPNLALMRAENRVLKYKLENCEKLLDKDVVDLQDSEIMEIVEMLPFEVGTLLETKFQGLESQIRQYRKYTQKLEDKIMALEKSGHTAMSLTGCDGTEVIELQKMLERKDKMIEALQSAKRLRDRALKPLINTQQSPHPVVDNDK

SEQ ID NO: 22470 - protein, 405 aa, Saccharomyces cerevisiae
MFSLKALLPLALLLVSANQVAAKVHKAKIYKHELSDEMKEVTFEQHLAHLGQKYLTQFEKANPEVVFSREHPFFTEGGHDVPLTNYLNAQYYTDITLGTPPQNFKVILDTGSSNLWVPSNECGSLACFLHSKYDHEASSSYKANGTEFAIQYGTGSLEGYISQDTLSIGDLTIPKQDFAEATSEPGLTFAFGKFDGILGLGYDTISVDKVVPPFYNAIQQDLLDEKRFAFYLGDTSKDTENGGEATFGGIDESKFKGDITWLPVRRKAYWEVKFEGIGLGDEYAELESHGAAIDTGTSLITLPSGLAEMINAEIGAKKGWTGQYTLDCNTRDNLPDLIFNFNGYNFTIGPYDYTLEVSGSCISAITPMDFPEPVGPLAIVGDAFLRKYYSIYDLGNNAVGLAKAI

SEQ ID NO: 22471 - protein, 506 aa, Saccharomyces cerevisiae [sequence omitted]

SEQ ID NO: 22472 - protein, 310 aa, Saccharomyces cerevisiae
MTSIDNRPLPFIYQFTAGAIAGVSELLVMYPLDVVKTRMQLQVTTKGHPAVVAAKAAVDHYTGVMDCLTKIVKKEGFSHLYKGITSPILMEAPKRAIKFSGNDTFQTFYKKIFPTPNGEMTQKIAIYSGASAGAVEAFVVAPFELVKIRLQDVNSQFKTPIEVVKNSVVKGGVLSLFNGLEATIWRHVLWNAGYFGIIFQIRKLLPAAKTSTEKTRNDLIAGAIGGTVGCLLNTPFDVVKSRIQRSSGPLRKYNWSLPSVLLVYREEGFKALYKGFAPKVMRLAPGGGLLLVVFTNVMDFFREVKYGKKQ

SEQ ID NO: 22473 - protein, 896 aa, Saccharomyces cerevisiae
MTQSLGIEQYKLSVVSGGKPALNNLSSVTGNKNIARLSQDQRNYIIPFNNQIKVYSVETRQCVKTLKFANNSLLSGIFLQEEENNESIVKILLGDITVPQQEDAHLITVFTNNGHVIVLNYKGKLVESPKHFKISLADEKLANVFHSEGNYRILTTFKDPSQKAHNSLQSYRLYALTFDDAKKQFEVAHQAEWHNVILSNISSNGKLLAHMCKDVSTKDHEHKSISVVSLFDDSVNLSFPLGSILSSQTQSLSYNTRYVSSMAIDNMGQQLAVGFASGVISIVSLADLQIRLLKWHIDSVLSLSFSHDGSYLLSGGWEKVMSLWQLETNSQQFLPRLNGIIIDCQVLGPQGNYYSLILQMTENNSNSDYQFLLLNASDLTSKLSINGPLPVFNSTIKHIQQPISAMNTKNSNSITSLNHSKKKQSRKLIKSRRQDFTTNVEINPINKNLYFPHISAVQIFDFYKNEQVNYQYLTSGVNNSMGKVRFELNLQDPIITDLKFTKDGQWMITYEIEYPPNDLLSSKDLTHILKFWTKNDNETNWNLKTKVINPHGISVPITKILPSPRSVNNSQGCLTADNNGGLKFWSFDSHESNWCLKKISLPNFNHFSNSVSLAWSQDGSLIFHGFDDKLQILDFDTFKKFESLENTKTVSEFTLDSEIQTVKLINDTNLIVATRTTLNAINLLRGQVINSFDLYPFVNGVYKNGHMDRLITCDERTGNIALVINQQLTDLDGVPTINYKSRIIIFDSDLSTKLGNFTHHEYISWIGWNYDTDFIFLDIESTLGVVGTTVNTQLSDEVNNEGILDGLVSNTITTSASNSDIFAEQLHKLSSRGKKSDTRDKNTNDNDEDEEDIALEFINGEKKDKLVNMNSFTSMFDNIQNVQMDTFFDRVMKVLT

SEQ ID NO: 22474 - protein, 1032 aa, Saccharomyces cerevisiae
MASSLNELNLVQVLEQASNPQHIRSDVQKLAEQQLRQWETQAGFHYLLQSIYLNLSNSLQIRWLAVIQFKNGVDKYWRSTRINAIPKDEKASIRGRLFEMIDEQNNQLCIQNAQASARIARLDFPVEWPTLFEDLENLLNDEIIRKDSVKIYNILMHINQIVKVLGTARIGRCRPAMQSKVPLILPLIVRIYLQSFEEWTTSSNLNYEDLSSLQVSYLALKVLRRIICEGYDRPQTDQSVCDFIKLSVSHFEMLISNHENFKKFDIYEKFIKCLGKLYFNLVTGSPANFILLPCSTQILITYTRLIFDKAPKVYRENSDVTGDFWEQTAIRGLLILKRVINFIHKKGAITLKARSDKLTIDASINKINTEFLNENLITRLVDTLMEWYLRLRPTELENWFMDPEEWINEQMATSYEYQIRPCAENVFQDLMNTFSELLVPYLLKKIENDASKLSNSLDDFLRKDAIYASFQLSASAVSEMVDFDRLLIQVFLPEATNTNISGDELRIIRRRVALIINEWSTVKCSEESKSLCYKLFTNFLTDEDDKVVLLTTVQTVRTMVDDWNFNKDTFQPFLTENVHLLLRKILPSVSLTETRLYVLNTLSDIIIQTKPLISRDLLVEILQIIPNLWEIATNNASEAILANALLRLLRNLVSSLGSQSHLTWDIAIPVVALACDPSSMQYQLLSEDGYELWGMLLQNFSSHDQEFDDKFVELVPFLKYGIETHTEILPTLLEIIKSYALILNPVDFFSNNTFQDIFKQMSKYLLKLREDSFQLVLEIWEILILSNESDYENLLLQKFYETGVLSALFDAIFLEEAPSSYLCSQIIQIIARISYVNPDALMTFLATYHDNLPTSNENARMPESIRKIVSKDQTYDSVVNKLLTGWIVCFRDIFDPKFKKVHILGISSLLRTGLVPILTEFSSIASLWIEMLEEINETNRGDCEKYHLNDIVTEQSIAFHPLTAEQLRYHQLCKNNDPVHNISLKDFISQSMEYLESHLGVERYQEFLKTINPSLLENLQMFLSIQPQEARP

SEQ ID NO: 22475 - protein, 253 aa, Saccharomyces cerevisiae [sequence omitted]

SEQ ID NO: 22476 - protein, 434 aa, Saccharomyces cerevisiae
MLLKNLHSLLQLPIFSNGADKGIEPNCPINIPLSCSNKTDIDNSCCFEYPGGIFLQTQFWNYFPSKNDLNETELVKELGPLDSFTIHGLWPDNCHGGYQQFCNRSLQIDDVYYLLHDKKFNNNDTSLQISGEKLLEYLDLYWKSNNGNHESLWIHEFNKHGTCISTIRPECYTEWGANSVDRKRAVYDYFRITYNLFKKLDTFSTLEKNNIVPSVDNSYSLEQIEAALSKEFEGKKVFIGCDRHNSLNEVWYYNHLKGSLLSEMFVPMDSLAIRTNCKKDGIKFFPKGYVPTFRRRPNKGARYRGVVRLSNINNGDQMQGFLIKNGHWMSQGTPANYELIKSPYGNYYLRTNQGFCDIISSSSNELVCKFRNIKDAGQFDFDPTKGGDGYIGYSGNYNWGGDTYPRRRNQSPIFSVDDEQNSKKYKFKLKFIKN

SEQ ID NO: 22477 - protein, 513 aa, Saccharomyces cerevisiae
MSDYSLKHSVTQYLEEIPQQVQNRLYTSPATCLAIYRILPPLAKFFIMAMVFNENEVPLLDLDKWVNSNGKLQFQNAIKSMKSLHLLIPNKSSGTLMINLNPTFKISLRNALTGGEVQNSFGVVVEENVVSLDLLDEYSANKWETILHFMVGTPLAKIPSEKVLNLLKHSKLMEEVNSTGEFKITNEGFQFLLQEINSQLWTLLLQYLKMIETSKMDLVDVLHFIFMLGALEVGKAYKIDALSETQRIMLQDMRDYGLVFQKHSNDSIFYPTKLALMLTSDTKTIRSASNAMDSVLRQNREEPSVNEDGANGKSTTDITTSDDLNKAGLKNQDIPDGSLIVETNFKIYSYSNSPLQIAVLSLFVHLKARFVNMVLGQITRESIRRALTNGITADQIIAYLETHAHPQMRRLAEEKLEKKLELDPNCKEPLQVLPPTVVDQIRLWQLELDRVITYEGSLYSDFETSQEYNLLSKYAQDIGVLLWKDDKKKKFFISKEGNSQVLDFAKRKLKKKQ

SEQ ID NO: 22478 - protein, 222 aa, Saccharomyces cerevisiae
MHNQEEWLDKDKTLVNEEENTCINHSYTKKDTNNYRVGKSGIKDLKKPTNQKEIAIKNRELTKQLTLLRQENNHLQQACKILSENKIIENRKSIEKWRTICEMELSFILNSTLIKINRMGGYKDFLEKEMEAKKRRLEYQIDNGMEDQICEIKESDDFRQLSEVEKQEWESQMNEQLKELEKKKIAELEKLNKVLHDSEGKDFGMAELCTRLKLDYSLIFPQ

SEQ ID NO: 22479 - protein, 557 aa, Saccharomyces cerevisiae
MKCQTCHLPLQLDPSLEGLSLTQRNLLLSNNSIITATNENVISNKGIEAADNCGPQIPKERLRRLGEIQNIKDLNLKDDKLITDSFVFLNHDDDDNANITSNSREDQRYGNANGNDNKKANSDTSDGTSTFRDHDEEEQEATDEDENQQIQLNSKTLSTQVNAMTNVFNILSSQTNIDFPICQDCCNILINRLKSEYDDAIKERDTYAQFLSKLESQNKEISESNKEKQYSHNLSEKENLKKEEERLLDQLLRLEMTDDDLDGELVRLQEKKVQLENEKLQKLSDQNLMDLNNIQFNKNLQSLKLQYELSLNQLDKLRKINIFNATFKISHSGPFATINGLRLGSIPESVVPWKEINAALGQLILLLATINKNLKINLVDYELQPMGSFSKIKKRMVNSVEYNNSTTNAPGDWLILPVYYDENFNLGRIFRKETKFDKSLETTLEIISEITRQLSTIASSYSSQTLTTSQDESSMNNANDVENSTSILELPYIMNKDKINGLSVKLHGSSPNLEWTTAMKFLLTNVKWLLAFSSNLLSKSITLSPTVNYNDKTISGN

SEQ ID NO: 22480 - protein, 617 aa, Saccharomyces cerevisiae
MADLPQKVSNLSINNKENGGGGGKSSYVPPHLRSRGKPSFERSTPKQEDKVTGGDFFRRAGRQTGNNGGFFGFSKERNGGTSANYNRGGSSNYKSSGNRWVNGKHIPGPKNAKLEAELFGVHDDPDYHSSGIKFDNYDNIPVDASGKDVPEPILDFSSPPLDELLMENIKLASFTKPTPVQKYSIPIVTKGRDLMACAQTGSGKTGGFLFPLFTELFRSGPSPVPEKAQSFYSRKGYPSALVLAPTRELATQIFEEARKFTYRSWVRPCVVYGGAPIGNQMREVDRGCDLLVATPGRLNDLLERGKVSLANIKYLVLDEADRMLDMGFEPQIRHIVEECDMPSVENRQTLMFSATFPVDIQHLARDFLDNYIFLSVGRVGSTSENITQRILYVDDMDKKSALLDLLSAEHKGLTLIFVETKRMADQLTDFLIMQNFKATAIHGDRTQAERERALSAFKANVADILVATAVAARGLDIPNVTHVINYDLPSDIDDYVHRIGRTGRAGNTGVATSFFNSNNQNIVKGLMEILNEANQEVPTFLSDLSRQNSRGGRTRGGGGFFNSRNNGSRDYRKHGGNGSFGSTRPRNTGTSNWGSIGGGFRNDNEKNGYGNSNASWW

SEQ ID NO: 22481 - protein, 344 aa, Saccharomyces cerevisiae
MTLAELLGRSRIAQVANNHKPLTYTGKKFHPTHQIIETKPSTLYRQEWGLKSAIPSKIKSRYLVYNDLDTLERITTFEPRGGTQWNRLRFQEMGVPIVSNIGRQNPFFKYISRPEDESHAKLSLFKEMKGDTDISPAAMKKRLKKITALIRSFQDEFKEWLVENHPDELKLNSNKLEDYVVKFLNKKLETKTNKKFNTEIIGTGGLSYSLPGKLKNSPNGVIQRTVVPGRILNVVKENNDNKWLAAIGGFVADVVFFQSPPSSFNSMGDFIRMKTFLFEILEASMEKNGSVSMHARLLEPQNDKTREFFNKRPIYKPLTSRRARRPSVGNIQEANNLLNIIKGN

SEQ ID NO: 22482 - protein, 288 aa, Saccharomyces cerevisiae
MTADNNSMPHGAVSSYAKLVQNQTPEDILEEFPEIIPLQQRPNTRSSETSNDESGETCFSGHDEEQIKLMNENCIVLDWDDNAIGAGTKKVCHLMENIEKGLLHRAFSVFIFNEQGELLLQQRATEKITFPDLWTNTCCSHPLCIDDELGLKGKLDDKIKGAITAAVRKLDHELGIPEDETKTRGKFHFLNRIHYMAPSNEPWGEHEIDYILFYKINAKENLTVNPNVNEVRDFKWVSPNDLKTMFADPSYKFTPWFKIICENYLFNWWEQLDDLSEVENDRQIHRML

SEQ ID NO: 22483 - protein, 697 aa, Saccharomyces cerevisiae
MSSKHSDPLERFYKQFQAFVQNNPNVISAARAAAQIPESAKAVVVLSPYSLQHVFPREWVTKSYRKTIVERPERLLASSMGISAAITMYPSLFTLKSSHQRKGSLMAPHVLKVHGSSWPAELIELCQMADAKLLKGEIEVPDTWNSGDIYLSSKTIKALQGTIGAIETGVDSIFKGPSAEHISNRAFVAIRPPGHHCHYGTPSGFCLLNNAHVAIEYAYDTYNVTHVVVLDFDLHHGDGTQDICWKRAGFKPEEEPEDSSYDDFGKKFAEFPKVGYFSMHDINSFPTESGFATKENIKNASTCIMNSHDLNIWNIHLSKWTTEEEFNVLYRTKYRTLFAKADEFFRSAKLEMNQQGRPFKGLVVISAGFDASEFEQTSMQRHSVNVPTSFYTTFTKDALKLAQMHCHGKVLSLMEGGYSDKAICSGVFAHLIGLQNQDWVKEWGSEQVVKEIVRGCKPAWKPYKTKRAKDVIRIWAEEVIRLGRAMIPEFDDIIFKDAVNSAPSNSLLKATVEPASTSTIAQRIIRSHRSNASPEKELHENKPRSTEKQEQREIRSDTKVKQLSSNNRAAETQIPFLQQEFSSEDEDEEYVYDEELNKTFNRTVEDITIDDISRHLETLEIEKKGDEDSDHELKEKNWKNSHQRRLQGNGMYKIPSNTKPHRIRQPQNANTPTYDDSDISMISHVSRKHTTRSGGRW

SEQ ID NO: 22484 - protein, 1128 aa, Saccharomyces cerevisiae
MTDNLTTTHGGSTTLELLAQYNDHRSKKDKSIEHIEKGTCSGKERNPSYDEIFTENIKLKLQVQEYETEIESLEKVIDMLQKNREASLEVVLEQVQNDSRDSYVNDQSFVLPPRSAERKAHIKSLNLPIPTLSPPLQQGSDVALETSVTPTVPQIGVTSNTSISRKHLQNMILNDEIEANSSFSSPKIINRSVSSPTKIHSEQLASPAASVTYTTSRITIKSPNKGSKSPLQERLRSPQNPNRMTAVINNHLHSPLKASTSNNLDELTESKSQQLTNDAIQKNDRVYSSITSSAYTTGTPTSAAKSPSSLLEVKEGENKALGFSPASKEKLDDFTQLLDSSFGEEDLVNTDSKDPLSIKSTINESLPPPPAPPTFFSPTSSGNIKNSTPLSSHLASPVILNKKDDNFGAQSAKNLKKPVLTSSLPNLSTKLSTTSQNASLPPNPPVESSSKQKQLGETASIHSTNTLNTFSSTPQGSLKTLRRPHASSVSTVKSVAQSLKSDIPLFVQPEDFGTIQIEVLSTLYRDNEDDLSILIAIIDRKSGKEMFKFSKSIHKVRELDVYMKSHVPDLPLPTLPDRQLFQTLSPTKVDTRKNILNQYYTSIFSVPEFPKNVGLKIAQFISTDTVMTPPMMDDNVKDGSLLLRRPKTLTGNSTWRVRYGILRDDVLQLFDKNQLTETIKLRQSSIELIPNLPEDRFGTRNGFLITEHKKSGLSTSTKYYICTETSKERELWLSAFSDYIDPSQSLSLSSSRNANDTDSASHLSAGTHHSKFGNATISATDTPSYVTDLTQEYNNNNNISNSSNNIANSDGIDSNPSSHSNFLASSSGNAEEEKDSRRAKMRSLFPFKKLTGPASAMNHIGITISNDSDSPTSPDSIIKSPSKKLMEVSSSSNSSTGPHVSTAIFGSSLETCLRLSSHKYQNVYDLPSVVYRCLEYLYKNRGIQEEGIFRLSGSSTVIKTLQERFDKEYDVDLCRYNESIEAKDDEASPSLYIGVNTVSGLLKLYLRKLPHLLFGDEQFLSFKRVVDENHNNPVQISLGFKELIESGLVPHANLSLMYALFELLVRINENSKFNKMNLRNLCIVFSPTLNIPISMLQPFITDFACIFQGGEPVKEEEREKVDIHIPQV

SEQ ID NO: 22485 - protein, 396 aa, Saccharomyces cerevisiae
MITSIDIADVTYSAKPRILVPYKTQWEVASHLPEYRKLAERVEFYKYEMSTKDDFVKFLETHRINGFWLTEEFFTVLGNPSSYIEFFPASLKVILVPWVGCDFIDGKLLRSKGITLCNIGPHAADHVTELAIFLAISCFRMTSFWEYCFKYVENGNVEQCKKYISSDSYEIVTDSYHGQEMKFPSRTDKCKPNKDRKVVHLAEKYTVGGKKMESPMNKKVLILGFGSIGQNIGSNLHKVFNMSIEYYKRTGPVQKSLLDYNAKYHSDLDDPNTWKNADLIILALPSTASTNNIINRKSLAWCKDGVRIVNVGRGTCIDEDVLLDALESGKVASCGLDVFKNEETRVKQELLRRWDVTALPHIGSTVADMVIKQTLITLENVQDIFVEGGDGKYVLN

SEQ ID NO: 22486 - protein, 394 aa, Saccharomyces cerevisiae
MSQFGTTDIVSGSETPPYSGASYQDAQDDNTHPHSSDAGAEKFSAGSGSESHTESSRSDDEDSQAKTKMVDNITILKYILDSLSGRDKLAKIIKYALDILKLFIEKSKRNLTVLDPSVLTYYTKILKNLTVKVALRHPITVIKVLLLSLLRNFDKKIDFISQQLSTFRYILRFGGTPFRVCSFLGKFNKTRKCNFQIDQIKKIWFNEASLREFLDLYYGIFDELDLLYKLKIWTNKSFYSFVSRQESLAWQYDILLSLKDHWLNLQSLQKRQLELEVQLKVQNNALLLSPILMHQAHKDDGSQSPIRKQLLNDLNVNNDAEVLIHKQLKAIKDEKTLVYLDIARLSFDCMANTSDILNLKTPKGTYAVLSLGSGLTGLVKLWITTKRSLCSSKD

SEQ ID NO: 22487 - protein, 333 aa, Saccharomyces cerevisiae
METGPHYNYYKNRELSIVLAPFSGGQGKLGVEKGPKYMLKHGLQTSIEDLGWSTELEPSMDEAQFVGKLKMEKDSTTGGSSVMIDGVKAKRADLVGEATKLVYNSVSKVVQANRFPLTLGGDHSIAIGTVSAVLDKYPDAGLLWIDAHADINTIESTPSGNLHGCPVSFLMGLNKDVPHCPESLKWVPGNLSPKKIAYIGLRDVDAGEKKILKDLGIAAFSMYHVDKYGINAVIEMAMKAVHPETNGEGPIMCSYDVDGVDPLYIPATGTPVRGGLTLREGLFLVERLAESGNLIALDVVECNPDLAIHDIHVSNTISAGCAIARCALGETLL

SEQ ID NO: 22488 - protein, 1223 aa, Saccharomyces cerevisiae
MKFGKTFANHRIPEWSSQYVGYKSLKKMIKEITRLQEDIYRAHNKNSYDEGRPPTKMRDSSNSAQNYLDSPKIQKLLASFFFAVDRDIEKVDTFYNSQYAEYKKRFERLLSSNQFNEIKSTLVVDANKEDAVAQTLLTKDTREMNMLLKGTSQASRLSYHKDDLIEIQSILAELRKQFRNLKWYAELNKRAFGKILKKLDKKVGTNQQMSTMKTRILPLQFANDSLITKDLSLLKTIWEQVTFRINSYERVMRSTSPNANANDNTEFFKIICVFIEEDDSKGLIRELTNLYSELSLIPTRIMISVLNKAALSKSLACIDAILKVIPSLNDSEDINRRNFFHHHIIAIGKLIRKQEILSRKKKSQPSKYTNSEGEIVTDLRTLHTTLSAPAESDSITEEEKSSACTLSYILEELPIHLRPCLFQHDNYKRTPLHYSCQYGLSEVTKLIIKLMKEWNIWNEIPIDDVSAFGDAESLTPLHLCVLGAHPKTTEVLLQSLDPNVKLKSSSLLHLATEWNNYPLLHVLLSSKRFDINYQDNELHETPLYLACRLNFFEAAVCLLYNGADLEIREKLFGWTAIFVAAAEGFTDIVKLLIANNANFDIEDEGGWTPMEHAVLRGHLHIADMVQIRDELVTHPHSQLNSGSEEKEPLNEISAGELNERNENGNGGNKGSLGKLAGPIKSYGHRFLDNNESLILITLGSNDTRNKSPSISLSSEALAKVIGLETDCALSLVISCNDSIDKSSVILDLPLDDNVDAVDFKVPFKVDYSHTLYFDIVPTYGTRSLETHNRIDCQKNNNNYVMARGVSMLNKSYSSVGVNRSILNGSVTVPIIANHTLEILGTLKFEYIIITPFEHPQLPLERTETYWKSLVSTRVIGHRGLGKNNPNKSLQIGENTVESFIMAASLGASYVEFDVQLTKDNVPVVYHDFLVAETGVDIPMHELTLEQFLDLNNADKEHIQRGAGHSPHHVNGADTALQKYRGRSVDDSDVSTLRRAWDLHDNDPNGKSNNAHWSDNRMRLTKTFKKNNFKGNARGHSIASSFVTLKELFKKIPANVGFNIECKFPMLDEAEEEELGQIMMEMNHWVDTVLKVVFDNANGRDIIFSSFHPDICIMLSLKQPVIPILFLTEGGSEQMADLRASSLQNGIRFAKKWNLLGIVSAAAPILKAPRLVQVVKSNGLVCVTYGVDNNDPENASIQIEAGVDAVIVDSVLAIRRGLTKKNEK

SEQ ID NO: 22489 - protein, 543 aa, Saccharomyces cerevisiae
MGLYVSSENELQEKLKSFRSAKITESRNKLIRYLRIFWFGFNDNIVEPVCTILRFLEISAIFLPLLLLYPISWFGHKLKITDTNITETRGSLIWCQLLRKALELAGPSFIKLGQWAGSRTDIFSHALCHELGKLHSNVTAHSLSFTLEKLSQALKVDKIEDAFDEFNRTPIGVGSIAQVYVGELSQKYIDKYDNIQIGKDGNRWCAIKILHPNVRSQIRRDLKIMKFCADAINWIPTMEWLSLPSEVDQFSILMNIQLDLRIEALNLERFNENFKNSIQVKFPKPFLPLSNRDVMFEEHVYGLSMEKFLSTKKQINDVELCKKVSDPFVDAFLQMLILDDFVHADLHPGNVIIRFVKTNKYGTNIISSELESYRITHDLRKKIEEDQDQDFVGKLKSVLTNYTPQICFIDTGIITELNEKNRINFIALFNALARFDGYRAGELMIERSRTPETAIDKEVFAFKVEKLVDKVKQRTFTLGTVSIGDLLDQMLSMVRSHHVRMESDFVSVVVAILLLEGIGRQLDPNLDLFERFVFYAWINGFKE

SEQ ID NO: 22490 - protein, 693 aa, Saccharomyces cerevisiae
MSTPFGLDLGNNNSVLAVARNRGIDIVVNEVSNRSTPSVVGFGPKNRYLGETGKNKQTSNIKNTVANLKRIIGLDYHHPDFEQESKHFTSKLVELDDKKTGAEVRFAGEKHVFSATQLAAMFIDKVKDTVKQDTKANITDVCIAVPPWYTEEQRYNIADAARIAGLNPVRIVNDVTAAGVSYGIFKTDLPEGEEKPRIVAFVDIGHSSYTCSIMAFKKGQLKVLGTACDKHFGGRDFDLAITEHFADEFKTKYKIDIRENPKAYNRILTAAEKLKKVLSANTNAPFSVESVMNDVDVSSQLSREELEELVKPLLERVTEPVTKALAQAKLSAEEVDFVEIIGGTTRIPTLKQSISEAFGKPLSTTLNQDEAIAKGAAFICAIHSPTLRVRPFKFEDIHPYSVSYSWDKQVEDEDHMEVFPAGSSFPSTKLITLNRTGDFSMAASYTDITQLPPNTPEQIANWEITGVQLPEGQDSVPVKLKLRCDPSGLHTIEEAYTIEDIEVEEPIPLPEDAPEDAEQEFKKVTKTVKKDDLTIVAHTFGLDAKKLNELIEKENEMLAQDKLVAETEDRKNTLEEYIYTLRGKLEEEYAPFASDAEKTKLQGMLNKAEEWLYDEGFDSIKAKYIAKYEELASLGNIIRGRYLAKEEEKKQAIRSKQEASQMAAMAEKLAAQRKAEAEKKEEKKDTEGDVDMD

SEQ ID NO: 22491 - protein, 483 aa, Saccharomyces cerevisiae
MLSATKQTFRSLQIRTMSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 22492 - protein, 244 aa, Saccharomyces cerevisiae
MSMSMGVRGLALRSVSKTLFSQGVRCPSMVIGARYMSSTPEKQTDPKAKANSIINAIPGNNILTKTGVLGTSAAAVIYAISNELYVINDESILLLTFLGFTGLVAKYLAPAYKDFADARMKKVSDVLNASRNKHVEAVKDRIDSVSQLQNVAETTKVLFDVSKETVELESEAFELKQKVELAHEAKAVLDSWVRYEASLRQLEQRQLAKSVISRVQSELGNPKFQEKVLQQSISEIEQLLSKLK

SEQ ID NO: 22493 - protein, 499 aa, Saccharomyces cerevisiae
MSWIKNVTESPTSLIKKVSCGLIIAASLYAIAPSLSALVFGDSKQSIGKYTTVGLINRGNDCFITSSLQGLAGIPRFVEYLKRIRTVLLELETKLSNNAKGDNPTVDNTTRHSRLENSSNSLAPLHESLTSLILDLISVKDRKTSISPKIVINTLESIFKSKISSKQNDAHEFTLILLQTLQEERSKLIDYSKQICNLNIPKFPFEGETSKFLVCLKCKGLSEPSYKQTFIRELSVPQQTSENLSNILAHDETEIIDDYSCLICQIRAILNHEEYRNFKDCTPDEILMLDRLKNYATKAPINENLPFEVEQYVKRYSKGNLQVSNIKGKVIKKDVVVQLPDILIVHLSRSTFNGITYSRNPCNVKFGERITLSEYTLAESGTITENRQVKYNLKSVVKHTGSHSSGHYMCYRRKTEIRFGKEDESSFRRAPVVNNEVNKNREQNVAHNDYKKSRYKKVKNALRYPYWQISDTAIKESTASTVLNEQKYAYMLYYERVNK

SEQ ID NO: 22494 - protein, 335 aa, Saccharomyces cerevisiae [sequence omitted]

SEQ ID NO: 22495 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 22496 - protein, 1511 aa, Saccharomyces cerevisiae
MSSTDEHIEKDISSRSNHDDDYANSVQSYAASEGQVDNEDLAATSQLSRHLSNILSNEEGIERLESMARVISHKTKKEMDSFEINDLDFDLRSLLHYLRSRQLEQGIEPGDSGIAFKNLTAVGVDASAAYGPSVEEMFRNIASIPAHLISKFTKKSDVPLRNIIQNCTGVVESGEMLFVVGRPGAGCSTFLKCLSGETSELVDVQGEFSYDGLDQSEMMSKYKGYVIYCPELDFHFPKITVKETIDFALKCKTPRVRIDKMTRKQYVDNIRDMWCTVFGLRHTYATKVGNDFVRGVSGGERKRVSLVEAQAMNASIYSWDNATRGLDASTALEFAQAIRTATNMVNNSAIVAIYQAGENIYELFDKTTVLYNGRQIYFGPADKAVGYFQRMGWVKPNRMTSAEFLTSVTVDFENRTLDIKPGYEDKVPKSSSEFEEYWLNSEDYQELLRTYDDYQSRHPVNETRDRLDVAKKQRLQQGQRENSQYVVNYWTQVYYCMIRGFQRVKGDSTYTKVYLSSFLIKALIIGSMFHKIDDKSQSTTAGAYSRGGMLFYVLLFASVTSLAEIGNSFSSRPVIVKHKSYSMYHLSAESLQEIITEFPTKFVAIVILCLITYWIPFMKYEAGAFFQYILYLLTVQQCTSFIFKFVATMSKSGVDAHAVGGLWVLMLCVYAGFVLPIGEMHHWIRWLHFINPLTYAFESLVSTEFHHREMLCSALVPSGPGYEGISIANQVCDAAGAVKGNLYVSGDSYILHQYHFAYKHAWRNWGVNIVWTFGYIVFNVILSEYLKPVEGGGDLLLYKRGHMPELGTENADARTASREEMMEALNGPNVDLEKVIAEKDVFTWNHLDYTIPYDGATRKLLSDVFGYVKPGKMTALMGESGAGKTTLLNVLAQRINMGVITGDMLVNAKPLPASFNRSCGYVAQADNHMAELSVRESLRFAAELRQQSSVPLEEKYEYVEKIITLLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGPNSETLLKYFERQSGMKCGVSENPAEYILNCIGAGATASVNSDWHDLWLASPECAAARAEVEELHRTLPGRAVNDDPELATRFAASYMTQIKCVLRRTALQFWRSPVYIRAKFFECVACALFVGLSYVGVNHSVGGAIEAFSSIFMLLLIALAMINQLHVFAYDSRELYEVREAASNTFHWSVLLLCHAAVENFWSTLCQFMCFICYYWPAQFSGRASHAGFFFFFYVLIFPLYFVTYGLWILYMSPDVPSASMINSNLFAAMLLFCGILQPREKMPAFWRRLMYNVSPFTYVVQALVTPLVHNKKVVCNPHEYNIMDPPSGKTCGEFLSTYMDNNTGYLVNPTATENCQYCPYTVQDQVVAKYNVKWDHRWRNFGFMWAYICFNIAAMLICYYVVRVKVWSLKSVLNFKKWFNGPRKERHEKDTNIFQTVPGDENKITKK

SEQ ID NO: 22497 - protein, 382 aa, Saccharomyces cerevisiae
MRKELKYLICFNILLLLSIIYYTFDLLTLCIDDTVKDAILEEDLNPDAPPKPQLIPKIIHQTYKTEDIPEHWKEGRQKCLDLHPDYKYILWTDEMAYEFIKEEYPWFLDTFENYKYPIERADAIRYFILSHYGGVYIDLDDGCERKLDPLLAFPAFLRKTSPLGVSNDVMGSVPRHPFFLKALKSLKHYDKYWFIPYMTIMGSTGPLFLSVIWKQYKRWRIPKNGTVRILQPAYYKMHSYSFFSITKGSSWHLDDAKLMKALENHILSCVVTGFIFGFFILYGEFTFYCWLCSKNFSNLTKNWKLNAIKVRFVTILNSLGLRLKLSKSTSDTASATLLARQQKRLRKDSNTNIVLLKSSRKSDVYDLEKNDSSKYSLGNNSS

SEQ ID NO: 22498 - protein, 446 aa, Saccharomyces cerevisiae
MHVLLSKKIARFLLISFVFVLALMVTINHPKTKQMSEQYVTPYLPKSLQPIAKISAEEQRRIQSEQEEAELKQSLEGEAIRNATVNAIKEKIKSYGGNETTLGFMVPSYINHRGSPPKACFVSLITERDSMTQILQSIDEVQVKFNKNFAYPWVFISQGELDGMKQEMIRQAITDSMNGDPELINIKFAEIPADEWVYPEWIDENKAAESLISLANVPDGDSRAVRYQARYFAGFFWRHPVLDEFDWYWRVDPGIKLYCDIDHDLFRWMQDEGKVFGFTLSMSEAKEANEKIWDVTKKFAKDFPKFISENNFKSFITKKDSEDFNNCEFTSNFEIGNLNFYRSPAYRKFFNYIDEEGGIFYWKWSDSIIHTIGLSMLLPKDKIHFFENIGFHYDKYNNCPLNDDIWNQYNCNCDQGNDFTFRSGSCGGHYFDIMKKDKPEGWDRLP

SEQ ID NO: 22499 - protein, 198 aa, Saccharomyces cerevisiae
MFHLVKGLYNNWNKKEQYSILILGLDNAGKTTFLETLKKEYSLAFKALEKIQPTVGQNVATIPVDSKQILKFWDVGGQESLRSMWSEYYSLCHGIIFIVDSSDRERLDECSTTLQSVVMDEEIEGVPILMLANKQDRQDRMEVQDIKEVFNKIAEHISARDSRVLPISALTGEGVKDAIEWMIVRLERNKKSRPPIYK

SEQ ID NO: 22500 - protein, 555 aa, Saccharomyces cerevisiae
MYNGKDRAQNSYQPMYQRPMQVQGQQQAQSFVGKKNTIGSVHGKAPMLMANNDVFTIGPYRARKDRMRVSVLEKYEVIGYIAAGTYGKVYKAKRQINSGTNSANGSSLNGTNAKIPQFDSTQPKSSSSMDMQANTNALRRNLLKDEGVTPGRIRTTREDVSPHYNSQKQTLIKKPLTVFYAIKKFKTEKDGVEQLHYTGISQSACREMALCRELHNKHLTTLVEIFLERKCVHMVYEYAEHDLLQIIHFHSHPEKRMIPPRMVRSIMWQLLDGVSYLHQNWVLHRDLKPANIMVTIDGCVKIGDLGLARKFHNMLQTLYTGDKVVVTIWYRAPELLLGARHYTPAVDLWSVGCIFAELIGLQPIFKGEEAKLDSKKTVPFQVNQLQRILEVLGTPDQKIWPYLEKYPEYDQITKFPKYRDNLATWYHSAGGRDKHALSLLYHLLNYDPIKRIDAFNALEHKYFTESDIPVSENVFEGLTYKYPARRIHTNDNDIMNLGSRTKNNTQASGITAGAAANALGGLGVNRRILAAAAAAAAAVSGNNASDEPSRKKNRR

SEQ ID NO: 22501 - protein, 825 aa, Saccharomyces cerevisiae
MSSSSLRVLAIGNNPNILFYTSRFQLAKNIDLYHVNDSKSCQFEIETEYYGKDRFELENHFTSIEHLTEALSSKSSEAVFDIIIMSAPSLQELSSLASKLTSIIDSNTKIFLESSGFIQLEPFVKLSMESPHVNVFSILTDLDIRQIGPNHFKHFPSTAKENTIYLGESKSSTEKYSSGVITLLTTFEKLFAKLFSNIKINLCNFSSIEFLSQQWKLAISRICFDPLLIMFEQENPSDLDQQIIAKPLISGLVTEIITVAKTMGARLNSSHDNENSLLSLWKNSYHSTNKPPALVYHFIHQTTPLNIDILLLQTILLADDFGIKTPYLEFLYSVLSQFERLNSGKSKWFIRSDEKTQILQSLQKSQKNESALQTQITSLQGQISKLRQELLMQAKQHEMETNELKEKHQVALKAQAQAQAQAQSQAQTSIEALTPTEATNQSDTNEYKATGTPNLRDIEDMALYSVNYGDSPVRSPPPVVSSQPQMNSPLSSHSQTFGENNGTNDKLLQERELQLRKKELELQERELEFQKRALQQQRFNNSNNSIPRKPSFPQLQQSANVRSNSRGMHGTNGAMSQPASAGNFVDPISSSIAAYDPQQPPSLPLQQPQQSVQVQPFHSHSIKPTSRKNRNSNMPNIGNPSSINMSDFGRPPNNSSQTRLNSMPTHSIVNQNRLRSQQSKNKLNMPHATNPNNTFNQVPAPSLNNHVPTQRQFSSSTMIEVTNNNNKVNNSSSNPDISTNSVVHNAMQFTNTNNNTSSTVDINDPKNIAPPPTTSVSAPSTPTLSSSSQMANMASPSTDNGDNEEKNGGKKKRFGLFKKKNKSKK

SEQ ID NO: 22502 - protein, 302 aa, Saccharomyces cerevisiae
MNRFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 22503 - protein, 398 aa, Saccharomyces cerevisiae
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 22504 - protein, 657 aa, Saccharomyces cerevisiae
MSIRDLYHARASPFISLEFFPPKTELGTRNLMERMHRMTALDPLFITVTWGAGGTTAEKTLTLASLAQQTLNIPVCMHLTCTNTEKAIIDDALDRCYNAGIRNILALRGDPPIGEDWLDSQSNESPFKYAVDLVRYIKQSYGDKFCVGVAAYPEGHCEGEAEGHEQDPLKDLVYLKEKVEAGADFVITQLFYDVEKFLTFEMLFRERISQDLPLFPGLMPINSYLLFHRAAKLSHASIPPAILSRFPPEIQSDDNAVKSIGVDILIELIQEIYQRTSGRIKGFHFYTLNLEKAIAQIVSQSPVLSHIVNESSEEEGEDETSGEIGSIENVPIEDADGDIVLDDSNEETVANRKRRRHSSLDSAKLIFNRAIVTEKGLRYNNENGSMPSKKALISISKGHGTLGRDATWDEFPNGRFGDSRSPAYGEIDGYGPSIKVSKSKALELWGIPKTIGDLKDIFIKYLEGSTDAIPWSDLGLSAETALIQEELIQLNYRGYLTLASQPATNATLSSDKIFGWGPAKGRLYQKAFVEMFIHRQQWETTLKPKLDHYGRRKFSYYAGDSSGSFETNLDPHSSSVVTWGVFPNSPVKQTTIIEEESFKAWRDEAFSIWSEWAKLFPRNTPANILLRLVHKDYCLVSIVHHDFKETDELWEMLLDQA

SEQ ID NO: 22505 - protein, 1100 aa, Saccharomyces cerevisiae
MSQLFYQGDSDDELQEELTRQTTQASQSSKIKNEDEPDDSNHLNEVENEDSKVLDDDAVLYPLIPNEPDDIETSKPNINDIRPVDIQLTLPLPFQQKVVENSLITEDALIIMGKGLGLLDIVANLLHVLATPTSINGQLKRALVLVLNAKPIDNVRIKEALEELSWFSNTGKDDDDTAVESDDELFERPFNVVTADSLSIEKRRKLYISGGILSITSRILIVDLLSGIVHPNRVTGMLVLNADSLRHNSNESFILEIYRSKNTWGFIKAFSEAPETFVMEFSPLRTKMKELRLKNVLLWPRFRVEVSSCLNATNKTSHNKVIEVKVSLTNSMSQIQFGLMECLKKCIAELSRKNPELALDWWNMENVLDINFIRSIDSVMVPNWHRISYESKQLVKDIRFLRHLLKMLVTSDAVDFFGEIQLSLDANKPSVSRKYSESPWLLVDEAQLVISYAKKRIFYKNEYTLEENPKWEQLIHILHDISHERMTNHLQGPTLVACSDNLTCLELAKVLNASNKKRGVRQVLLNKLKWYRKQREETKKLVKEVQSQDTFPENATLNVSSTFSKEQVTTKRRRTRGASQVAAVEKLRNAGTNVDMEVVFEDHKLSEEIKKGSGDDLDDGQEENAANDSKIFEIQEQENEILIDDGDAEFDNGELEYVGDLPQHITTHFNKDLWAEHCNEYEYVDRQDEILISTFKSLNDNCSLQEMMPSYIIMFEPDISFIRQIEVYKAIVKDLQPKVYFMYYGESIEEQSHLTAIKREKDAFTKLIRENANLSHHFETNEDLSHYKNLAERKLKLSKLRKSNTRNAGGQQGFHNLTQDVVIVDTREFNASLPGLLYRYGIRVIPCMLTVGDYVITPDICLERKSISDLIGSLQNNRLANQCKKMLKYYAYPTLLIEFDEGQSFSLEPFSERRNYKNKDISTVHPISSKLSQDEIQLKLAKLVLRFPTLKIIWSSSPLQTVNIILELKLGREQPDPSNAVILGTNKVRSDFNSTAKGLKDGDNESKFKRLLNVPGVSKIDYFNLRKKIKSFNKLQKLSWNEINELINDEDLTDRIYYFLRTEKEEQEQESTDENLESPGKTTDDNALHDHHNDVPEAPV

SEQ ID NO: 22506 - protein, 499 aa, Saccharomyces cerevisiae
MGGEDEILSTMEDFAAVYDVLVIGCGPGGFTAAMQASQAGLLTACVDQRASLGGAYLVDGAVPSKTLLYESYLYRLLQQQELIEQRGTRLFPAKFDMQAAQSALKHNIEELGNVYKRELSKNNVTVYKGTAAFKDPHHVEIAQRGMKPFIVEAKYIVVATGSAVIQCPGVAIDNDKIISSDKALSLDYIPSRFTIMGGGTIGLEIACIFNNLGSRVTIVESQSEICQNMDNELASATKTLLQCQGIAFLLDTRVQLAEADAAGQLNITLLNKVSKKTYVHHCDVLMVSIGRRPLLKGLDISSIGLDERDFVENVDVQTQSLLKYPHIKPIGDVTLGPMLALKAEEQAIRAIQSIGCTGSDGTSNCGFPPNVLYCQPQIGWVGYTEEGLAKARIPYQKGRVLFSQNVRYNTLLPREENTTVSPFIKVLIDSRDMKILGVHMINDDANELLSQASMAVSLGLTAHDVCKVPFPHPSLSESFKQAVQLAMANGTSPGVHVRE

SEQ ID NO: 22507 - protein, 861 aa, Saccharomyces cerevisiae
MDKKEYSETFYHPYKPYDIQVQLMETVYRVLSEGKKIAILESPTGTGKTLSLICATMTWLRMNKADIFTRMETNIKTNEDDSENLSDDEPDWVIDTYRKSVLQEKVDLLNDYEKHLNEINTTSCKQLKTMCDLDKEHGRYKSVDPLRKKRKGARHLDVSLEEQDFIPRPYESDSENNDTSKSTRGGRISDKDYKLSELNSQIITLLDKIDGKVSRDPNNGDRFDVTNQNPVKIYYASRTYSQLGQFTSQLRLPSFPSSFRDKVPDEKVKYLPLASKKQLCINPKVMKWKTLEAINDACADLRHSKEGCIFYQNTNEWRHCPDTLALRDMIFSEIQDIEDLVPLGKSLGICPYYASREALPIAEVVTLPYQYLLSESTRSSLQINLENSIVIIDEAHNLIETINSIYSSQISLEDLKNCHKGIVTYFNKFKSRLNPGNRVNLLKLNSLLMTLIQFIVKNFKKIGQEIDPNDMFTGSNIDTLNIHKLLRYIKVSKIAYKIDTYNQALKEEESSKNENPIKETHKKSVSSQPLLFKVSQFLYCLTNLTSEGQFFFEKNYSIKYMLLEPSKPFESILNQAKCVVLAGGTMEPMSEFLSNLLPEVPSEDITTLSCNHVIPKENLQTYITNQPELEFTFEKRMSPSLVNNHLFQFFVDLSKAVPKKGGIVAFFPSYQYLAHVIQCWKQNDRFATLNNVRKIFYEAKDGDDILSGYSDSVAEGRGSLLLAIVGGKLSEGINFQDDLCRAVVMVGLPFPNIFSGELIVKRKHLAAKIMKSGGTEEEASRATKEFMENICMKAVNQSVGRAIRHANDYANIYLLDVRYNRPNFRKKLSRWVQDSINSEHTTHQVISSTRKFFSMRSLNSR

SEQ ID NO: 22508 - protein, 486 aa, Saccharomyces cerevisiae
MVQRLLPGAHICRRSFNSSAIIKSSALTLKEALENVIPKKRDAVKKLKACYGSTFVGPITISSVLGGMRGNQSMFWQGTSLDPEHGIKFQGLTIEECQNRLPNTGIDGDNFLPESMLWLLMTGGVPTFQQAASFRKELAIRGRKLPHYTEKVLSSLPKDMHPMTQLAIGLASMNKGSLFATNYQKGLIGKMEFWKDTLEDSLNLIASLPLLTGRIYSNITNEGHPLGQYSEEVDWCTNICSLLGMTNGTNSSNTCNLTSQQSLDFINLMRLYTGIHVDHEGGNVSAHTTHLVGSALSDPYLSYSSGIMGLAGPLHGLAAQEVVRFLIEMNSNISSIAREQEIKDYLWKILNSNRVIPGYGHAVLRKPDPRFTAMLEFAQKRPIEFENDKNVLLMQKLAEIAPKVLLEHGKSKNPFPNVDSASGILFYHYGIRELLFFTVIFGCSRAMGPLTQLVWDRILGLPIERPKSLNLEGLEALTKASNVNKL

SEQ ID NO: 22509 - protein, 1203 aa, Saccharomyces cerevisiae
MSKVIKPPGQARTADFRTLERESRFINPPKDKSAFPLLQEAVQPHIGSFNALTEGPDGGLLNLGVKDIGEKVIFDGKPLNSEDEISNSGYLGNKLSVSVEQVSIAKPMSNDGVSSAVERKVYPSESRQRLTSYRGKLLLKLKWSVNNGEENLFEVRDCGGLPVMLQSNRCHLNKMSPYELVQHKEESDEIGGYFIVNGIEKLIRMLIVQRRNHPMAIIRPSFANRGASYSHYGIQIRSVRPDQTSQTNVLHYLNDGQVTFRFSWRKNEYLVPVVMILKALCHTSDREIFDGIIGNDVKDSFLTDRLELLLRGFKKRYPHLQNRTQVLQYLGDKFRVVFQASPDQSDLEVGQEVLDRIVLVHLGKDGSQDKFRMLLFMIRKLYSLVAGECSPDNPDATQHQEVLLGGFLYGMILKEKIDEYLQNIIAQVRMDINRGMAINFKDKRYMSRVLMRVNENIGSKMQYFLSTGNLVSQSGLDLQQVSGYTVVAEKINFYRFISHFRMVHRGSFFAQLKTTTVRKLLPESWGFLCPVHTPDGSPCGLLNHFAHKCRISTQQSDVSRIPSILYSLGVAPASHTFAAGPSLCCVQIDGKIIGWVSHEQGKIIADTLRYWKVEGKTPGLPIDLEIGYVPPSTRGQYPGLYLFGGHSRMLRPVRYLPLDKEDIVGPFEQVYMNIAVTPQEIQNNVHTHVEFTPTNILSILANLTPFSDFNQSPRNMYQCQMGKQTMGTPGVALCHRSDNKLYRLQTGQTPIVKANLYDDYGMDNFPNGFNAVVAVISYTGYDMDDAMIINKSADERGFGYGTMYKTEKVDLALNRNRGDPITQHFGFGNDEWPKEWLEKLDEDGLPYIGTYVEEGDPICAYFDDTLNKTKIKTYHSSEPAYIEEVNLIGDESNKFQELQTVSIKYRIRRTPQIGDKFSSRHGQKGVCSRKWPTIDMPFSETGIQPDIIINPHAFPSRMTIGMFVESLAGKAGALHGIAQDSTPWIFNEDDTPADYFGEQLAKAGYNYHGNEPMYSGATGEELRADIYVGVVYYQRLRHMVNDKFQVRSTGPVNSLTMQPVKGRKRHGGIRVGEMERDALIGHGTSFLLQDRLLNSSDYTQASVCRECGSILTTQQSVPRIGSISTVCCRRCSMRFEDAKKLLTKSEDGEKIFIDDSQIWEDGQGNKFVGGNETTTVAIPFVLKYLDSELSAMGIRLRYNVEPK

SEQ ID NO: 22510 - protein, 326 aa, Saccharomyces cerevisiae
MAEVLTVLEQPNSIKDFLKQDSNIAFLAGGVAGAVSRTVVSPFERVKILLQVQSSTTSYNRGIFSSIRQVYHEEGTKGLFRGNGLNCIRIFPYSAVQFVVYEACKKKLFHVNGNNGQEQLTNTQRLFSGALCGGCSVVATYPLDLIKTRLSIQTANLSSLNRSKAKSISKPPGIWQLLSETYRLEGGLRGLYRGVWPTSLGVVPYVALNFAVYEQLREFGVNSSDAQPSWKSNLYKLTIGAISGGVAQTITYPFDLLRRRFQVLAMGGNELGFRYTSVWDALVTIGRAEGVSGYYKGLAANLFKVVPSTAVSWLVYEVVCDSVRNW

SEQ ID NO: 22511 - protein, 933 aa, Saccharomyces cerevisiae
MSQQSSSPTKEDNNSSSPVVPNPDSVPPQLSSPALFYSSSSSQGDIYGRNNSQNLSQGEGNIRAAIGSSPLNFPSSSQRQNSDVFQSQGRQGRIRSSASASGRSRYHSDLRSDRALPTSSSSLGRNGQNRVHMRRNDIHTSDLSSPRRIVDFDTRSGVNTLDTSSSSAPPSEASEPLRIIWGTNVSIQECTTNFRNFLMSFKYKFRKILDEREEFINNTTDEELYYIKQLNEMRELGTSNLNLDARNLLAYKQTEDLYHQLLNYPQEVISIMDQTIKDCMVSLIVDNNLDYDLDEIETKFYKVRPYNVGSCKGMRELNPNDIDKLINLKGLVLRSTPVIPDMKVAFFKCNVCDHTMAVEIDRGVIQEPARCERIDCNEPNSMSLIHNRCSFADKQVIKLQETPDFVPDGQTPHSISLCVYDELVDSCRAGDRIEVTGTFRSIPIRANSRQRVLKSLYKTYVDVVHVKKVSDKRLDVDTSTIEQELMQNKVDHNEVEEVRQITDQDLAKIREVAAREDLYSLLARSIAPSIYELEDVKKGILLQLFGGTNKTFTKGGRYRGDINILLCGDPSTSKSQILQYVHKITPRGVYTSGKGSSAVGLTAYITRDVDTKQLVLESGALVLSDGGVCCIDEFDKMSDSTRSVLHEVMEQQTISIAKAGIITTLNARSSILASANPIGSRYNPNLPVTENIDLPPPLLSRFDLVYLVLDKVDEKNDRELAKHLTNLYLEDKPEHISQDDVLPVEFLTMYISYAKEHIHPIITEAAKTELVRAYVGMRKMGDDSRSDEKRITATTRQLESMIRLAEAHAKMKLKNVVELEDVQEAVRLIRSAIKDYATDPKTGKIDMNLVQTGKSVIQRKLQEDLSREIMNVLKDQASDSMSFNELIKQINEHSQDRVESSDIQEALSRLQQEDKVIVLGEGVRRSVRLNNRV

SEQ ID NO: 22512 - protein, 747 aa, Saccharomyces cerevisiae
MNVSKILVSPTVTTNVLRIFAPRLPQIGASLLVQKKWALRSKKFYRFYSEKNSGEMPPKKEADSSGKASNKSTISSIDNSQPPPPSNTNDKTKQANVAVSHAMLATREQEANKDLTSPDAQAAFYKLLLQSNYPQYVVSRFETPGIASSPECMELYMEALQRIGRHSEADAVRQNLLTASSAGAVNPSLASSSSNQSGYHGNFPSMYSPLYGSRKEPLHVVVSESTFTVVSRWVKWLLVFGILTYSFSEGFKYITENTTLLKSSEVADKSVDVAKTNVKFDDVCGCDEARAELEEIVDFLKDPTKYESLGGKLPKGVLLTGPPGTGKTLLARATAGEAGVDFFFMSGSEFDEVYVGVGAKRIRDLFAQARSRAPAIIFIDELDAIGGKRNPKDQAYAKQTLNQLLVELDGFSQTSGIIIIGATNFPEALDKALTRPGRFDKVVNVDLPDVRGRADILKHHMKKITLADNVDPTIIARGTPGLSGAELANLVNQAAVYACQKNAVSVDMSHFEWAKDKILMGAERKTMVLTDAARKATAFHEAGHAIMAKYTNGATPLYKATILPRGRALGITFQLPEMDKVDITKRECQARLDVCMGGKIAEELIYGKDNTTSGCGSDLQSATGTARAMVTQYGMSDDVGPVNLSENWESWSNKIRDIADNEVIELLKDSEERARRLLTKKNVELHRLAQGLIEYETLDAHEIEQVCKGEKLDKLKTSTNTVVEGPDSDERKDIGDDKPKIPTMLNA

SEQ ID NO: 22513 - protein, 393 aa, Saccharomyces cerevisiae
MTDIQLNGKSTLDTPSATMSAKEKEAKLKSADENNKPPNYKRISDDDLYRHSSQYRMWSYTKDQLQEKRVDTNARAIAYIEENLLKFREAHNLTEEEIKVLEAKAIPLTMEEELDLVNFYAKKVQVIAQHLNLPTEVVATAISFFRRFFLENSVMQIDPKSIVHTTIFLACKSENYFISVDSFAQKAKSTRDSVLKFEFKLLESLKFSLLNHHPYKPLHGFFLDIQNVLYGKVDLNYMGQIYDRCKKRITAALLTDVVYFYTPPQITLATLLIEDEALVTRYLETKFPSREGSQESVPGNEKEEPQNDASTTEKNKEKSTESEEYSIDSAKLLTIIRECKSIIEDCKPPSTEEAKKIAAKNYYCQNPSTLIQKLKRKLNGEDTSSTVEKKQKT

SEQ ID NO: 22514 - protein, 1211 aa, Saccharomyces cerevisiae
MKRIRSLWFNAEASYSNLNNSPSLRNKNSTGNNSRSKNYRSFSRFDLINSILLLMMLFLLAIFVTALYLTKSSRLTYSHASRAALFNPLGVISPSLGNHTLNYDPEARESSKKLYELLSDFNTAYYDDENMILGSNLFSKNTYSRQPYVANGYIGSRIPNIGFGYALDTLNFYTDAPGALNNGWPLRNHRFAGAFVSDFYCLQPKLNSTNFPELDDVGYSTVISSIPQWTNLQFSLVNDSKWFNPQNVTLDDVTNYSQNLSMKDGIVTTELDWLNSQIHVKSEIWAHRHIHPLGVVSLEISLNTDHLPSDFDSLDVNIWDILDFNTSHRTVLHSTGTDEKNNAVFMIVQPDNVPSSNCAIYSTCTVKYENSTNPINSSESFEEKDVSSNIYNVILTEDQPKIIVHKYVGIMSTEFNKNKEQQDNTNIGLAKMIALNSKGNYEKLLSSHKRAWYDLYNDAFIEIPSDSLLEMTARSSLFHLLANTRDYNVSSDRGLPVGVSGLSSDSYGGMVFWDADIWMEPALLPFFPNVAQNMNNYRNATHSQAKLNAEKYGYPGAIYPWTSGKYANCTSTGPCVDYEYHINVDVAMASFSIYLNGHEGIDDEYLRYTTWPIIKNAAQFFTAYVKYNSSLGLYETYNLTDPDEFANHINNGAFTNAGIKTLLKWATDIGNHLGEVVDPKWSEISKDIYIPRSSSNITLEYSGMNSSVEIKQADVTLMVYPLGYINDESILNNAIKDLYYYSERQSASGPAMTYPVFVAAAAGLLNHGSSSQSYLYKSVLPYLRAPFAQFSEQSDDNFLTNGLTQPAFPFLTANGGFLQSILFGLTGIRYSYEVDPDTKKINRLLRFNPIELPLLPGGIAIRNFKYMNQVLDIIIDDHNGTIVHKSGDVPIHIKIPNRSLIHDQDINFYNGSENERKPNLERRDVDRVGDPMRMDRYGTYYLLKPKQELTVQLFKPGLNARNNIAENKQITNLTAGVPGDVAFSALDGNNYTHWQPLDKIHRAKLLIDLGEYNEKEITKGMILWGQRPAKNISISILPHSEKVENLFANVTEIMQNSGNDQLLNETIGQLLDNAGIPVENVIDFDGIEQEDDESLDDVQALLHWKKEDLAKLIEQIPRLNFLKRKFVKILDNVPVSPSEPYYEASRNQSLIEILPSNRTTFTIDYDKLQVGDKGNTDWRKTRYIVVAVQGVYDDYDDDNKGATIKEIVLND

SEQ ID NO: 22515 - protein, 477 aa, Saccharomyces cerevisiae
MTLNRKCVVIHNGSHRTVAGFSNVELPQCIIPSSYIKRTDEGGEAEFIFGTYNMIDAAAEKRNGDEVYTLVDSQGLPYNWDALEMQWRYLYDTQLKVSPEELPLVITMPATNGKPDMAILERYYELAFDKLNVPVFQIVIEPLAIALSMGKSSAFVIDIGASGCNVTPIIDGIVVKNAVVRSKFGGDFLDFQVHERLAPLIKEENDMENMADEQKRSTDVWYEASTWIQQFKSTMLQVSEKDLFELERYYKEQADIYAKQQEQLKQMDQQLQYTALTGSPNNPLVQKKNFLFKPLNKTLTLDLKECYQFAEYLFKPQLISDKFSPEDGLGPLMAKSVKKAGASINSMKANTSTNPNGLGTSHINTNVGDNNSTASSSNISPEQVYSLLLTNVIITGSTSLIEGMEQRIIKELSIRFPQYKLTTFANQVMMDRKIQGWLGALTMANLPSWSLGKWYSKEDYETLKRDRKQSQATNATN

SEQ ID NO: 22516 - protein, 370 aa, Saccharomyces cerevisiae
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHANVSTKEMRQPGGTKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 22517 - protein, 478 aa, Saccharomyces cerevisiae [sequence omitted]

SEQ ID NO: 22518 - protein, 474 aa, Saccharomyces cerevisiae
MEVTSMFLNRMMKTRTGLYRLYSTLKVPHVEINGIKYKTDPQTTNVTDSIIKLTDRSLHLKESHPVGILRDLIEKKLNSVDNTFKIFNNFKPVVTTMENFDSLGFPKDHPGRSKSDTYYINETHLLRTHTSAHELECFQKIRNDSDNIKSGFLISADVYRRDEIDKTHYPVFHQMEGATIWKRTKADVGVKEPMYIEKIREDIRQVENLLNKENVKITVDDDTIPLKENNPKQEYMSDLEVDLCSQHLKRSIELIVSEVFNKKISSMIKNKANNTPKELKVRWINAYFPWTAPSWEIEVWWQGEWLELCGCGLIRQDVLLRAGYKPSETIGWAFGLGLDRIAMLLFEIPDIRLLWSRDERFSRQFSKGLITSFKPYSKHPGSFRDVAFWLPEDKPDIHQVHENDLMEIIRNIAGDLVESVKLVDSFTHPKTGRKSMCYRINYQSMDRNLTNAEVNTLQDMVCSKLVKEYSVELR

SEQ ID NO: 22519 - protein, 176 aa, Saccharomyces cerevisiae
MEIVYKPLDIRNEEQFASIKKLIDADLSEPYSIYVYRYFLNQWPELTYIAVDNKSGTPNIPIGCIVCKMDPHRNVRLRGYIGMLAVESTYRGHGIAKKLVEIAIDKMQREHCDEIMLETEVENSAALNLYEGMGFIRMKRMFRYYLNEGDAFKLILPLTEKSCTRSTFLMHGRLAT

SEQ ID NO: 22520 - protein, 388 aa, Saccharomyces cerevisiae
MNCTLTDNTRAINVASNLGAPQQRTIFAKERISIPGYYEIIQFLGKGAYGTVCSVKFKGRSPAARIAVKKISNIFNKEILLKRAIRELKFMNFFKGHKNIVNLIDLEIVTSSPYDGLYCYQELIDYDLAKVIHSSVQLSEFHIKYFLYQILCGLKYIHSADVIHRDLKPGNILCTLNGCLKICDFGLARGIHAGFFKCHSTVQPHITNYVATRWYRAPELLLSNQPYSKSVDIWAVGCILAEFYARKPVFMGRDSMHQIFEIIKVLGTPDKDILIKFGTIKAWNLGKNSNNPVYKKIPWSNIFPFASHEAINLIESLLHWDSTHRLNVEQAISHPFLNEVRKPDDEPVCLQGPFDFTYESELNSMSKLRDYLVEEVKNFKTDLSSSSL

SEQ ID NO: 22521 - protein, 1065 aa, Saccharomyces cerevisiae
MDYLKPAQKGRRRGLSINSLSETQQSAMNSSLDHLQNDLNRINLQWNRILSDNTNPLELALAFLDDTSVGLGHRYEEFNQLKSQIGSHLQDVVNEHSQVFNTNVASYGKAVSSIMQAQEQTLNLKNCLKEANEKITTDKGSLQELNDNNLKYTKMIDVLVNIEELLQIPEKIEENIRKENFHQVQILLERGFILMNNKSLKTVEILKPINQQLELQEHLLFNNLIEEIHDIMYSKSNKTNFTRVTNNDIFKIISISHNGFTSLENYLYNIVNIDIMEHSKTINKNLEQFIHDQSLNKGNIMLQENAATQAPLAPSRNQENEGFNRIGFLLKTINNINKLPVAFNIITERAKEEIHNIIVKSTESIRSKHPSLLKMATSLKNDNHFGLPVQDILSIILRECFWEIFLKLLYAIQCHRAIFEMSNILQPTSSAKPAFKFNKIWGKLLDEIELLLVRYINDPELISSNNGSIKPINGATNNAPTLPKRKNPKIFSLEYNIEDNSSVKDQAFELKALLKDIFPGFSVSSNMDLDSIYVKDESFEQDEPLVPPSVFNMKVILDPFLLFTQSTSTIVPSVLTQNTISSLTFFDDYMNKSFLPKIQMTMDYLFTVEVESNNPYALELSDENHNIFKTALDFQRLFYNLLNVFNTANTFREKISYCILDLLNHFYNYYLGLFNSLIGTSDRHLTRKIITAWLQNGILMDQEQKILNGDETLFHEESIELFKEIPHFYQAGKGLSKSDLFNNLTLDTILQFSASVLWILNWLPGLKKAINIDEVSQEPMLDADRLRSSWTFSESMDLNYSNPSSSPNSLGNLKILLDDKASKKFDETIDGFKTLKFKLITILRFNIRALCIYDIGSFFQNTKIWNMDVGSIELDQNIASLISELRRTESKLKQQLPEKEKNSIFIGLDIVNNYALIKGAKSIKVLNHNGIKKMLRNVNVLQHAYRNLSSEPSKINMNVTMNFYSLCGSSEAELFEYIKDNELPHCSVEDLKTILRLQFSEEMHRQLKRQSTSSTKGSIKPSNKRYTEALEKLSNLEKEQSKEGARTKIGKLKSKLNAVHTANEK

SEQ ID NO: 22522 - protein, 307 aa, Saccharomyces cerevisiae
MSEEFPSPQLIDDLEEHPQHDNARVVKDLLAGTAGGIAQVLVGQPFDTTKVRLQTSSTPTTAMEVVRKLLANEGPRGFYKGTLTPLIGVGACVSLQFGVNEAMKRFFHHRNADMSSTLSLPQYYACGVTGGIVNSFLASPIEHVRIRLQTQTGSGTNAEFKGPLECIKKLRHNKALLRGLTPTILREGHGCGTYFLVYEALIANQMNKRRGLERKDIPAWKLCIFGALSGTALWLMVYPLDVIKSVMQTDNLQKPKFGNSISSVAKTLYANGGIGAFFKGFGPTMLRAAPANGATFATFELAMRLLG

SEQ ID NO: 22523 - protein, 470 aa, Saccharomyces cerevisiae
MSKLVISTSIFQSQVADLLPCNNHQKSQLTYSLINAYDLLQHFDEVLTFPYARKDDLLEFHSKSYIDYLINGRFNKMMAQDVNNPMVESKWSELSELADNWNEKIDYNPSQDLQRFTTRENLYNYYLNHSQALENNMDCINNSEVPTNDKPTDTYILNSETKQYNLEGDCPIFSYLPMYCQVITGATLNLLDHLSPTERLIGINWDGGRHHAFKQRASGFCYINDVVLLIQRLRKAKLNKITYVDFDLHHGDGVEKAFQYSKQIQTISVHLYEPGFFPGTGSLSDSRKDKNVVNIPLKHGCDDNYLELIASKIVNPLIERHEPEALIIECGGDGLLGDRFNEWQLTIRGLSRIIINIMKSYPRAHIFLLGGGGYNDLLMSRFYTYLTWCVTKQFSNLRCGDNNSFQIDPFDVCDGDDSEQFIREHDLVEMYNEENYQYWIYEMEGSSRMKMLRNDNKDRDMVELMKFYEL

SEQ ID NO: 22524 - protein, 680 aa, Saccharomyces cerevisiae
MTQFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 22525 - protein, 458 aa, Saccharomyces cerevisiae; identical to SEQ ID NO: 1461

SEQ ID NO: 22526 - protein, 345 aa, Saccharomyces cerevisiae
MMTRESIDKRAGRRGPNLNIVLTCPECKVYPPKIVERFSEGDVVCALCGLVLSDKLVDTRSEWRTFSNDDHNGDDPSRVGEASNPLLDGNNLSTRIGKGETTDMRFTKELNKAQGKNVMDKKDNEVQAAFAKITMLCDAAELPKIVKDCAKEAYKLCHDEKTLKGKSMESIMAASILIGCRRAEVARTFKEIQSLIHVKTKEFGKTLNIMKNILRGKSEDGFLKIDTDNMSGAQNLTYIPRFCSHLGLPMQVTTSAEYTAKKCKEIKEIAGKSPITIAVVSIYLNILLFQIPITAAKVGQTLQVTEGTIKSGYKILYEHRDKLVDPQLIANGVVSLDNLPGVEKK

SEQ ID NO: 22527 - protein, 287 aa, Saccharomyces cerevisiae
MQAIADSFSVPNRLVKELQYDNEQNLESDFVTGASQFQRLAPSLTVPPIASPQQFLRAHTDDSRNPDCKIKIAHGTTTLAFRFQGGIIVAVDSRATAGNWVASQTVKKVIEINPFLLGTMAGGAADCQFWETWLGSQCRLHELREKERISVAAASKILSNLVYQYKGAGLSMGTMICGYTRKEGPTIYYVDSDGTRLKGDIFCVGSGQTFAYGVLDSNYKWDLSVEDALYLGKRSILAAAHRDAYSGGSVNLYHVTEDGWIYHGNHDVGELFWKVKEEEGSFNNVIG

SEQ ID NO: 22528 - protein, 564 aa, Saccharomyces cerevisiae
MFSRSDREVDDLAGNMSHLGFYDLNIPKPTSPQAQYRPARKSENGRLTPGLPRSYKPCDSDDQDTFKNRISLNHSPKKLPKDFHERASQSKTQRVVNVCQLYFLDYYCDMFDYVISRRQRTKQVLRYLEQQRSVKNVSNKVLNEEWALYLQREHEVLRKRRLKPKHKDFQILTQVGQGGYGQVYLAKKKDSDEICALKILNKKLLFKLNETNHVLTERDILTTTRSDWLVKLLYAFQDPESLYLAMEFVPGGDFRTLLINTRILKSGHARFYISEMFCAVNALHELGYTHRDLKPENFLIDATGHIKLTDFGLAAGTVSNERIESMKIRLEEVKNLEFPAFTERSIEDRRKIYHNMRKTEINYANSMVGSPDYMALEVLEGKKYDFTVDYWSLGCMLFESLVGYTPFSGSSTNETYENLRYWKKTLRRPRTEDRRAAFSDRTWDLITRLIADPINRVRSFEQVRKMSYFAEINFETLRTSSPPFIPQLDDETDAGYFDDFTNEEDMAKYADVFKRQNKLSAMVDDSAVDSKLVGFTFRHRDGKQGSSGILYNGSEHSDPFSTFY

SEQ ID NO: 22529 - protein, 220 aa, Saccharomyces cerevisiae
MSSNSTPEKVTAEHVLWYIPNKIGYVRVITAALSFFVMKNHPTAFTWLYSTSCLLDALDGTMARKYNQVSSLGAVLDMVTDRSSTAGLMCFLCVQYPQWCVFFQLMLGLDITSHYMHMYASLSAGKTSHKSVGEGESRLLHLYYTRRDVLFTICAFNELFYAGLYLQLFSNSATFGKWTTIISFPGYVFKQTANVVQLKRAALILADNDAKNANEKNKTY

SEQ ID NO: 22530 - protein, 491 aa, Saccharomyces cerevisiae
MSNPIENTENSQNTSSSRFLRNVQRLALNNVTNTTFQKSNANNPALTNFKSTLNSVKKEGSRIPQFTRESVSRSTAAQEEKRTLKENGIQLPKNNLLDDKENQDPSSQQFGALTSIKEGRAELPANISLQESSSAKEIIQHDPLKGVGSSTEVVHNSVENEKLHPARSQLQVRNTESETDSGKKRPISTIVEQELPKKFKVCDENGKEEYEWEDLDAEDVNDPFMVSEYVNDIFEYLHQLEVITLPKKEDLYQHRNIHQNRDILVNWLVKIHNKFGLLPETLYLAINIMDRFLGKELVQLDKLQLVGTSCLFIASKYEEVYSPSIKHFASETDGACTEDEIKEGEKFILKTLKFNLNYPNPMNFLRRISKADDYDIQSRTLAKFLLEISLVDFRFIGILPSLCAAAAMFMSRKMLGKGKWDGNLIHYSGGYTKEELAPVCHMIMDYLVSPIVHDEFHRKYQSRRFMKASIISVQWALKVRKNGYDIMTLHE

SEQ ID NO: 22531 - protein, 435 aa, Saccharomyces cerevisiae
MGENHDHEQSIKRNSMIYNENERQLCNSNLKILQNKRALSKNDSSSKQQVQDSKPRRALTDVPVNNNPLSQNKRIVAGSKAAKVRREENIRPIVSAVQKRQIYNDRTAAEQEEEEEEEGEDDDAASIVNKKRRIDAEGVSEIVGWQDLDYVEKDDTAMVAEYSAEIFAFLYRRELETLPSHNYLLDKTSKYYLRPSMRTILVDWLVEVHEKFQCYPETLFLSINLMDRFLAKNKVTMNKLQLLAVTSLFIAAKFEEVNLPKLAEYAYITDGAASKNDIKNAEMFMLTSLEFNIGWPNPLNFLRRISKADDYDPVNRNIGKFILEYAYCCHQFIHLPPSTVSAMAMYIARRMTNRNKNELWNGTLQHYSGGIDPIHDEAFQSLCIDLVKDIASSKTHLDSLILKYKKPRYGSVYFQTFKWCTSEMHSNFQNLFNLK

SEQ ID NO: 22532 - protein, 1208 aa, Saccharomyces cerevisiae
MSLREVTNYEVSFYIPLSYSNRTHKVCKLPNGILALIISDPTDTSSSCSLTVCTGSHNDPKDIAGLAHLCEHMILSAGSKKYPDPGLFHTLIAKNNGSQNAFTTGEQTTFYFELPNTQNNGEFTFESILDVFASFFKEPLFNPLLISKEIYAIQSEHEGNISSTTKIFYHAARILANPDHPFSRFSTGNIHSLSSIPQLKKIKLKSSLNTYFENNFFGENITLCIRGPQSVNILTKLALSKFGDIKPKSAVKERSISIRTRSFRRSKSLKKRQDSSKNDYSDLKTFKILNTTWEKKYKNTMCFQQFPECNSIFINSNKVPIMRLLFPVSDKNTRFTKDDIKIYSHLWCELFGDESPGSLSYYLASKGWLTGCFAFTSEFAIGDIGLILELELTNSGWENIKRITTIVLNRLLPSFYVMNIDYLITFLKEQNLIDLVSFLYQSSEDLPMEECSKLSGILQDDLECLTPPNIFKGFKSLIEIDDPNIEKYENTKANIQWWTGQAIKFQNFLKSFMNHDNMRLLLLGNIKSGNIFDKMKNKSDICTDFFYEFEYYTANVHLASDNKFHSNSSYEFNFPTGNLFLPDCVSDPLKLQQLFLECSLKSKFATLRPQIYSEPTRTKPQLVSENQNYEMWILKEDPNFASDNKSVVSFEVLGLGIKPSPEATIHLEVLAQALFIITSSFLYPALRIGYTYEIASSSKGNVTLRFTISGFPEGVFTIVKTFVDTLKLIATDPTFLSKDTLRKARILVRNKYKNASSDNCVKLASVGLLIVLEKYIWTLEDRINALELTELESFEKFCFLFWRNPKHLVLFMQGSLEYADAINRYLNNNFTQHLKISNEGSKPTIRLYPPPSTKDLDQGTNAFISYNGHQDDPNNSIVYFIQTAQRDDIKNLTLTFLTEYLFSLTLVPDLRNKKQIGYIVLGGLRVLTDTVGIHITVMSGSSGHNLETRINEYLSYLQLQVLNRFTEFDFRRILLEPFLNLLKQNSTKQFEGSAGPVDLLNEIVANVQNGDNYTLNNKQMRQHRKVRNKIAEGRLNFQEDHEMIDISFLQKLTLKKYLAFFESKISIYSAQRSKLSIMITSPMAEKEIASRKMFLQLEAFLKINGFAIKNEDLKKIVEHSKGNPILLVKNLFTYFRRRNEVFKLGTVVLQEILKIIGMNLKQRYGSILGFSSQDGEGQEIEKFWNNDTSPIVPLQELPEPNFFRKAAF

SEQ ID NO: 22533 - protein, 328 aa, Saccharomyces cerevisiae
MLTLESALTGAVASAMANIAVYPLDLSKTIIQSQVSPSSSEDSNEGKVLPNRRYKNVVDCMINIFKEKGILGLYQGMTVTTVATFVQNFVYFFWYTFIRKSYMKHKLLGLQSLKNRDGPITPSTIEELVLGVAAASISQLFTSPMAVVATRQQTVHSAESAKFTNVIKDIYRENNGDITAFWKGLRTGLALTINPSITYASFQRLKEVFFHDHSNDAGSLSAVQNFILGVLSKMISTLVTQPLIVAKAMLQSAGSKFTTFQEALLYLYKNEGLKSLWKGVLPQLTKGVIVQGLLFAFRGELTKSLKRLIFLYSSFFLKHNGQRKLAST

SEQ ID NO: 22534 - protein, 927 aa, Saccharomyces cerevisiae
MVSVIDKLVFDFGGKTLVSLAPDNNTLCVANKNGLTKILKTNNPEEEPETLDSSKLVSSIKCYSNSHFLMTTMQGDALRYNIDSSQEELLARFALPLRDCCVIHSGKMAVFGGDDLELILLELDDETHKKHAIKIDEQVSQISYNSQMNILAVSMINGKVQIFSLTSTIPNKVHELNDYIVANSYDDTHRDKILSNMMDDIDKDNDNDLSETADPDENNVADPEFCAANRICTRVAWHPKGLHFALPCADDTVKIFSIKGYSLQKTLSTNLSSTKAHFIDLQFDPLRGTYIAAVDLNNKLTVWNWETSEIHYTREFKRKITNIAWKIQADSKTLDLVLGTWSGSIAIVQNLAESVVSNIPDQSVAESSTKHGLFVDSESDLENLEGNDDINKSDKLFSDITQEANAEDVFTQTHDGPSGLSEKRKYNFEDEEDFIDDDDGAGYISGKKPHNEHSYSRVHKTHSFPISLANTGKFRYMPFSPAGTPFGFTDRRYLTMNEVGYVSTVKNSEQYSITVSFFDVGRFREYHFEDLFGYDLCFLNEKGTLFGQSKTGQIQYRPHDSIHSNWTKIIPLQAGERITSVAATPVRVIVGTSLGYFRSFNQFGVPFAVEKTSPIVALTAQNYRVFSVHYSQFHGLSYSLSELGTSSKRYYKRECPLPMSLPNINSDMKKDANLDYYNFNPMGIKSLFFSSYGDPCIFGSDNTLLLLSKWRSPEESKWLPILDSNMEIWKMSGGKETTDIHVWPLALAYDTLNCILVKGKHIWPEFPLPLPSEMEIRMPVFVKSKLLEENKAILNKKNEIGADTEAEEGEEDKEIQIPVSMAAEEEYLRSKVLSELLTDTLENDGEMYGNENEVLAALNGAYDKALLRLFASACSDQNVEKALSLAHELKQDRALTAAVKISERAELPSLVKKINNIREARYEQQLK

SEQ ID NO: 22535 - protein, 729 aa, Saccharomyces cerevisiae
MESLPRTPTKGRSTQHLSTPSPKNDILAMNGHKRRNTTTPPPKHTLLKPQRTDIHRHSLASQSRISMSPNRELLKNYKGTANLIYGNQKSNSGVTSFYKENVNELNRTQAILFEKKATLDLLKDELTETKEKINAVNLKFETLREEKIKIEQQLNLKNNELISIKEEFLSKKQFMNEGHEIHLKQLAASNKKELKQMENEYKTKIEKLKFMKIKQFENERASLLDKIEEVRNKITMNPSTLQEMLNDVEQKHMLEKEEWLTEYQSQWKKDIELNNKHMQEIESIKKEIENTLKPELAEKKKLLTEKRNAYEAIKVKVKEKEEETTRLRDEVALKQKTNLETLEKIKELEEYIKDTELGMKELNEILIKEETVRRTLHNELQELRGNIRVYCRIRPALKNLENSDTSLINVNEFDDNSGVQSMEVTKIQNTAQVHEFKFDKIFDQQDTNVDVFKEVGQLVQSSLDGYNVCIFAYGQTGSGKTFTMLNPGDGIIPSTISHIFNWINKLKTKGWDYKVNCEFIEIYNENIVDLLRSDNNNKEDTSIGLKHEIRHDQETKTTTITNVTSCKLESEEMVEIILKKANKLRSTASTASNEHSSRSHSIFIIHLSGSNAKTGAHSYGTLNLVDLAGSERINVSQVVGDRLRETQNINKSLSCLGDVIHALGQPDSTKRHIPFRNSKLTYLLQYSLTGDSKTLMFVNISPSSSHINETLNSLRFASKVNSTRLVSRK

SEQ ID NO: 22536 - protein, 902 aa, Saccharomyces cerevisiae
MPPASTSTTNDMITEEPTSPHQIPRLTRRLTGFLPQEIKSIDTMIPLKSRALWNKHQVKKFNKAEDFQDRFIDHVETTLARSLYNCDDMAAYEAASMSIRDNLVIDWNKTQQKFTTRDPKRVYYLSLEFLMGRALDNALINMKIEDPEDPAASKGKPREMIKGALDDLGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDFAKFNNGDYKNSVAQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPVGLFGHLLPRHLEIIYDINWFFLQDVAKKFPKDVDLLSRISIIEENSPERQIRMAFLAIVGSHKVNGVAELHSELIKTTIFKDFVKFYGPSKFVNVTNGITPRRWLKQANPSLAKLISETLNDPTEEYLLDMAKLTQLGKYVEDKEFLKKWNQVKLNNKIRLVDLIKKENDGVDIINREYLDDTLFDMQVKRIHEYKRQQLNVFGIIYRYLAMKNMLKNGASIEEVAKKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSVANVGFFSSDRCIEEYSDTIWNVEPVT

SEQ ID NO: 22537 - protein, 657 aa, Saccharomyces cerevisiae
MSDNGSPAVLPKTEFNKYKIGKVKSTPAIQRDAKTNLTYIKLRKRSSEKVYGCTVFQNHYREDEKLGQGTFGEVYKGIHLETQRQVAMKKIIVSVEKDLFPITAQREITILKRLNHKNIIKLIEMVYDHSPDITNAASSNLHKSFYMILPYMVADLSGVLHNPRINLEMCDIKNMMLQILEGLNYIHCAKFMHRDIKTANILIDHNGVLKLADFGLARLYYGCPPNLKYPGGAGSGAKYTSVVVTRWYRAPELVLGDKQYTTAVDIWGVGCVFAEFFEKKPILQGKTDIDQGHVIFKLLGTPTEEDWAVARYLPGAELTTTNYKPTLRERFGKYLSETGLDFLGQLLALDPYKRLTAMSAKHHPWFKEDPLPSEKITLPTEESHEADIKRYKEEMHQSLSQRVPTAPRGHIVEKGESPVVKNLGAIPRGPKKDDASFLPPSKNVLAKPPPSKIRELHQNPRPYHVNSGYAKTAIPPPAAPAGVNRYGPNNSSRNNRFSGNSTAPNNSRNPVNRFHPETNVSSKYNKVPLPLGPQSRYQGNSNESRYKNSPNDSRYHNPRYVNKPETNFNRQPQKYSRQESNAPINKNYNPSNGSRNMAGDHHQGSRPSHPQFPISPSQGQHQLTSKPIEKKNGSFKDERAKPDESKEFQNSDIADLY

SEQ ID NO: 22538 - protein, 209 aa, Saccharomyces cerevisiae
MSQQVGNSIRRKLVIVGDGACGKTCLLIVFSKGQFPEVYVPTVFENYVADVEVDGRRVELALWDTAGQEDYDRLRPLSYPDSNVVLICFSIDLPDSLENVQEKWIAEVLHFCQGVPIILVGCKVDLRNDPQTIEQLRQEGQQPVTSQEGQSVADQIGATGYYECSAKTGYGVREVFEAATRASLMGKSKTNGKAKKNTTEKKKKKCVLL

SEQ ID NO: 22539 - protein, 261 aa, Saccharomyces cerevisiae
MKTYHLNNDIIVTQEQLDHWNEQLIKLETPQEIIAWSIVTFPHLFQTTAFGLTGLVTIDMLSKLSEKYYMPELLFIDTLHHFPQTLTLKNEIEKKYYQPKNQTIHVYKPDGCESEADFASKYGDFLWEKDDDKYDYLAKVEPAHRAYKELHISAVFTGRRKSQGSARSQLSIIEIDELNGILKINPLINWTFEQVKQYIDANNVPYNELLDLGYRSIGDYHSTQPVKEGEDERAGRWKGKAKTECGIHEASRFAQFLKQDA

SEQ ID NO: 22540 - protein, 437 aa, Saccharomyces cerevisiae
MSTGDFLTKGIELVQKAIDLDTATQYEEAYTAYYNGLDYLMLALKYEKNPKSKDLIRAKFTEYLNRAEQLKKHLESEEANAAKKSPSAGSGSNGGNKKISQEEGEDNGGEDNKKLRGALSSAILSEKPNVKWEDVAGLEGAKEALKEAVILPVKFPHLFKGNRKPTSGILLYGPPGTGKSYLAKAVATEANSTFFSVSSSDLVSKWMGESEKLVKQLFAMARENKPSIIFIDEVDALTGTRGEGESEASRRIKTELLVQMNGVGNDSQGVLVLGATNIPWQLDSAIRRRFERRIYIPLPDLAARTTMFEINVGDTPCVLTKEDYRTLGAMTEGYSGSDIAVVVKDALMQPIRKIQSATHFKDVSTEDDETRKLTPCSPGDDGAIEMSWTDIEADELKEPDLTIKDFLKAIKSTRPTVNEDDLLKQEQFTRDFGQEGN

SEQ ID NO: 22541 - protein, 692 aa, Saccharomyces cerevisiae
MCEMFGSGNVLPVKIQPPLLRPLAYRVLSRKYGLSIKSDGLSALAEFVGTNIGANWRQGPATIKFLEQFAAVWKQQERGLFIDQSGVKEVIQEMKEREKVEWSHEHPIQHEENILGRTDDDENNSDDEMPIAADSSLQNVSLSSPMRQPTERDEYKQPFKPESSKALDWRDYFKVINASQQQRFSYNPHKMQFIFVPNKKQNGLGGIAGFLPDIEDKVQMFLTRYYLTNDRVMRNENFQNSDMFNPLSSMVSLQNELSNTNRQQQSSSMSITPIKNLLGRDAQNFLLLGLLNKNFKGNWSLEDPSGSVEIDISQTIPTQGHYYVPGCMVLVEGIYYSVGNKFHVTSMTLPPGERREITLETIGNLDLLGIHGISNNNFIARLDKDLKIRLHLLEKELTDHKFVILGANLFLDDLKIMTALSKILQKLNDDPPTLLIWQGSFTSVPVFASMSSRNISSSTQFKNNFDALATLLSRFDNLTENTTMIFIPGPNDLWGSMVSLGASGTLPQDPIPSAFTKKINKVCKNVVWSSNPTRIAYLSQEIVIFRDDLSGRFKRHRLEFPFNESEDVYTENDNMMSKDTDIVPIDELVKEPDQLPQKVQETRKLVKTILDQGHLSPFLDSLRPISWDLDHTLTLCPIPSTMVLCDTTSAQFDLTYNGCKVINPGSFIHNRRARYMEYVPSSKKTIQEEIYI

SEQ ID NO: 22542 - protein, 325 aa, Saccharomyces cerevisiae
MSGSLTLLKEKHIRYIESLDTKKHNFEYWLTEHLRLNGIYWGLTALCVLDSPETFVKEEVISFVLSCWDDKYGAFAPFPRHDAHLLTTLSAVQILATYDALDVLGKDRKVRLISFIRGNQLEDGSFQGDRFGEVDTRFVYTALSALSILGELTSEVVDPAVDFVLKCYNFDGGFGLCPNAESHAAQAFTCLGALAIANKLDMLSDDQLEEIGWWLCERQLPEGGLNGRPSKLPDVCYSWWVLSSLAIIGRLDWINYEKLTEFILKCQDEKKGGISDRPENEVDVFHTVFGVAGLSLMGYDNLVPIDPIYCMPKSVTSKFKKYPYK

SEQ ID NO: 22543 - protein, 465 aa, Saccharomyces cerevisiae
MSKYIALENLPVDLQHKGATQNESTADILKQLPHERLQAVLEKIPEEDLEVRRLLSILKKPEVVENEDVQQRRIRLAEILMVDEIDLENINNMENINGEEVDEEDDEDFFTPATSELIFARRFLINYSLERSRKRLQKEMERHQKFNTRQELLSRRTELQRMANLELAGSQLVSTKPISAVSLSTDDMVVATGSWAGDLQVLNSQTLQPLTQKLDSHVGKIGAIDWHPDSNNQMISCAEDGLIKNFQYSNEEGGLRLLGDLVGHERRISDVKYHPSGKFIGSASHDMTWRLWDASTHQELLLQEGHDKGVFSLSFQCDGSLVCSGGMDSLSMLWDIRSGSKVMTLAGHSKPIYTVAWSPNGYQVATGGGDGIINVWDIRKRDEGQLNQILAHRNIVTQVRFSKEDGGKKLVSCGYDNLINVYSSDTWLKMGSLAGHTDKIISLDISNNSHFLVSGGWDRSIKLWN

SEQ ID NO: 22544 - protein, 155 aa, Saccharomyces cerevisiae
MSDYEEAFNDGNENFEDFDVEHFSDEETYEEKPQFKDGETTDANGKTIVTGGNGPEDFQQHEQIRRKTLKEKAIPKDQRATTPYMTKYERARILGTRALQISMNAPVFVDLEGETDPLRIAMKELAEKKIPLVIRRYLPDGSFEDWSVEELIVDL

SEQ ID NO: 22545 - protein, 163 aa, Saccharomyces cerevisiae
MDHSESLTFNQLTQDYINKLKDAFQMLDEDEDGLISRGDLTKIYATLGKTLTDEEWSKMVPDNDTSTAEVGEEGVSFPIFLSIMGKNLSQFPEREELEESLKAIGRGHDLNVPLNEVIDSLKEAGFENPEEEFAKLFKLFTTNQQATEERTFRGKLFLDSITD

SEQ ID NO: 22546 - protein, 368 aa, Saccharomyces cerevisiae
MLSAARLQFAQGSVRRLTVSARDAPTKISTLAVKVHGGSRYATKDGVAHLLNRFNFQNTNTRSALKLVRESELLGGTFKSTLDREYITLKATFLKDDLPYYVNALADVLYKTAFKPHELTESVLPAARYDYAVAEQCPVKSAEDQLYAITFRKGLGNPLLYDGVERVSLQDIKDFADKVYTKENLEVSGENVVEADLKRFVDESLLSTLPAGKSLVSKSEPKFFLGEENRVRFIGDSVAAIGIPVNKASLAQYEVLANYLTSALSELSGLISSAKLDKFTDGGLFTLFVRDQDSAVVSSNIKKIVADLKKGKDLSPAINYTKLKNAVQNESVSSPIELNFDAVKDFKLGKFNYVAVGDVSNLPYLDEL

SEQ ID NO: 22547 - protein, 877 aa, Saccharomyces cerevisiae
MSETVKDKVIIDEKVSTKGTVDYAEGAEYSERLSNHSSDFSQWYTDEQILHFMKKLGYENRTLYDIPEDVAYILKKMPELTLEDSFKILKDSIIYFKDDENIPHDQYEEWKRLVDLEDLDSKEGIDEYDSFDIRAFASAIKFHSPYQEVRAVVDPEDDPTIPVETFRAYFLAIIWSVIGSGFNEFFSHRVVSISLNTPIIQMFLYICGKAWAKTIPCWTITIRGRKYGINIDKPWTQKEQMFSTLLYAICQGAFYTHYNILTQKLFYHSAFSFGYQFLLSLSVQFIGFGFAGILRKFVVYPARALWPTVMPTIAINKALLGKEKHESGMSRYKFFFLTFFIMFIYNWFPTYIINILNTFNWMTWIKPSNINLANITGGVTGLGINPISSFDWNVISFNSPLVYPFWSYLTQYLGCILAALIVIAVYYSNYMSCQYLPIFTNSLYTNTGHSFKVTEVLDSDNKLDVKKYQSYSPPYYSAGNLVSYGAFICAYPLMITWSFIVHSKLLFNAFKDWALNLWAMRKLKSWVTMFKSDYRALDDYDDPHSNAMKNYKEVPDWWYFAILIGSLVVGIAVVEHYPTNTPVWGLFVCLGFNFVFLIPTTILQATTGYSFGLNLLIEMVMGYALPGNPIAIMILKAFGYNIDGQADNYVSNLKIAHYCKIPPMALFRGQCVIVFIQIFVNLGVLNWQISNIKDFCTPHQNAKFTCPDAVTYYNASVVWGAIGPKRIFNYIYPIFKWCWLIGACIGIFFGVWKRWGKFYPRYFDPMLFVGGMLNMSPPYNLMYYTSGMIVSYISQYYMKRHHLNLWEKYNYVLSAGFSTGLVLSAIIIFFAVQYKDTAFNWWGNTVPYAGADGVGYPLKNITDTANGYFGYAPGHYP

SEQ ID NO: 22548 - protein, 1104 aa, Schizosaccharomyces pombe
RQIILNDYSANHFLHNAVSTCKYSAFTFLPKFLKEQFSKYANLFFLFTAVVQQIPGITPVNRYTTIGPMLIVLSVSGIKEIMEDIKRKKQDQELNESPCYVLQGTGFVEKQWKDVVVGDIVKIVSETFFPADLVLLSSSEPEGLCYIETANLDGETNLKIKQALPETAGLLKPVELGQLSGEVKSEQPNNNLYTFDATLKLLPSDRELPLSPDQLLLRGAQLRNTPWVYGIVVFTGHESKLMKNTTETPIKRTSVEKQVNSQILFLLCIFVFLCFASSLGALIHRSVYGSALSYVKYTSNRAGMFFKGLLTFWILYSNLVPISLFVTFELVRYIQAQLISSDLDMYNEETDTPAACRTSSLVEELGQVGYIFSDKTGTLTRNQMEFRQCTIAGVAYADVIPEDRQFTSEDLDSDMYIYDFDTLKENLKHSENASLIHQFLLVLSICHTVIPEYDESTNSIKYQASSPDEGALVKGAASIGYKFLARKPHLVTVSIFGKDESYELLHICEFNSTRKRMSIVFRCPDGKIRLYVKGADTVIMERLASDNPYLQTTIHHLEDYATVGLRTLCIAMREVPEDEYQRWSTVFETAASSLVDRAQKLMDAAEEIEKDLILLGATAIEDRLQDGVPDTISTLQTAGIKIWVLTGDRQETAINIGMSCKLIDEDMGLVIVNEETKEATAESVMAKLSSIYRNEATTGNVESMALVIDGVSLTYALDFSLERRFFELASLCRAVICCRVSPLQKALIVKMVKRNTGEVLLAIGDGANDVPMIQAAHVGVGISGMEGLQAVRSSDFSISQFCYLKKLLLVHGSWCYQRLSKLILYSFYKNIALYMTQFWYAFCNAFSGQVIFESWSISLYNVLFTVLPPVVIGIFDQFVSAGQLFQYPQLYQLGQRSEFFNLKRFWSWITNGFYHSLLLFLCSIAVFYYDGPNKDGLASGHWVWGTTLYAAILATVLGKAALISNHWTQYTVIATLGSFLLWIVFMPIYAVAAPAIGFSKEYYGIIPHLYGNLKFWASLLVLPTIALMRDFVWKYSSRMYYPEEYHYVQEIQKYNVTDYRPRIVGFHKAIRKIRQMQRMRKQRGYAFSQGEEDQSRILDAYDTT

SEQ ID NO: 22549 - protein, 453 aa, Schizosaccharomyces pombe
  unsure (1)..(453): unsure at all Xaa locations
MKRVVITGLGAVTPLGNGVKTNWRNLIQGKSGIVSLKGFPEYEQIPSKVAGVIPRGKEKEEWNVLDYVDQGKLREVATFTQLALTSAAEALKDARWIDIDEQEKLATVCESRKLYTNKKGVCFGTGIGNLDDALNENGVLNKAGIRKVSPRVISKILINMPAGYISQRYGFTALNHTTTTACAAGCHAIGDAFNFIKLGHADVIIAGGSESCINPLTVAGFSKARSLSTKFNDNPKAASRPFDANRDGFVIGEGSAALVLEELEHAKNRNAHIYAEIVGYGLASDSYHITAPNPNGDAAYYAMKRSLKQAGLSASQLDYINAHATSTKLGDVAESIAITRLLCDVNRNPEAFPVSSSKGSIGHLLGAAGAIESVYTVLTVQKVFYSTQTFYCXQNCIGRLPPTLNFEYSDIPQQFQCDYVPNVAKESRINVALSNSFGFGGTNASLCFKKFLQ

SEQ ID NO: 22550 - protein, 819 aa, Schizosaccharomyces pombe
  unsure (1)..(819): unsure at all Xaa locations
MFSCQSLYKFSHSFRKRIPVMFQRAQQKSSLLHTQNESSHQPSLNKLGGFSSASLNFNSSRSSTNDDQQTFSSQSDNLPSSPITLPAKRGRSAASLKQLDNTVGFDVSKPSLPVFENSGLGSKYSTEIANGVYIDENDFDDDLLLENDIDQKPIPWSSSPIEHTKLTKSMLSSEKRSKNHLSKIYEDHTSEKGASSVISSNITRQGIKRSRTLPWAVDPYRYGDPDPKRTSTSADISQHTVSNDSSNKLSNGRSSSLDSLAKKRMSKSKSTPQISKKFSVPLNSASKSPIGSSLFKTSDSRKKSVPSIFLSDEQKRILDMVVEQQHSIFFTGSAGTGKSVLLRKIIEVLKSKYRKQSDRVAVTASTGLAACNIGGVTLHSFAGVGLARESVDLLVSKIKKNKKCVNRWLRTRVLIIDEGKQFKXVYIYXXLXVSMVDAELMDKLEEVARVIRKDSKPFGGIQLVLTGDFFQLPPVPENGKESKFCFESQTWKSALDFTIGLTHVFRQKDEEFVKMLNELRLGKLSDESVRKFKVLNRTIEYEDGLLPTELFPTRYEVERSNDMRMQQINQNPVTFTAIDSGTVRDKEFRDRLLQGCMAPATLVLKVNAQVMLIKNIDDQLVNGSLGKVIGFIDDETYQMEKKDAEMQGRNAFEYDSLDISPFDLPDVKQKKYKLIAMRKASSTAIKWPLVRFKLPNGGERTIVVQRETWNIELPNGEVQASRSQIPLILAYAISIHKAQGQTLDRVKVDLGRVFEKGQAYVALSRATTQEGLQVLNFSPAKVMAHPKVVQFYKQLASVNGLPIRNENKAPVQMRGVKNK

SEQ ID NO: 22551 - protein, 293 aa, Schizosaccharomyces pombe
MVTTVEMLTTWNPVTVSLVSPVIIYWVASAFFGFLHYIELPVFEKYRIHPPEEIARRNRVPQMAVVKAVLFQQLCEVVVGIALAMFEGYPEPIDEAKQMLRYEAFFSKNLPALLQVAPFAPKLAYNFIVPAFQYFFAFFIIDSWQYFWHRYLHYNKKLYNMIHAHHHRLQVPYAMGALYNHPFEGLILDTFGAGVAYLAAGLSPQQAVIFFTLSTLKTVDDHCGYVFPYDPLQMFFANNARYHDLHHQPYGFQKNFSQPFFTFWDHVLGTYMPPKSETPYEKKQKAKNAKKVN

SEQ ID NO: 22552 - protein, 502 aa, Schizosaccharomyces pombe
QCLIFPGVGNFGFVCDSLAKQGFLEPLRRYALSGKPFMAVCVGIQALFEGSVEAPHSKGLGVFPGLVQRFDNDDKTVPHIGWNSCAVRSDTSKEFFGMRPHDKFYFVHSYMIPEKGLILPPEFKIATTKYGNETFVGAIVKNNFLATQFHPEKSGSAGLRCLKAFLTGNYEQPISGEASKLIENSFGGLTKRIIACLDVRSNDAGDLVVTKGDQYDVREKSSGSEVRNLGKPVELCQRYFQEGADEVVFLNITSFRNCPMADAPMLQVLEKAAQTVFVPLTVGGGIRDVSDPDGTFHPAVEVAGIYFRSGADKVSIGSDAVYAAEKYYENGKKLSGKTAIETISKAYGNQAVVISVDPKRQYVKVPEDTKHHVVKTSRLGPNGEAYCWYQCTVKGGREYRDIDVVELTRACEAMGAGEVLLNCMDQDGSNAGYDIELVRLVKNSVNIPVIASSGAGIPQHFEEVFKETDCDAALAAGIFHRQTCRIEDVKEYLAIHDVLVRT

SEQ ID NO: 22553 - protein, 695 aa, Schizosaccharomyces pombe
MSKLSEKEAFLFDRSIDQFEKGQYSKSLKTIQSVLKKKPKHPDSVALLGLNLCKLHDSRSALLKCGYASSIDPKSQFCWHALAIVYRETKDYNNSLKCYQNALAISPNNESLWYDAAYLQAQLGLYQPLFDNWNRLLQLDSSNLEYRLCFTLSAFLSGNYKESLEQIQYLISSCNLSPLVVSRLISFLPRICEHIENGSQTVLEILLMNQNSFLNNFNFEHIKADFAFRQKNYEESIYLYARLLIKFPNRLDYSEKYLNSLWNFYKSGGLALDLLLKRTDSLIKTFSEILQTGISVLIFLLSKNLDYDFCLNHLISYSMHHFIPSFISLLKIPLKTNDAFSKKLITMLSNFREGDSAKNIPTHKLWCTYCLCLAHYKLGDYEESNYWLNLAIDHTPTYPELFLAKAKIFLCMGEIEEALCSFKRSVELDKSDRALASKYAKYLIRMDRNEEAYIVLSKFSRFRFGGVCNYLAETECVWFLVEDGESLLRQKLYGLALKRFHSIYQIYKKWSFLKFDYFTQCAEDGEFQEYVELVEWSDNLWSSTDYLRATLGALTIYLLLFESKFNMYGNKAEEISHMSEVEQIAYAREDNKKIMKLQKIEEDKIKSYIPSESEEPLVIDEDYFGHKLLITDDPLTEAMRFLQPICWHKIKGWGFLKILSSKLYKLKGIIFCYYALTNNIEGLHQKANSLETSVL

SEQ ID NO: 22554 - protein, 1444 aa, Schizosaccharomyces pombe
  unsure (1)..(1444): unsure at all Xaa locations
MFNDQSKTTSSVKGICATTDNNHGNLKKTNSTPFRKNYLLNGRTKLKLENFAYNASTEISSPKISEKKHSSLPIKRKNTFNESSTSFSPFTKAHKEITDDLKPDKSFTRKSDLNSQDMPGMIFLVFRRVFXLLEVCFQETSKDLCRSSSTQHLLDHQTTDSTIIDMKPVSTNSKSDVFTLYTDETVLLRRCASDNKPLINNNLSSSNVSENQSRSFGSYDEVKNQGNNLHKVPSLVSIIRNARSSEQSRIAANSSCLLKGSDTEIDEDDFALEAEDLAALDSLERQYSQLPNSTVTASAKDIEKTAKVNHVGGDLQSYCSATKASDATINEEPVNLALDKACNSLPDINSDFIDDWDDSCDGCTPGELCEFSSEYTVLEVHEDFIFHEGNHFRQLKLILEANDILHQLFLRGDWTETSIFVGDSIRVEATFDKDNTAIVDNDKGLIIIHPKILMSATAVASSFPCLRKAVISDRVGIYGPPTKAMVTGNILHDFFQHALYRGIDALENVDINLETSIKTYISDIYFADLSLDEIREELDARLPLLKSIVERYLISKKNDNNNESIHISRLLDIEESIWSPRFGLKGNIDATVEVVLTEKPESSSTLTLPLELKTGRYVDNISHFAQSLLYTLLISDRYGINTNQALLCYLENSTIKNLVASNSQLRGLIMTRNSLAQHNFRRSLPEMISNRKICDHCSLVSECLFFQKMSDKGVANSNGLTESWNEWMREVKDEDLEFYKKWEKLLNQEERLLLLKRGDVLTFDTEELEAYGKTLYPLYITKEDIVCLEIDDRVFHYKFAFLNDNGYPRNFLHSGFSVGERVFISDEHGHWSLAKGHIVHIQDSCIEVRTRHRLHIPWLKMPNFDFKKNQVFFGNYEDSKLSFIGSNHTRYRIDKDEFSSGIASIRGTLMSSVLPDAPLIIRDMIIRLKPPKFCNSALIDPEFLKCLNEDQITALKKCHAAEHYSLILGMPGTGKTTTISSLIRSLLAKKKKILLTSFTHLAVDNILIKLKGCDSTIVRLGSPHKIHPLVKEFCLTEGTTFDDLASLKHFYEDPQIVACSSLGVYQXVIESDGNEQTTNNISSIFNKRKFDYCIIDEASQIPLPICLGPLQLAEKFVLVGDHYQLPPLVKNSRTSKDGLSLSLFKLLSEKHPEAVTTLRLQYRMNEDINSLSSELIYGGNLVCGSKTISQKKLILPKAHLSDGLPDSSSSLHWVNKLINPSHSVIFFNTDDILGVESKTNNILENHTEAFLIEQAVSSFLERGVKQSSIGIISIYKSQVELLSKNLKSFTEIEINTVDRYQGRDKDIILISFVRSNSKNLSEYXTNYLHNCXPFIXVGELLRDWHRLNVALSRAKVKCIMFGSLSTLSSSNIVSHLLKLLEKNKWIFTLNENDIATKFDENSSPIKDCSQVATTNNAKVIIRKNQRFFNSDNLCEKAILPQLEF

SEQ ID NO: 22555 - protein, 905 aa, Schizosaccharomyces pombe
MADYPFTDKAAKTLSDAYSIAQSYGHSQLTPIHIAAALLSDSDSNGTTLLRTIVDKAGGDGQKFERSVTSRLVRLPAQDPPPEQVTLSPESAKLLRNAHELQKTQKDSYIAQDHFIAVFTKDDTLKSLLAEAGVTPKAFEFAVNNVRGNKRIDSKNAEEGFDALNKFTVDLTELARNGQLDPVIGREDEIRRTIRVLSRRTKNNPVLIGEPGVGKTSIAEGLARRIIDDDVPANLSNCKLLSLDVGSLVAGSKFRGEFEERIKSVLKEVEESETPIILFVDEMHLLMGAGSGGEGGMDAANLLKPMLARGKLHCIGATTLAEYKKYIEKDAAFERRFQIILVKEPSIEDTISILRGLKEKYEVHHGVTISDRALVTAAHLASRYLTSRRLPDSAIDLVDEAAAAVRVTRESQPEVLDNLERKLRQLRVEIRALEREKDEASKERLKAARKEAEQVEEETRPIREKYELEKSRGSELQDAKRRLDELKAKAEDAERRNDFTLAADLKYYGIPDLQKRIEYLEQQKRKADAEAIANAQPGSEPLLIDVVGPDQINEIVARWTGIPVTRLKTTEKERLLNMEKVLSKQVIGQNEAVTAVANAIRLSRAGLSDPNQPIASFLFCGPSGTGKTLLTKALASFMFDDENAMIRIDMSEYMEKHSVSRLIGAPPGYVGHEAGGQLTEQLRRRPYSVILFDEIEKAAPEVLTVLLQVLDDGRITSGQGQVVDAKNAVIIMTSNLGAEYLTTDNESDDGKIDSTTREMVMNSIRGFFRPEFLNRISSIVIFNRLRRVDIRNIVENRILEVQKRLQSNHRSIKIEVSDEAKDLLGSAGYSPAYGARPLNRVIQNQVLNPMAVLILNGQLRDKETAHVVVQNGKIFVKPNHEANANGSADIDMDGIDDDVNDEELE

SEQ ID NO: 22556 - protein, 297 aa, Schizosaccharomyces pombe
  unsure (1)..(297): unsure at all Xaa locations
MLEARFQQAALLKKLLDAIKELVTDANVCKGQHINKDAQRQSLSFFXKKYIYXLLLNDSLTSXQFDCNDNGISLQAMDSSHVALVSMLIKSDGFEPYRCDRNIALGINLNALSKVLRCAQNEDLVTLKAEDTPEVLNLVFESEKNDRISDYDVKLMDIDQEHLGIPDIEYDATITMPAAEFQRITRDLLTLSDSVTINASKEGVRFSCKGDIGNGSTTLKQHTDLSDQDQSIEISLTQAVTLTFSLKYLAQFTKATPLATRVTLSMSNDVPLLVEYKMESGFLRFYLAPKIGEEDEE

SEQ ID NO: 22557 - protein, 621 aa, Schizosaccharomyces pombe
  unsure (1)..(621): unsure at all Xaa locations
MNNSITDSVEKKPEQVSFEVQPNALRPVAFHVFTRKYDLNINRDSLQELASFVSKKCGSQWRSQCEPLLDEIAKTWKRVHETQPIVTRPLLIPVLANLNVPHEVRVSSLARVQTLETTGSFLNSSNSEIRETIKNEKYFRVLDAFKMPKFKYDSSRKVFVLSKQSPTLMASASACTDMLNRRFNVVYSRILRNESFQTPSFSGSFSQTGTYQLTPIRNLLGRAGNTFLLFGLLTIAPDGTLWLEDLDSQVQLDVSQAEQGFGLFCPGCLVLVNGQFLSSGLFLVFELGHPPIERRDASLKALNNLDILGLNMDAKQLALLRHAEQAYQSQAFVCISEVHLDNHQTFYALEKIFQKYESSEAVPFCIILCGSFMSSAFHNSGSSIQYKEGFNKLAASLEKFPKICEKTKFIFVPGPNDPWTTNGISLMPKHSIPLHFVNRIQRVCKHTIFASNPCRIIFFSQEVLIYRDDISGRFQRNSLKFGKTPQGTSNINSIPLAEQQVHQQRKVSKFLIIFLCXFVXLVKTVLDQSHLSPFPSRTRPILWDFDYALSVFPLPSCVRYKSFFSLLIFLMGLIDSESSAFDVHYGGCPTFNPGALLLGVHYNWQEVFPVKKEIITHKERI

SEQ ID NO: 22558 - protein, 815 aa, Schizosaccharomyces pombe
  unsure (1)..(815): unsure at all Xaa locations
MSYRDNEYSGNYNGKEDGYNSRGXEFTIGRAPVQYKIIDTDLPFFLKXLILTFYSRYGGGYRNNYSRGGGRGGFNDGASYGYDQRGQGRNFYESDGPGANLVKKDWKNETLIPFQKDFYKEHENVRNRSDAEVTEYRKEKEIVVHGLNVPKPVTTFEEAGFPNYVLKEVKQLGFEAPTPIQQQAWPMAMSGRDMVGISATGSGKTLSYCLPAIVHINAQPLLSPGDGPIVLVLAPTRELAVQIQQECTKFGKSSRIRNTCVYGGVPRGPQIRDLIRGVEICIATPGRLLDMLDSNKTNLRRVTYLVLDEADRMLDMGFEPQIRKIVDQIRPDRQTVMFSATWPKEVQRLARDYLNDYIQVTVGSLDLAASHNIKQIVEVVDNADKRARLGKDIEEVLKDRDNKVLIFTGTKRVADDITRFLRQDGWPALAIHGDKAQDERDWVLNEFRTGKSPIMVATDVASRGIGKFLFNSFFLFAGFFIXRYTFTGVLNVSFDNKRWTGDQHHFSLNFASLCCFDEYFCLRPVLRKVENSDDCLACFLQARMVLQRETDDFYFMILAFSIVVEIRVVCYLLNLLSTFPRSMXPFDLRSIXKVFKRLFYSAFKPTXLIVYFXTTLNDLKHSFSVLFPPFLYFLLSFVFLSLXTYCCSVPLLKCLCSVVDLTCQIXRSLKLLIYWINPXNIYLEAXSQNPLGHYXLFIDVKGITHVFNYDFPGNTEDYVHRIGRTGRAGAKGTAYTYFTSDNAKQARELVSILSEAKQDIDPKLEEMARYSSGGRGGNYRRGGYGRGGFRRGGGYGNRNRGFTGSNSAPLARSRW

SEQ ID NO: 22559 - protein, 1019 aa, Schizosaccharomyces pombe
MAEYEIDEITFHKRLGILLTSWKNEEDGKTLFQDCDSILVTVGAHDDTNPYQKSTALHTWLLGYEFPSTLILLEKHRITILTSVNKANMLTKLAETKGAAADVNILKRTKDAEENKKLFEKIIEYIRATNKKVGVFPKDKTQGKFINEWDSIFEPVKSEFNLVDASLGLAKCLAIKDEQELANIKGASRVSVAVMSKYFVDELSTYIDQGKKITHSKFSDQMESLIDNEAFFQTKSLKLGDIDLDQLEWCYTPIIQSGGSYDLKPSAITDDRNLHGDVVLCSLGFRYKSYCSNVGRTYLFDPDSEQQKNYSFLVALQKKLFEYCRDGAVIGDIYTKILGLIRAKRPDLEPNFVRNLGAGIGIEFRESSLLVNAKNPRVLQAGMTLNLSIGFGNLINPHPKNSQSKEYALLLIDTIQITRSDPIVFTDSPKAQGDISYFFGEDDSSLEDGVKPRKPPTRGTATISSHKGKTRSETRDLDDSAEKRRVEHQKQLASRKQAEGLQRFAQGSVPSSGIEKPTVKRFESYKRDSQLPQAIGELRILVDYRAQSIILPIFGRPVPFHISTLKNASKNDEGNFVYLRLNFVSPGQIGGKKDELPFEDPNAQFIRSFTFRSSNNSRMSQVFKDIQDMKKAATKRETERKEFADVIEQDKLIEIKNKRPAHINDVYVRPAIDGKRLPGFIEIHQNGIRYQSPLRSDSHIDLLFSNMKHLFFQPCEGELIVLIHVHLKAPIMVGKRKTQDVQFYREVSDIQFDETGNKKRKYMYGDEDELEQEQEERRRRAQLDREFKSFAEKIAEASEGRIELDIPFRELAFNGVPFRSNVLLQPTTDCLVQLTDTPFTVITLNEIEIAHLERVQFGLKNFDLVFIFQDFRRPPIHINTIPMEQLDNVKEWLDSCDICFYEGPLNLNWTTIMKTVNEDPIAFFEEGGWGFLGAPSDDEGDDSVEEVSEYEASDADPSDEEEEESEEYSEDASEEDGYSESEVEDEESGEDWDELERKARQEDAKHDAFEERPSKKRHR

SEQ ID NO: 22560 - protein, 525 aa, Schizosaccharomyces pombe
MRDLTSATDSASLESDSSRNQFIINSLVCFIKIVIILTFSLPWYSCSEHEFPHRKARKRRSPKNLDWSVSVQMPLVTSKTKESEKSPKSWSAIAKKHVQGDSPVKKSHSVPVPSDRSEKKSFNSSLGELIETYSPSLDAPRPIQPRGFINTGNICFMNSILQALMYCVPFYNLLKQINRMVPYNFERTTPLIESLTMLSRDFREYSEKFDLQGDSILPEVVYSATKGNPRFEMLQTGEQEDAEEFLNLFLDELHEEFVRERRHYLLKNDERNPKSDIKISNGIKSGLDSFDDQSSVEASGWTEVGKNKKPVIARSATVERSPISQIFGGQLRSTLRVPSARDSVLLEPFQPLQLDIQAEDIHSVIDALEHMTAPEILPEWHSSKGNVTATKQMYIESLPPVLILHLKRFFYEASGGTQKNYKPIAYPARLSIPQNVFSPSVRGSIHPEYDLNAVVYHHGTSASGGHYTVDVQQLDKSGWFRIDDTHIHRVPIHDVENSELSADPSLSKLGHGDRVAYLLFYTRRS

SEQ ID NO: 22561 - protein, 359 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLLQELKLACKNIYAEDLFIRMERHILDTLDWDISIPTPASYIPVLDPIFFLVLDASMFVPNLFKFPASKIACSVMNIVNEHVGSFLLTHPSMESYRKDDNFLWPEDLDTVTSYMENMSKRYANEECTDLLFSSLGRISSILAKKYPEQCAMAAWCNMTEKDTERTL

SEQ ID NO: 22562 - protein, 276 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLLQELKLACKNIYAEDLFIRMERHILDTLDWDISIPTPASYIPVLDPIFFLVLDASMFVPNLFKFPASKIACSVMNIVNEHVG

SEQ ID NO: 22563 - protein, 489 aa, Schizosaccharomyces pombe
KLLNNLFREYLSTKRVALVCSARSTDTKAEGTTTRLIRATEAALRPAVGSVHDLVRIIETDHVQAARDFIQDVGIQDELIDAFHADCVELEQYLNAIRVLSEVSPRTRDLVIGMGERLSCRFMAAVLKDQGIDSEFIDMSHIIDEQREWRNLDASFYAYLASQLASKVTAVGNKVPVVTGFFGMVPGGLLSQIGRGYTDFCAALLAVGLNADELQIWKEVDGIFTADPRKVPTARLLPLITPEEAAELTYYGSEVIHPFTMSQVVHARIPIRIKNVGNPRGKGTVIFPDTISRHGSATPPHPPKIMPDDISASLANKGATAVTIKDTIMVINIQSNRKISAHGFLASIFAILDKYKLAVDLITTSEVHVSMALYEESDDGNMHEAFVELRRLGTLDILHGLAILSLVGKHMRNTTGYAGRMFCKLAEAQINIEMISQGASEINISCVIDEKMAVKALNVIHKELLEPLALHEVPSQASMLVEKPWLYSA

SEQ ID NO: 22564 - protein, 760 aa, Schizosaccharomyces pombe
MALPTIDLKIPEYEECQHKITDFLSHFKQEQVQDGQQNQDISMSDAGDEPFLKSKYMDILQKISNRESNVINVDLNDLYEFDPSDTQLLHNIESNAKRFVELFSQCADALMPPPTVEINYRNEVLDVIMQQRVQRNENIDPEHKGFPPELTRGYDLYFRPVTRNKKPFSVRDLRGENLGSLLTVRGIVTRTSDVKPSLTVNAYTCDRCGYEVFQEIRQKTFLPMSECPSDECKKNDAKGQLFMSTRASKFLPFQEVKIQELTNQVPIGHIPRSLTVHLYGAITRSVNPGDIVDISGIFLPTPYTGFRAMRAGLLTDTYLECHYVSQIIKNYTNIEKTPQSEAAIAELNQGGNVYEKLAKSIAPEIYGHEDVKKALLLLLVGGVTKELGDGMRIRGDINICLTGDPGVAKSQLLKYISKVAPRGVYTTGRGSSGVGLTAAVMRDPVTDEMVLEGGALVLADNGICCIDEFDKMDESDRTAIHEVMEQQTISISKAGITTTLNARTSILAAANPLYGRYNPKVAPIHNINLPAALLSRFDILFLILDTPSRETDEHLAQHVTYVHMHNEQPKMDFEPLDPNMIRHYISSARQYRPVVPKDVCDYVTGAYVQLRQNQKRDEANERQFAHTTPRTLLAILRMGQALARLRFSNRVEIGDVDEALRLMSVSKSSLYDDLDPSSHDTTITSKIYKIIRDMLNSIPDVEGNERSLTLRAIRERVLAKGFTEDHLINTIQEYTDLGVLLTTNNGQTIMFLDPDLHMEN

SEQ ID NO: 22565 - protein, 391 aa, Schizosaccharomyces pombe
MGLEHLEEFSYPKEHGEEVEYDSEQGVRKIYVKSIKETFNFDNVSEEEKQEGGDYYLGKKEDELDEVVLRPNPHRFVLFPIKYHEIWQFYKKAEASFWTAEEIDLSKDLVDWDNKLNADERYFISTVLAYFAASDGIVNENLLERFSSEVQIPEARCVYGFQIMIENIHSETYSLLLDTYIREPKEKQRHFDAILTMGSIKAKAKWALRWINDEDSTYAIRLVAFAAVEGIFFSGSFASIFWLKKRGLMPGLTFSNELICRDEGLHTDFACLMFSHLKHRPGRKVVEAIIVEAVDIEKEYFTDALPVSLLGMNKDLMCQYIEFVADRLLVALGNDKYYNVTNPFDFMENISLAGKTNFFEKKVSDYQIAGVMSGTKRAEKDDHTFTIDEDF

SEQ ID NO: 22566 - protein, 462 aa, Schizosaccharomyces pombe
  unsure (1)..(462): unsure at all Xaa locations
MQAEFKSSINDFLEQLPNHARLYQKPAACLAVFRLLPILARQYVMSMLFNPMPVALSDFDLWIKLSSKVYQSESFNKLVRMHIFQFDGQYITLNSEFRKQFITALTGGXVLLNFEYKLIKLFRGNHNSFGVPCTDEDKHLVTVDFLDAYAKETWETILHFMVGTPEAKFPGEGVLSLLKRGGLMSGPKNQLRITRAGFQFLLQDINAQIWTLLLDYLKLSEDTHMDPVQVLHFLFMLGSLDLGRAYSVDFLTDTQQIMLEDLREYGLVYQRKITSKRFYPTRLATGLTTDYRSLHGKQSENDDDKGFIIVETNYRLYAYTSSPLQIAIIGLFANLRARFSNLVVGVITRDSIRRALMNGIAAEQIITYLTTHAHPQMRSNVPLLPPTLVDQIYLWELEKNRLRATPGILFRDFLTDSGFDQAVEYAKELGVLVWDSSLKRMFFITTTGAQPMIAYLKRRAVK

SEQ ID NO: 22567 - protein, 237 aa, Schizosaccharomyces pombe
DPVQVLHFLFMLGSLDLGRAYSVDFLTDTQQIMLEDLREYGLVYQRKITSKRFYPTRLATGLTTDYRSLHGKQSENDDDKGFIIVETNYRLYAYTSSPLQIAIIGLFANLRARFSNLVVGVITRDSIRRALMNGIAAEQIITYLTTHAHPQMRSNVPLLPPTLVDQIYLWELEKNRLRATPGILFRDFLTDSGFDQAVEYAKELGVLVWDSSLKRMFFITTTGAQPMIAYLKRRAVK

SEQ ID NO: 22568 - protein, 292 aa, Schizosaccharomyces pombe
  unsure (1)..(292): unsure at all Xaa locations
MFIINWFYDALAMLGLVNKHAKMLFLGLDNAGKTTLLHMLKVCLTSTLLDYPYTNYLNDRLAVMQPTLHPTSEELAIGNVRFTTFDLGGHQQGMXSQSCFSKSWRFCKSWNVFRIINFFSLKILFCIKLFEFLYRLICRWLVYQWAVLFSXSLFFLCNFFYDFGFSIXFYVFLLIFLXLRRLWRDYFPEVNGIVYLVDCCDFERLSESKAELDALLAMEELARVPFLILGNKIDAPGAISEDELKAALGLYQTTGKGVSKPVPGIRPIEVFMCSVVLRQGYGEGFKWLAQYV

SEQ ID NO: 22569 - protein, 1040 aa, Schizosaccharomyces pombe
MRNNTAFEQFTLNPCEQIPLDDKHNIGFNKNNTPDYSSSASSDQLLKNDINRHEMERRIAFLNRKQALFNAFMHDSSSSLNTMESNIEKVNGLFPNDNSVIALKPNEEKLNSSLSVENNDSTYTDATLIAPKIGLDRPNINAITIDVDGHSLQNEISSSTDKLSPSQSDALFEQKQDSLFWNDNAVIVVSDSESDDNNVRTKSSLNDHDKVNMKEKRNLELAFMNSKRKKLELPSLPVLSTAGPSYTNSLALPPFHHHNNYKMFNTTHTLEDDKFLQGKGTSNNPISLSDEEDNEINFQNKRYGSDSVILPGGLLHDSKLPEPGKHLFHLQWYHDRFHNIEGFNLSDSNNQKVQDDQQQQLEELFKDLDEQLVNDPTIREGTPAGLIPTLMEHQKEGLMWLKRLEESSKKGGILADDMGLGKTVQALALLVTRPPESKSVKTTLIITPVSLLQQWHNEILTKIAPSHRPTVYIHHGSSKKHKIAEQLMSYDIVLTTYNVIAYEFKNKMAYDKSIEDNAPIKKFEHLPFFEAEWYRVILDEAQTIKNRNTLAARGCCLLESTYRWCLSGTPMQNGVEEFYSLIKFLRIKPYSDWSSFSKDFTIPLSSNINTSAPMKRFRGLLKAVLLRRTKNTKIDGKPILTLPPKTAVKSETDLSSSEMEFYNTLQSGAQIQMRKYLQEGTITTHYGSLLVLLLRLRQACCHPWLIVAREAAVDDNDSFQAKNRAIYNQIYPEAVNRLKLIETLQCSLCMDVVAELLIIVPCGHFLCRECLTHVITSSEDMAKQTSNENISPKCSVCEEYIDTERLLSYALFRRYSGMAPIVDADNKLRTENISELLPKQYSNILENRQMGMKIFTDPKHWTTSTKIEKALNAVKEIIKKQPTDKILIFSQFVSFLELFTVPFRQEGIKYLMYTGGLSTAERNQALINFEVDPNVRVLLISLKAGNVGLNLTCANHVIILDPFWNPYIEEQAVDRAHRIGQDKPVNILRIVTNNTIEERVLALQDRKRELIDSALGEKGLREISRLNTKELSFLFGMSSR

SEQ ID NO: 22570 - protein, 993 aa, Schizosaccharomyces pombe
  unsure (1)..(993): unsure at all Xaa locations
MSNSDIRSFFGGGNAQKKPKVSPTVCLFLQSVKFDKLVIHFLTSLSSPTSPKPKRSLKKKRIVLSDDEDGTIENSKVPASKSKVQKRFVXFGLSVYISNPPTSNESEDISHSLPSIVHEDDKLYVYFTFTSLCVVRXFEFLFSVGSDGVSTTPDEYFEQQSTRSRSKPRIISNKETTTSKDVVHPVKTENFANDLDTTSDSKPVVHQTRATRKPAQPKAEKSTTSKSKSHTTTATTHTSRSSKSKGLPRFSDEVSQALKNVPLIDVDSMGVMAPGTFYERAATTQTPGSKPVPEGNSDCLSGISFVITGILETLTRQEATDLIKQYGGKVTGAPSVRTDFILLGENAGPRKVETIKQHKIPAINEDGLFYLITHLPASGGTGAAAQAAQQKKEQEEKKILETVARMDDSNKKESQPSQIWTSKYAPTSLKDICGNKGVVQKLQKWLQDYHKNRKSNFNKPGPDGLGLYKAVLLSGPPGIGKTTAAHLVAKLEGYDVLELNASDTRSKRLLDEQLFGVTDSQSLAGYFGTKANPVDMAKSRLVLIMDEIDGMSSGDRGGVGQLNMIIKKSMIPIICICNDRAHPKLRPLDRTTFDLRFRRPDANSMRSRIMSIAYREGLKLSPQAVDQLVQGTQSDMRQIINLLSTYKLSCSEMTPQNSQAVIKNSEKHIVMKPWDICSRYLHGGMFHPSSKSTINDKLELYFNDHEFSYLMVQENYLNTTPDRIRQEPPKMSHLKHLELISSAANSFSDSDLVDSMIHGPQQHWSLMPTHALMSCVRPASFVAGSGSRQIRFTNWLGNNSKTNKLYRMLREIQVHMRLKVSANKLDLRQHYIPILYESLPVKLSTGHSDVVPEIIELMDEYYLNREDFDSITELVLPADAGEKLMKTIPTAAKSAFTRKYNSSSHPIAFFGSSDVLPMKGSAQREVPDVEDAIEAEDEMLEEASDSEAANEEDIDLSKDKFISVPKKPKKRTKAKAEASSSSSTSRRSRKKTA

SEQ ID NO: 22571 - protein, 329 aa, Schizosaccharomyces pombe
  unsure (1)..(329): unsure at all Xaa locations
MGLAKQKDSQEFAQPVWHYTLAGGISSVICRYGXVAGKXSINDLNXFMIAPFDVIKIRMQITQSSLRPVFKETVQKEGVRALWRGNVVAELLYLVYGAAEFVAFSKLKHLTENLAMNDHAVNFLCGTSAGIFATLTSYPLDTMRTKFASYAKTPHMLPATKKIYAEAGIKGFFPGLKFSVIQIGPYAGCFFMFYRASEAVLSPLGLALSSTLSGVIAGAGSKAIMFPVDTVVKTLQTFPSNYKSFKDCFLSIYRNSGIKGLYRGLSVSMLKVAPGRYECLWLSCHFYYSIIYLLNSMFYLLTFYSLRAITMLIYEQTLQGLRTLSSPEA

SEQ ID NO: 22572 - protein, 550 aa, Schizosaccharomyces pombe
MSFSLASTLPAWQAVQTHYESVGKHLVLKELFAKDSSRFEKFSFTFNGLKEEDGPILFDFSKNLITEETVELLVKLAKEANVEGLRDALFAGEHINFTEDRAVFHPALRNVSEKPMKVNGQDVMPGVRKVLRHMKEFSDAVRSGAWKGYTGKPIKSIVNVGIGGSDLGPVMVTEALKPYGQENLELHFVSNIDGTHLAEALKKCDPETTLFLIASKTFTTAETCTNAKSAKDWFLASAKDPSHVAKHFVALSTNEKEVTAFGISAQNMFEFSDWVGGRYSVWSAIGLSVALYIGYENFEAFLSGAHAMDEYFCSTPLEKNIPALAALISIWYSDFFGAQTHLVAPYDQYLHRFPAYLQQLSMESNGKAITRSGDMVNYTTGKILWGEPGTNSQHSFFQLIHQGTKLIPADFLIPIESHNPIDNNKHHRMLFSNFAAQTEALMLGKTPAEVKAEGTPDEIVPHKTFVGNRPSNSIIAKKITPASLGALIAFYEWVTFTEGAVWNINSFDQFGVELGKKLAKNVLAQLETKGDVENHDSSTNGLINLFKNGF

SEQ ID NO: 22573 - protein, 237 aa, Schizosaccharomyces pombe
LRSFPSVQRTAWQRLVLPSTRKFSLTPTTFDKTPSGRIPPDQKAANIISSVPSTSLLTKSGVLTVTAAALATAISKGIYVVNDESIVVASFLGLVGVFGTLGRKAYNEWSDKTIAKIGGIMQAARNDHTSAIRERIDQVASLQEVESVTQALFHTSKETARMEAEIFELEQRVALAKEAKSVLDSWVHHEANVRAEQQERLVEDVLARVNSKVSTQKFQQDALNESLGEIEKVLASA

SEQ ID NO: 22574 - protein, 539 aa, Schizosaccharomyces pombe
MESRYLSDRRSRFKSKGVFKADELRRQREEQQIEIRKQKREESLNKRRNLNAVLQNDIDVEEEADQSQVQMEQQMKDEFPKLTADVMSDDIELQLGAVTKFRKYLSKETHPPIDQVIACGVVDRFVQFLESEHHLLQFEAAWALTNIASGTTDQTRIVVDSGAVPRFIQLLSSPEKDVREQVVWALGNIAGDSSACRDYVLGNGVLQPLLNILQSSASDVSMLRNATWTLSNLCRGKNPPPNWSTISVAVPILAKLLYSEDVEIIVDACWAISYLSDGPNEKIGAILDVGCAPRLVELLSSPSVNIQTPALRSVGNIVTGTDAQTQIIIDCGALNAFPSLLSHQKENIRKEACWTISNITAGNTQQIQAIIESNLIPPLVHLLSYADYKTKKEACWAISNATSGGLGQPDQIRYLVSQGVIKPLCDMLNGSDNKIIQVALDAIENILKVGEMDRTMDLENINQYAVYVEEAGGMDMIHDLQSSGNNDIYLKAYSIIEKYFSDEDAVEDLAPETENGAFTFGNGPQAQGEFKFDSQDMAM

SEQ ID NO: 22575 - protein, 658 aa, Schizosaccharomyces pombe
MERGTLQPRKKAPNGYGITPIVAHKTGEPVRYEVEDDLRKLKPSRTAPKPPAINTNLAEDTFSGFPLSQSRTTVSRVSLGSRQHSSSSIRKLQTNVSDVRSYDERNQKKSAFENFVSSMSSFLTGGGSSPTSSYGSGSASPRKSTVISSPFDPKHVTHVGFNYDTGEFTGMPTEWQALLKVSGITKSEQVQHPQAVLDAMAFYSQSKKYLEEGAKPPFPRESTEKPLLSVSALSSSSHLQPTSATSSSSRLYPSRPAPTPPASSSSSPLLSSQTVKTTTSNASRQPSPLVSSKSTDNIIRSHSPVLLTPQTLSTSETKHIRPNNSTPYQRRAETSTKPKAVATPQKVEAPSAPRLQKRAPRQQSNDSAVLAKLQSICNPKNPTLLYRNFVKIGQGASGDVYSARQVGTNLSVAIKKMNINQQPKKEFIVNEILVMKSHHHKNIVNFIDTFFYKSELWMVMEYMRGGSLTEVVTNNTLSEGQIAAICKETLEGLQHLHENGIVHRDIKSDNILLSLQGDIKLTDFGFCAQIDSNMTKRTTMVGTPYWMAPEVVTRKEYGFKVDVWSLGIMAIEMVEGEPPYLNENPLRALYLIATIGTPKISRPELLSSVFHDFLSKSLTVNPKQRPSSGELLRHPFLKQAVPVSSLIPLIKSIHHSGK

SEQ ID NO: 22576 - protein, 628 aa, Schizosaccharomyces pombe
MSSSSSKPVNTGLVTPRRYSTMTGIRTGPSQSGTGSIPYSPTSPLSRNFSNYSIPMLRSNSTQTNVNGPTAFDLGVTEKLMSPGTLDRYTRPALYPSKDLDYLKNEYVNYESTTSQQTNSKGLKESNFVGSGIITSIRIRPIGKNQGVWSHGKLSNDPYGREYIRQQTSTSSSTIQQEYLFNNVFGMESKNYDIYKRSVKSVVRNVFSGYNGIVFAYGMTGTGKTYSMQGTENEPGIIPLAMNDLFEMVENNSDDDTFQIRISYLEIYNERIRDLIGNSDEEPRIRENASGEVNVTPLTRVLVTSPEEVSQVIEQCNAIRKTAATDFNTYSSRSHAILQVFLIRNNPTAHTSQISSLSLVDLAGSERASAHHERRKEGAFINKSLLTLGTVISRLSAAANPSLTSNSGHIPYRESKLTRLLQQSLSGQSQISLLATISIESNHTMETTNTLKFASRAQNLPQDIRQAEAVTNVQAELASLHSALEKNAQEVEYYASLVKQLTSDLEERDTYIAMLEAERSQGTAISRARLRMEELLSDHNFEIADLRDELQDKEQIIYALRYAQKQRDIADFNQSLAKFPHKILKKNVTRGSRSSSDQFSNETKTEILPDDQQQSKKDSVTQETQLLS

SEQ ID NO: 22577 - protein, 905 aa, Schizosaccharomyces pombe
MTNQIPSASSAADFGSSKSTSVDAVPNMDKSSSVRRKNIDSNGLQQTNQIEQAESSLNAEADHSEPERYGCTPSGKVFLLPKEQENRRSILETVDPRFSKTPWDWIVISSILAQVLLFFMTTGAVRRYSMMLCFFFWRISYDAGIGFLLHMQSNHRKVVTWISDFGFFDKENHPKLYDLTKKQLISKMDSSYNYDTSPLEFNSWLVFRHFVDLILMCDFCSYILMGLAWTCWPKVNIILQFLRIFGGIALIVFNYWVKMDAHRVVRDYAWYWGDFFFLLRSSLVFNGVFELAPHPMYSVGYAGYYGMSLLTGSYAVLFASILAHAAQFGFLLFVENPHIERTYGTDINHARLSPRGEDNEFELPPEHDLVGFVNFDFTRISDVALLIIALYSIFIILLSSNSHYSQFWAIFQAFVWRFLHSIIHAFILFYQSKSKAWTKHFIRNGESAAYAWSQWKGLYNLTLNMSYISFVMAAWKLYHLPSNWTYGLVSLRHALGFGLIALHIYTSVSIYEDLGQYGWFYGDFFLPSRSPKLVYQGIYRYVNNPERFLGCSAYWGLALISSSAWIFLIAILAQLSNLAIIRLVEQPHMQKVYGNTLRKEAGISKLIKQATSEKGNILPKTVETHMKALTTSVDKVLDQTAEALEEFVNTAPPKVQELLKGTESNLRKNAQLAILKLFAPQLSSSTHFDYKLEIKGIDNNQVLLGHPITVCWTASPNHEINDWIGLYKLSDNASDLYTQTSSEGRWSAIDANGYTSHCSSIKSLSNDKNSGEVEFSGDLLFWETGTFEFRYHYGGKHLVMAKTEPFVITATSMNTTDVDEVSAYLLKSIKFCDPNITPHDGDASLCDISEGSARKLTSIIKYSFGIDLSYRVVQVDGSCSALSRRIVNSLKILQSFDGPSGAKDD

SEQ ID NO: 22578 - protein, 404 aa, Schizosaccharomyces pombe
  unsure (1)..(404): unsure at all Xaa locations
MTDLDLDWQLEELENGRLIPESNVCIIVFIEXLLSPSIXQRSFILVVLCHNYKNGVXRFVVVVELCQRVRDILIEESNIQWISSPVTICGDIHGQLHDLLELFRIGGSCPGTKYLFLGDFVDRGFYSVETFLLLLTLKCKYPKEMTLIRGNHESRQITQVYGFYDECVRKYGSANVWRYCCEIFDYLSLGALVDGKVFCVHGGLSPSISSIDQVCYXFRKFELNFXRFLXRFRLLDRKQEVPHEGAMCDLLWSDPEDISGWGLSPRGAGFLFGADVSEVFNRANDLSFIARAHQLVMEGYKIHFSDKDKQYPKFTNEEDSELDSDSASPVDDSPAPGDIITIPEKDKGSVVTVWSAPNYCYRCGNVASILQLDENQTQSFKIFGTASQERSGIPTKRPIADYFL

SEQ ID NO: 22579 - protein, 535 aa, Schizosaccharomyces pombe
  unsure (1)..(535): unsure at all Xaa locations
QXVHIQAGQCGNQVGAAFWXAKSTLLXRFSQLTLGRSTIADEHGLDSAGMXVYFACFFTDFYVDYHGTSEAQHERLNVYFNEVGFFAFLQVFGCLKLFEKIFFCLFSTDDCRPAGGKYVPRAVLVDLEPGTMDAVKSGKFGNLFRPDNIIYGQSGAGNIWAKGHYTEGAELADAVLDVVRREAEACDALQGFQLTHSLGGGTGSGMGTLLLSKIREEYPDRMMATFSVAPAPKSSDTVVEPYNATLSMHQLVENSDETFCIDNEALSSIFANTLKIKSPSYDDLNHLVSAVMAGVTTSFRFPGELNSDLRKLAVNMVPFPRLHFFMVGFAPLAAIGSSSFQAVSVPELTQQMFDANNMMVAADPRHGRYLTVAALFRGKVSMKEVDEQIRSVQTKNSAYFVEWIPDNGMLLGLKRRLYIXFIFSTCLCSSANLEIVLKAVCSVPPKDLKMSATFIGNSTSIQEIFRRLGDQFSAMFRRKAFLHWYTGEGMDEMEFTEAESNMNDLVSEYQQYQEAGIDEGDEDYEIEEEKEPLEY

SEQ ID NO: 22580 - protein, 1025 aa, Schizosaccharomyces pombe
  unsure (1)..(1025): unsure at all Xaa locations
MSTVSGLKRPQSSEKNHRDRVFVRATRGKVQKVVREQYLRNDIPCQSRACPLCRSKLPKDSRGNGKYXRNPTXVICIGLELVGIIFCEVNFXELLKLIHLLFNFIFFXCEAKFNXLLRXVLEPILSEKPMFLEKFGHHYLIPDSNIFYHCIDALEHPNNFFDVIILQTVFSEISSKSIPLYNRMKRLCQEKTKRFTPFSNEFFVDTFVERLDDESANDRNDRAIRNAASWFASHLASLGIKIVLLTDDRENARLAAEQGIQVSTLKDYVQYLPDSEILLDMVSAIADAIASKEQVESGTKNVYELHWSMSRLLACIKNGEVHKGLINISTYNYLEGSVVVPGYNKPVLVSGRENLNRAVQGDIVCIQILPQDQWKTEAEEIADDDEDVVVSTAAEPDSARINDLELITKRNAHPTAKVVGILKRNWRPYVGHVDNATIAQSKGGSQQTVLLTPMDRRVPKIRFRTRQAPRLVGRRIVVAIDLWDASSRYPEGHFVRDLGEMETKEAETEALLLEYDVQHRPFPKAVLDCLPEEGHNWKVPADKTHPLWKNRKDFRDKLICSIDPPGCQDIDDALHACVLPNGNYEVGVHIADVTHFVKPNTSMDSEAASRGTTVYLVDKRIDMLPMLLGTDLCSLRPYVERFAFSCIWEMDENANIIKVHFTKSVIASKEAFSYADAQARIDDQKMQDPLTQGMRVLLKLSKILKQKRMDEGALNLASPEVRIQTDNETSDPMDVEIKQLLETNSLVEEFMLLANISVAQKIYDAFPQTAVLRRHAAPPLTNFDSLQDILRVCKGMHLKCDTSKSLAKSLDECVDPKEPYFNTLLRILTTRCMLSAEYFCSGTFAPPDFRHYGLASPIYTHFTSPIRRYADVLAHRQLAAAIDYETINPSLSDKSRLIEICNGINYRHRMAQMAGRASIEYYVGQALKGGVAEEDAYVIKVFKNGFVVFIARFGLEGIVYTKSLSSVLEPNVEYVEDEYKLNIEIRDQPKPQTVQIQMFQQVRVRVTTVRDEHSGKQKVQITLVY

SEQ ID NO: 22581 - protein, 468 aa, Schizosaccharomyces pombe [sequence omitted]

SEQ ID NO: 22582 - protein, 139 aa, Schizosaccharomyces pombe
  unsure (1)..(139): unsure at all Xaa locations
MSSQSYRERTLVSVIGDDDTVTGMLLAGTGQVNENGDKNFFIITQSKIICXKMESCFRXLAVLCRTTDEQIAEAFDDYTTKRKDIAIVLINQFAAERIRDRIENHVQAFPAVLEIPSKDDPYDPEKDSILRRVRKIIGE

SEQ ID NO: 22583 - protein, 385 aa, Schizosaccharomyces pombe
MSGYGQQGVSAANIDSIRPKKRLSIGVVGSGNWGTAIAKICGENARAHGHHFRSKVRMWVFEEEIEYKGEKRKLTEVFNEAHENVKYLPGIECPPNVIAVPDVREVARRADILVFVVPHQFIERVCDQMVGLIRPGAVGISCIKGVAVSKEGVRLYSEVISEKLGIYCGVLSGANVANEVAREQFCETTIGFNPPNEVDIPREQIAAVFDRPYFSVVSVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 22584 - protein, 1093 aa, Schizosaccharomyces pombe
SNTPDANAYIRSGHIKAAEHEKVKKVVVVGSGGLSIGQAGEFDYSGAQAIKALRESSVHTILINPNIATIQSSHSLADEIYFLPVTAEYLTHLIERENPDGILLTFGGQTALNVGIQLDDMGVFARNHVKVLGTPISTLKTSEDRDLFAKALNEINIPIAESVAVSTVDEALQAAEKVSYPVIIRSAYSLGGLGSGFANNKEELQSMAAKSLSLTPQILVEKSLKGWKEVEYEVVRDAANNCITVCNMENFDPLGIHTGDSIVVAPSQTLSDEEYHMLRTAAIKIIRHLGVVGECNVQYALSPNSLEYRVIEVNARLSRSSALASKATGYPLAYTAAKIALGHTLPELPNAVTKTTTANFEPSLDYVVTKIPRWDLSKFQYVNREIGSSMKSVGEVMAVGRTFEESLQKALRQVDPSFLGFMAMPFKDLDNALSVPTDRRFFAVVEAMLNQGYSIDKIHDLTKIDKWFLSKLANMAKVYKELEEIGSLYGLNKEIMLRAKKTGFSDLQISKLVGASELDVRARRKRLDVHPWVKKIDTLAAEFPAHTNYLYTSYNASSHDIDFNEHGTMVLGSGVYRIGSSVEFDWCGVSCARTLRKLGHSTIMVNYNPETVSTDFDECERLYFEELSYERVMDIYEMETASGIVVSVGGQLPQNIALKLQETGAKVLGTDPLMIDSAEDRHKFSQILDKIGVDQPAWKELTSVAEASKFANAVGYPVLVRPSYVLSGAAMSVIRDESSLKDKLENASAVSPDHPVVITKFIEGARELDVDAVASKGKLLVHAVSEHVENAGVHSGDATIALPPYSLSEDILSRCKEIAEKVCKAFQITGPYNMQIILAQNPDKPDTPDLKVIECNLRASRSFPFVSKTLGVNFIDVATRSIIDQEVPAARDLMAVHRDYVCVKVPQFSWTRLAGADPYLGVEMSSTGEVACFGKDVKEAYWAALQSTQNFKIPLPGQGILLGGDRPELAGIAADLSKLGYKLYVANKDAAKLLQPTSAEVVEFPVKDKRALRAIFEKYNIRSVFNLASARGKNVLDQDYVMRRNAVDFNVTLINDVNCAKLFVESLKEKLPSVLSEKKEMPSEVKRWSEWIG

SEQ ID NO: 22585 - protein, 391 aa, Schizosaccharomyces pombe
EVYIVSAVRTPMGSFGGSFASLPATKLGSIAIKGALERVNIKPSDVDEVFMGNVVSANLGQNPARQCALGAGLPRSIVCTTVNKVCASGMKATILGAQTIMTGNAEIVVAGGTESMSNAPYYAPKNRFGAKYGNVELVDGLLRDGLSDAYDGLPMGNAAELCAEEHSIDRASQDAFAISSYKRAQNAQATKAFEQEIVPVEVPVGRGKPNKLVTEDEEPKNLNEDKLKSVRAVFKSNGTVTAANASTLNDGASALVLMSAAKVKELGLKPLAKIIGWGEAAQDPERFTTSPSLAIPKALKHAGIEASQVDYYEINEAFSVVAVANTKILGLDPERVNINGGGVAMGHPLGSSGSRIICTLAYILAQKDAKIGVAAVCNGGGGASSIVIERV

SEQ ID NO: 22586 - protein, 306 aa, Schizosaccharomyces pombe
MSKTAASSAVDASQAGTVKVGDMVVNRMGFGAMRVTGDGIWDEPKDKEACIATLKRLPELNINFIDTADSYGPEVSENLLREALYPYKGLIIATKGGLVRTGPNEWHPCGAPKFLRQEVLMSMRRLGVKQIDLWQLHRIDPKVPRKDQFSEIAAMKKEGLIRHVGLSEVTVDDIKEAEQYFPVVSVQNLFNLVNRKNEKVLEYCEQKGIAFIPWYPLASGALAKPGTILDAVSKDLDRSTSQIALSWVLQRSPVMLPIPGTSKVDHLEENVKAAGIQLSSEVFAKLDEEGKSEDAKRQEEEKKKSS

SEQ ID NO: 22587 - protein, 404 aa, Schizosaccharomyces pombe
  unsure (1)..(404): unsure at all Xaa locations
MFTNNFSQKQILGVSKDASESEIRKAYRQLTKQWHPDKNPXVKQACKQMKAXSXXMFXGNEEAQEKFIEINKAHEVLSDPEQRKIYDAYGEEGLNGQPGGPGGGPGEGFPGGGFGFDPFGDIFDNIFGGRRRQNAVRRGPSMEQIVQIHLSSFYTGGSFTLEIPVKRTCSVCSGQGFNPKYSADKAIESCPVCGGSGFRVIEHMIAPGFRQQMRMPCNACNGNGRTIKHKCPRCKGERVAEVVESFDIKVPAGAPEGYRIGFRGKADEIPGMEAGDIIVILEAAGGDYGWTRKDNDLYRKETISVREALLGNWKRKIQKLDGSFMEVKRSAGEVVHPGETERVKNQGMPIYNLHKGKTTSAHGSAYIEWEVKFPKKLKGKFLKGMLHLADYISFVKLTNVFRPQ

SEQ ID NO: 22588 - protein, 474 aa, Schizosaccharomyces pombe
  unsure (1)..(474): unsure at all Xaa locations
MSGQNNVVGVHYKVGRRIGEGSFGVIFEGTNLLNNQQVAIKFVSENPFDAMLXSWIFFLFPSLLIDFAYREPRRSDAPQLRDEYRTYKLLAGCTGIPNVYYFGQEGLHNILVIDLLGPSLEDLLDLCGRKFSVKTVAMAAKQMLARVQSIHEKSLVYRDIKPDNFLIGRPNSKNANMIYVVDFGMVKFYRDPVTKQHIPYREKKNLSGTARYMSINTHLGREQSRRDDLEALGHVFMYFLRGSLPWQGLKAATNKQKYERIGEKKQSTPLRELCAGFPEEFYKYMHYARNLAFDATPDYDYLQGLFSKVLERLNTTEDENFDWNLLNNGKGWQSLKSRNAETENQRSSKPPAPKLESKSPALQNHASTQNVVSKRSDYEKPFAEPHLNSASDSAEPNQNSLPNPPTETKATTTVPDRSGLATNQPAPVDVHDSSEERVTREQVQNATKETEAPKKKKSFWASILSCCSGSNEDT

SEQ ID NO: 22589 - protein, 409 aa, Schizosaccharomyces pombe
  unsure (1)..(409): unsure at all Xaa locations
FDNQPICIDNVCQTLFSRLFPVKLSSYIDKTIXGSGFIKAGFAGDDIPKCLFPTWYEVYFSYXILIYSVGRIKHERVMPSSIQKDMFVGSEAQNLRGLLKIQRPIERGIIQNWSDMEEIWSYIYSDQQLNTLPEEHPLLLTEPPLANIRNKEKIAEYFYETLNVPALSFSLQPVLALYASARTTGIVLECGDGLTHSVPIYDGFSIPSAIQQEEIGGRDVTDYLQLQLRKSGHELVSSAEKEIVREIKEKCCYVASDFRSEIESWTEHKPQIHTYQLPDNQTITLGTECFSAPEVLFNPEMMGSEASGLHIQLFKSILLSDIDLRSTLYSNIVLSGGSTLLRGFGERFISELRAISGKKNQVKIYASPERMHNAWLGGSILASLSTFRRLLITSEEYKNDQNVIFRRRF

SEQ ID NO: 22590 - protein, 809 aa, Schizosaccharomyces pombe
MSVAIKFTVKINDGSLRRQQTRHVFLSPAALNRLKLSPSQVIYLKHKGGEAVGITQSVKGNGIGPFEILISPLLAKWANLKAFQRVNISQYVHPLKEAEGIKIVASLSSNNEPIPESLIRKELLEIRYLHPGMIVMGESPMNMAKSGSKNLSSENMATEIFEINSGLSAQSGTEVGSSQSSPSVNESEPKATEDLDELSPGSYKVKEIHIRSPSNLIEAISDMSLDEPRIYKFTAASSMEIETPDLLKLPHEDRTQSAYNQGSEETQNFDGPPSAVTFSSIGGLQAQIAQIRDIVELPFQNPELFKFFNIMPPRGVLLYGPPGTGKTMVMRAVAAEANAQVFTIDGPSVVGKYLGETESRLRKIFEDARAHQPSIIFIDEIDALAPKRTEDVSEAESRAVATLLTLLDGMANAGKVVVIAATNRPNSIDEALRRPGRLEKEIEIGIPDKSARLDIIKLLLSGVPNEINDAQLEDLASRTHAYVGADLAAVVREAALRAIKRTISLQKDTSGLDIFGAVQMDDLEFALSSVRQSAMREFMMESPNVHWSDIGGQEEVKQKLKESVEWPLTHGETFSRLGVRPPKGVLLYGPPGCSKTITAKAIATETGLNFIAVKGPELFDKFVGESERAVRQVFQKARQASPSVIFFDEIDALTANRGEDNSSDRVVAALLNELDGIEALRNVLVLAATNRPDMIDPALMRPGRLDRLLYVGPPNFEARKQIVKIQAEKMKFAEDVDLDLIAEKTEGCSGAEVVALCQEAGLIAMHEDLEAKEICQAHFKTALLALRKAITRDMLEYYASFSESVTSIS

SEQ ID NO: 22591 - protein, 415 aa, Schizosaccharomyces pombe
MLRFLKPFPLRFGKRFYSKVPPVTNHERILPKQPSFPTAPAQNEIATLTIRNGPIFHGTSFGANRNVSGEAVFTTSPVGYVESLTDPSYKQQILIFTQPLIGNYGVPDCKKRDENGLLRHFESPHIQCAGVVVNDYATKYSHWTAVESLGEWCAREGVAAITGVDTRAIVTFLREQGSSLAKISIGEEYDANDDEAFINPEEVNLVSQVSTREPFFVSGGDGMLNIAVIDCGVKENILRSLVSRGASVTVFPFDYPIQNVASNYDGIFLTNGPGDPTHLTKTVNNLRELMNTYNGPIMGICMGHQLLALSTGAKTIKLKYGNRGHNIPALDIASGNCHITSQNHGYAVDASTLPAEWKATWTNLNDQSNEGIAHVSRPISSVQFHPEARGGPMDTFYLFDNYIKEAIKYQKSRTA

SEQ ID NO: 22592 - protein, 526 aa, Schizosaccharomyces pombe
MARETEFNDKSPSSTDDGMSQSHFSDKLKNLFHFRRNRAATVSTSVRNDQRDNDSDDSTFDINVNQLNELDLNDSSDQLDSRPSLRRVSSAPDSHKGVEAPPPRPLINMSNIRKAQVKILKNPGNYIFGRTEYGKRTYSGNSTKISRVEVTPHSFEKIRLLGQGDVGKVYLVRQKSNHRLFAMKILNKREMIKRHKVNRVLAEQEILTKSKHPFIVTLYHSFQSRDYLYLCMEYCAGGEFFRALHSLPKHILPEKDACFYAAEVTAALEYLHLMGFIYRDLKPENILLHQSGHIMLSDFDLSKPISIVTHPTVVLPKHSTFSQEKPALDTNSYFSNFRTNSFVGTEEYIAPEVIRSCGHTVAVDWWTLGIFIYEILYGTTPFKGKNRHATFSNILYSDVSFPEYHGAPNVSSTCKSLIRRLLVKDESKRCGSVAGASDIKQHPFFRHIQWALLRSMKPPIIPKIEDGMEAVEPSDNDNEEEDFLNSQYLISANLPAVDMHSSTPVNEQSNPFDSFSSVTLHHAGDE

SEQ ID NO: 22593 - protein, 414 aa, Schizosaccharomyces pombe
MSLSTKLAITDVDLKGKNVLIRVDFNVPLDGDRITNNARIVGALPTIKYALEQQPKAVILMSHLGRPNGARVAKYSLKPVAAELSKLLGKPVKFLDDCVGPEVEKACKEAKGGEVILLENLRFHIEEEGSAKVDGKKVKADASAVEAFRKSLTSLGDIFVNDAFGTAHRAHSSMVGVDLPRVSGFLMKKELDYFSKALENPARPFLAILGGAKVADKIQLIDNLLDKVNRLIICGGMAFTFLKVLNGMKIGDSLFDEAGSKNVESMMAKAKKNNVEVFLPVDFVTADKFDKDAKVGSATAEEGIPDGWMGLDCGPKSSAKFAEVITTSKTIVWNGPAGVFEFDNFAKGTKSMLDACVKTCEAGNVVIVGGGDTATVAKKYGKEDALSHVSTGGGASLELLEGKALPGVVALSSK

SEQ ID NO: 22594 - protein, 382 aa, Schizosaccharomyces pombe
MAQTFLFTSESVGEGHPDKICDQISDAILDACLKDDPFSKVACETASKTGMVMVFGEITTRSQIDYQKVIRNTIKSIGYDDSEKGFDYKTCNVLVAIEQQSPDIAQGLHYEKALEELGAGDQGIMFGYATDETPEKLPLTILLAHKLNAAMSVARRDGSLPWLRPDTKTQVTIEYEEENGAVIPRRVDTIVVSAQHADSISTEDLRSEILEKIIKPTVPAHLLDEKTVYHIQPSGRFVVGGPQGDAGLTGRKIIVDTYGGWGAHGGGAFSGKDYSKVDRSAAYAARWIAKSLVAAGLARRCLVQLSYAIGVAEPLSIFVNTYGTSSKTSAELVEIIRKNFDLRPGVLVKSLKLQTPFYLSTASYGHFTDQSKPWEQPKELKF

SEQ ID NO: 22595 - protein, 473 aa, Schizosaccharomyces pombe
MAKEALELKNEANKFLKEGHIVQAIDLYTKAIELDSTNAILYSNRSLAHLKSEDYGLAINDASKAIECDPEYAKAYFRRATAHIAIFQPKEAVGDFRKALALAPSDPAARKKLRECEQLVKRIRFQEAIHNTEPPSPLANINIEDMDIPSDYDGVILEKQITKEFVEDMKERFCQGKKLPLKFAYSILRDLKELLEKTPSLIDIPVKGDETLVICGDTHGQYFDLLNIFKLHGPPSPTNKYLFNGDFVDRGSWSTEVAFTLYAYKLLYPDAVFINRGNHETDDMNKVYGFEGECRSKYNERTFNIFSETFSLLPLGSLISDSYLVVHGGLFSDDNVTLDQLRNIDRFSKKQPGQSGLMMEMLWTDPQPAPGRGPSKRGVGLQFGPDVSKRFCEANGLKAVIRSHEVRDQGYEVEHDGYCITVFSAPNYCDSTGNLGAVIKVKEDMELDFHQFEAVPHPNIRPMAYANGLLSGM

SEQ ID NO: 22596 - protein, 340 aa, Schizosaccharomyces pombe
MPMNSVLVIGSGFLGGHIIRQLCERENLRIAAFDLFENEKLLHELHGQFTMYTGDLTKQGDIERVFEEFHPRVVIHTASPVHNLARDIYFEVNVDGTANIIKACQKFNVDALVYTSSAGVVFNGADLINVDESQPIPEVHMDAYNESKALAEKQVLEASSESLKTAALRVAGLFGPGDRQLVPGMLSVLKNGQTKFQLGDNLNLFDFTYIENAAYAHLLAMDNLLSSNPTANGQVFFITNGQVIYFWDFARAIWAHAGHVPPYIIKFPRPVGMLLATAAEWVCYFLKKEPGFTRFRVQFSCANRYFNIQKAEDVLKYHPIVDLEEGIRRTLAWMDTEKKH

SEQ ID NO: 22597 - protein, 811 aa, Schizosaccharomyces pombe
MDQDYEELRAKFTKIGLNETTVKDTLKNKKLSSSLNKVIEETNVGSSGCDRTIGNLLFTLANASLKQKDPKSNAHEAFIASKIVSGDLKTNLQVNAAITYCKDKDTIDESEFDKETGVGVVLTPEQIEQLVGDYVAENKSKILEQRYQLLNPSASALRQHALLKWAPQLEVKQTLDRKFLELLGPKTEQDAAAGKKKGAKAKNSKQKTVDSGKAKEQKIVSEQSKKYNMFEEGFLAKLHKPGGNTQLIPERMKEHLQATGGGVVTRFPPEPNGYLHIGHSKAIAVNFGFARYHNGVCYLRFDDTNPEAEEERYFESIKDLVAWLGFQPYKITYSSDYFDKLYELAEELIKRDKAYVCHCTDAEIKKARGGEERGPRYACVHRDRPIEESLLEFRNMRDGKYQPKEAILRMKQDLSDGNPQMWDLIAYRVLNSPHPRTGDKWKIYPTYDFTHCLVDSFENISHSLCTTEFILSRVSYEWLCNALEVYCPAQREYGRLNVVGTLMSKRKIMKLVKEGYVHGWNDPRLYTLVALRRRGVPPGAILEFVSEVGVTTAVSNIEVARFENCVRKFLENSVPRLMFLPDPIKVTLENLDDSYREQIEIPFNPKDPSMGSRSAFLTKHIYIDRSDFREEASSDFFRLTLGQPVGLFRASHPVVAKRVVKNDEGEPIEIIAEYDASSSKKPKTFIQWVSRDKESNSPVLIAETRLFNNLFKCDNPAALKEQELAAQLNPESEVVLKNSIIEPGIYDLIKSAPWPKTDSSAGVDKAENPESVRFQAMRVGYFCLDEDTKKPNHLVLNRIVSLREDSAKNKN

SEQ ID NO: 22598 - protein, 318 aa, Schizosaccharomyces pombe
MINIVVLGSMNTDLVMRTKICPSGGETIHGEPDGFSTGNGGKGANQAVAVARLSNPADTKVSMLGCVGDDAFGVEMLSGLKKDGVNVDNVKKIENKSTGVAMIIVEETGENRILLSEGANGNVDTAFVKAMEQRISTCNLLIMQLEIPLEAVEIALQIAHKHGVDVLMNPAPAIPLSHDMISYCAYLVPNEHEAAILLNQADSPATLENVDAYASKLLSFGVRKAVIITLGSQGAYYKSANGESALVSACKVKAVDTTAAGDTFIGAFSNSIAHGQPLKDSLEFAAKCSAITVQRKGAASSIPSLLEVDGSFNLKKNT

SEQ ID NO: 22599 - protein, 548 aa, Schizosaccharomyces pombe
  unsure (1)..(548): unsure at all Xaa locations
MISKLLKIVLLTAGVIGNTLADSRIHEQYLVKAFPNEPVDYEGRMHAGHLNQTDQLDGDLFFWMFESVKPEYEHRSVSISSECFXIKLYIIQITNLIKILWLNGGPGCSSEDGSLMEVGPFRLDDNNTFQLNPGRWDELGNLLFVDQPLGTGYSYSLAKDFQSNNEKMANDFSIFFEKFLEEFPERANDEWFIAGESFAGQYIPHIAAKLKEKNLVNLGGLAIGNGWINPLSHYETYLNYLVEKGMVDFESELGQYLHHSWAECLLAFDKIGSGSGDLSKCESFLGDILYMVSKEPGKACMNMYDISLESTYPTCGMDWPYDLSYLTEFLSVCLXLYDNISFTNIVRLREAMTSLNVNLEKVHDWEECNDDVALQYAREGIESSSKLIQDLVSTVPILLFYGENDFLCNYLSGEKLTRSLEWNGAVGFQNQSAQPFYLPGYSDQPSGSYVSSRNLTFARIVEASHMVPYDHPNEMKTLITAFFNNDFASLPSVPKPSPDLGNGNYKWLYLGLIPVALTIIILFSIYLCRRFGLFGLSKQRYQPISPTP

SEQ ID NO: 22600 - protein, 696 aa, Schizosaccharomyces pombe
  unsure (1)..(696): unsure at all Xaa locations
MRVLCVAEKNSIAKSVASILGGGHVRRVCXKIXSFLKFTNLLRRDTRSKYVKNYDFSFNFGGNVGSSDVTMTSVSGHLTEASFPSEYSSWSSVPQDVLFDAQIITSVSKNAEVLADNIKKEARNAQYLYIWTDCDREGEHIGVEISNVARASNPSIQVIRADFNNLERSXVINILAFXKADIYLLQKKPFKINANXFSDIIISAAKRPRDVSKNAADAVDARIELDFRLGAIFTRLQTIQLQKSFDILQNKIISYGPCQFPTLGFVVDRWQRVEDFVPETYWHLRFVDKRQGKTIQFNWERAKVFDRLTTMIILENCLECKTAKVVNITQKPKTKYKPLPLSTVELTKLGPKHLRISAKKTLEVRFDYKXICNFNIIFISSPENLYTNGFVSYPRTETDQFDSSMNLHAIIQKLTGAQEWDSYAEGXIXFFLXWLPXXLMLGFWLGDYRPPRKGKHNDRAHPPIHPVQMVHRSALPSQDHWKVYELITRRFLACCSDNAKGAETLVQVKMEEELFSKKGLLVTEKNYLEVYPYEKWESSDQLPEYRLHEEFQPHILDMMDSSTSSPSYITEPELIALMDANGIGTDATMAEHIEKVQEREYVIKRKKRGQGVTEFVPSSLGVALAKGYDEIGLEWSLTKPFLRKEMEVQLKNIENGQLNRNVLVHMILTQFRDVFHLTKQRFDCLKNVSQIIIVSY

SEQ ID NO: 22601 - protein, 424 aa, Schizosaccharomyces pombe
MAKGAVKKEKFEYEFFGPIGALGVTVLTTVVSFGSFYICNEEGCPAKFSKISHIFKKTPLFDQKSLILYLLWFSTLTLLWKCTNGKWAKGTPIDDKGTRLLYKINGFNSACLILGVVCTSIYLLGASCMEFIWDNFLQLMFAAYVFSVVLCTFCYVQSFFGKQQLAKGGTSGNILFDWFIGRSLNPRIGNFDIKCFCELRPGLILWVVFDIAFACHQYLVLGGRITDSMVLVIIFHTWYVLDSLINESAVLTTMDITTDGFGYMLSFGDLVWVPFLYSLQARYLAFHPVDLGLVKTLAILCLQFLGYYIFRGANGQKNRFRSNPNDPKLKHLKFIQTKRGTKLLTSGWWGMARHINYFGDWIMAWAWCLPAGFGSPIPYFYVAYFGVLLVHRNARDDHKCRVKYGEDWEKYCKAVKYRIIPYVY

SEQ ID NO: 22602 - protein, 364 aa, Schizosaccharomyces pombe
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAA

SEQ ID NO: 22603 - protein, 347 aa, Schizosaccharomyces pombe
MSSETKSEFGTKSAWLYNRTGKPKDVLYLEKGLHIPNPAELGPYDVLVEVVATSINPLDYKLMNTYQMIAKALFKLPNIPGYDFAGRVLAVGSEVKEFSATQRVWGCQSFPRAGRQGGSCATHIVTGDKDVWHLPDGVSFNEGAGFGIAGLTAWEVLVRQMKVKPGTKLVIEGASGGVGTFAVALAKALECEVTTISSTENLDLCKSLGATHTLDYKKDNLVERLADLGPYDFVFDCVNDNVLYRASSKFVKPDGAFFGIGGDITLSYVGSRLSRTLRPRVLGGSSHSYYNILLHVDQEMLRDFVDFVMKHNIKTVIDSVYDFEDTVEAFNRLMTHRCKGKVIIKTD

SEQ ID NO: 22604 - protein, 302 aa, Schizosaccharomyces pombe
DSKVRIYEVQATGQSIGKALYEHQGPVLSVNWSRDGTKVASGSVDKSAKVFDIQTGQNQQVAAHDDAVRCVRFVEAMGTSPILATGSWDKTLKYWDLRQSTPIATVSLPERVYAMDCVHPLLTVATAERNICVINLSEPTKIFKLAMSPLKFQTRSLACFIKGDGYAIGSVEGRCAIQNIDEKNASQNFSFRCHRNQAGNSADVYSVNSIAFHPQYGTFSTAGSDGTFSFWDKDSHQRLKSYPNVGGTISCSTFNRTGDIFAYAISYDWSKGYTFNNAQLPNKIMLHPVPQDEIKPRPKKGR

SEQ ID NO: 22605 - protein, 485 aa, Schizosaccharomyces pombe
  unsure (1)..(485): unsure at all Xaa locations
MREVISVHVGQAGVQIGNGMFNIHLFVLLYTLNSWQSIFSXKIXLTFLACWELYCLEHGIGPDGFPTENSEVHKNNSYLNDGFGTFFSETGQGKFVPRSIYVDLEPNVIDQVRTGPYKDLFHPEQMVTGKEDASNNYARGHYTVGKEMIDSVLERIRRMADNCSGLQGFLVFHSFGGGTGSGLGALLLERLNMEYGKKSNLQFSVYPAPQVSTSVVEPYNSVLTTHATLDNSDCTFMVDNEACYDICRRNLDIERPTYENLNRLIAQVVSSITASLRFAGSLNVDLNEFQTNLVPYPRIHFPLVTYSPIVSAAKAFHESNSVQEITNQCFEPYNQMVKCDPRTGRYMATCLLYRGDVIPRDVQAAVTSIKSRRTIQFVDWCPTGFKIGICYEPPQHVPGSGIAKVNRAVCMLSNTTSIAEAWSRLDHKFDLMYSKRAFVHWYVGEGMEEGEFSEAREDLAALERDYEEVGQDSMDNEMYEADEEY

SEQ ID NO: 22606 - protein, 522 aa, Schizosaccharomyces pombe
  unsure (1)..(522): unsure at all Xaa locations
MPPKEDWEKYQKPVDTEEENDKNPPPLDEGDIELLKSYVSYINDXICHQQHTKCQCRATGPYARELAAIKEDTEAVLKRINDTVGMFYVEKAVARCCLMNGVPVVHIADMNYKIXHSXTGCIFTIFYHVKCSHFIXNLLNPLFYCXLALGIKESDTGLAPISFWDVAADRQRMSEEQPLQVARCTKIIENEQSAEKNAYVINLKQIAKFVVSLGERVSPTDIEEGMRVGCDRNKYAIQLPLPPKIDPSVTMMQVEEKPDVTYGDVGGCKEQIERLREVVELPLLSPERFVKLGIDPPKGIMLYGPPGTGKTLCARAVANRTDATFIRVIGSELVQKYVGEGARMVRELFEMARTKKACIIFFDEIDAIGGARFDDGAGGDNEVQRTMLELITQLDGFDPRGNIKVLFATNRPNTLDEALMRPGRIDRKVEFGLPDLEGRAHILRIHAKSMAIDKDIRWELIARLCPSQTGAELRSVCTEAGMFAIRARRRVATEKDFLDAVQKVVKGNQKFSSTADYMNMSS

SEQ ID NO: 22607 - protein, 460 aa, Schizosaccharomyces pombe
MASSQKLWGGRFTGATDPLMTAYNESIHYDKRMFNADIDGSKAYAKALEQRGIISADELDKMLDGLEAVRDEWKTNKFTLQPSDEDIHTANERRLGEIIGTGIAGKLHTGRSRNDQVTTDMRLWLRDELDIIQKSLVGLLQVFVARAESDLDIIMPGYTHLQRAQPIRWSHFLLSHAFSILNDLDRLKQIYSRVNRLPLGAGALAGNPFAVDRKFLQKELGFEGVIMNSMNAVADRDYVIEFMFWASMVMTHISRLAEDLIIYSTSEFNFVTLSDAYSTGSSIMPQKKNPDSLELLRGKSGRVFGNMMGFMVSVKGIPSTYNKDLQEDKEPLFDSSKTVLDSIQILTGVLSTLTVNPENIAKSLTADMLATDLAEYLVRKGVPFRETHHISGSAVRMAEERNTTIDKLSVEDFKSLHPLYEEDVADVFNYESSVEKRCAIGGTAKSCVLEQIQTIKKALE

SEQ ID NO: 22608 - protein, 106 aa, Schizosaccharomyces pombe
  unsure (1)..(106): unsure at all Xaa locations
MSSTFEQAAADVKELKETPNSDELLKVFFSXPPFFVAXLTNLLYXLYALFKQATVGDNNTEKPGLLDLKGKFKWNAWEELKGKSKEDAASEYISFVDELKTKYGMK

SEQ ID NO: 22609 - protein, 352 aa, Schizosaccharomyces pombe
IQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPDGTSRFSCRDKTLLHYMGCSSFSQYTVVADISLVAISHSAPLRSICLLGCGVTTGFGAVTHSAKVESGSTVAVVGCGCVGLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 22610 - protein, 316 aa, Schizosaccharomyces pombe
  unsure (1)..(316): unsure at all Xaa locations
MGNSLFKGFSKPFSRLFSNKEMRILMLGLDAAGKTSMFFIRMDFYSLHSVXSCLTWCFNNGNSFINILAILYKLKLNQRXRALNSILRLCQGIVCAASVLAXXIXISLRRLLVNXSVKSTVAHYLELQLCFRKXNXFFLCSLTNSSVVTIPTVGFNVETVTYKNIKFNVWVYLXSILGRACSNVDLFVGVGGQDKIRPLWRHYFTGTKGLIFVVDSADSNRISEARQELHRIISDREMRDCLLLVLANKQDLPGGKVANPNNLCXHYGSSSPAQITDVLQLDKLKDRLWNVQPTCALTGDGLLEGLAWLSQNAKLK

SEQ ID NO: 22611 - protein, 323 aa, Schizosaccharomyces pombe
  unsure (1)..(323): unsure at all Xaa locations
MAQPQNVPTFKLVLVGDGGTGKTTFVKRHLTGEFEKKYIATLGTFYDFTLLEQFLYTGNDAXYRKXMPSFYETYSYLYSCIIGFQLLFLCLDLSFRNNSLTYFXGVEVHPLHFHTNFGEICFNVWDTAGQEKLGGLRDGYYIQGQCGIIMFDVTSRITYKNVPHWWRKXYLSKKKLXMFFLILIDRXIXWLXVYXHXLFLTTLMNITNRMQVILVRVCENIPIVLCGNKVDVKERKVKAKAITFHRKKNLQYYDISAKSNYNFEKPFLWLARKLVGNPNLEFVASPALAPPEVQVDQQLLAQYQQEMNEAAAMPLPDEDDADL

SEQ ID NO: 22612 - protein, 936 aa, Schizosaccharomyces pombe
  unsure (1)..(936): unsure at all Xaa locations
MASQRFVIALHSFPGKSSDELPLVEGRKYLLIKMDEEFGDGWWEVSIXLRSQNPIIFIPGIFYNLKDSXCLLCTVFQSTXRCKHYMSKLHALRIVKPXYIFIILTKFXXGEDEQGNRGIFPASHVELISDERSDSSDSRRGKEDFSISTAEVTRSSLSSSRSTSSRSDKDSEKLYSNNSLSSSHSSILNGPLDSLSKPSVPSNFNSMFPSSKQEGPSPLLDNQPSSDLSNFNTIDADYNNASASTSAPATSASLKKVLSAEDSVRETITDIETALQNMSTSASRTPNDSSPLPYIENRPASSLAVSEKIQNVPNWSTEEVVEWLMNAGLGSVAPNFAENEITGEILLGLDSNVLKELNITSFGKRFEVLRKIQQLKDSYEQSLYEEYPQFAEPISVSQSSDSSSSIPKKSNDEAGGSPSKSSPTRPGFNDYVNRPTSVMPSLSNMIVSPDLDSSPSTDWNQYVIPPLATPSSRNSKSTQSAVPENVSRFDSNEPSATSPILKRSSPTDSISQNSGLPSRLTEPISSPSTSSIDVDKEGTSFPGLPYHSSKGNLYAPQPSSNVPTKFTGGASESSSVPPRPIPSAMKGKAPASAISIEALEELDPPKITTIDGESPSSISSRLPSSNLEQGSSSSVTKSPESMPDPSAKASSPVTSKGVSINEKSAVNNYATPLSKPQPKDTKGSKLGNTFVAPSPAASLPASPPVGTELKTRPTLRSVASSPLNKEPIGKRKSKRDIFGRQKVLPTGISEGLSNIPAKEAIKTADCHGWMRKRSDRYGVWKSRYFVLKGTRLSYYHSLNDASEKGLIDMTSHRVTKTDDIVLSGGKTAIKLIPPAPGAAKAAVMFTPPKVHYFTCENNEELHRWSSAFLKATVERDMSVPVLTTSRMPTISLSKAKELRTRPPSLLIDDENEANLTSSIGLKKNAKQKNKKSSKQK

SEQ ID NO: 22613 - protein, 418 aa, Schizosaccharomyces pombe
  unsure (1)..(418): unsure at all Xaa locations
MDKRKESESATNGHLVCSIAKKTCTNINRVKRIRIQDSSLITEGSVLQRTSDLNVPNLQMFGHTVWLYXNKSYXRFRLEVLVARFDPSGSYFASGGMDRQIRKAAVIKMLIYNNCGLVLWNVFGDVKNYGVLNGCKGAITDLQWSRDSRVVYCSSSDTHLMSWDAVSGQKIRKHKGHAGVVNALDVLKVGSELLTSVSDDCTMKVWILLLKYGIVTKFKVWDSRSKDCIKTIEEKYPLTAVAIAQQGTQVFIGGIDGAIKIWDLRNNHCSHVLKGHKDIITSLAISKDGSSLLSNSMDNTGMLFFLGVXSTFVLMLFXFIVRIFDVKPFASAQRQLQIFEGAIHGQEHNLLGVAWSRNSRFVGAGSSDKNVYVWSATGDLRYVLPGHEGSVNHVDFHPHQDIILSCSSDRTIFLGELN

SEQ ID NO: 22614 - protein, 375 aa, Schizosaccharomyces pombe
MRWYSYVIPAVILSIIAISGVWWNATLGTRLDQKVQLFLNEHSSILNAVYETTTIVYTEPLHTSVSETITSTSFVTETTTVTPTVTATAQELSTLNPHPENSKIVLLMGSNAQNDPSSPLNPYIRTIIKNRRDYAERHGFKFEFLDLDEYKPSIGDKPAPWAKIPMIKNVIRKYPDAEWVWWLDHDALIMNRDLNLVDHILKHEKLNSLLLRDTEYFSGFGIDSEGFRTPKNQDPDDIHFIIAQDFNGINAGSFLIRNSEVGTWMLDFWNEPLYKEHNGVFVEQQALSHMIYSHPIVHKHVGLVTLRSINAYDSSDPAWGYEDGDLCVHFAGCFVFQTCAQNFEKYGKIITEKQGHDWFDPSEKEYIEQRLFPQP

SEQ ID NO: 22615 - protein, 1333 aa, Schizosaccharomyces pombe; identical to SEQ ID NO: 2295

SEQ ID NO: 22616 - protein, 1283 aa, Schizosaccharomyces pombe
MLVFTDLIFLAIFAHIGKATAKVWNRNVQGFLDLNLPNECSQYTTIYSDGPSEYTSTLPYTHSFSNASVYTTLITITNSQCTGNYSTLTISSQPLIHTNTSISKPSQTATPQNTNTTQVSLTNGTTTNSYSNTNSLPITDTINGTTELIIPTTSYNNQSHTLIYSTYTSTYLPNSTIDLSILPHSTISTLSTVSINDTSASLSKTTSPTAGTITETIVSGSVGYTSTFPASGTTSGTVEVVEPTAGTITETIVSGSVGYTSTFPANGTTSGTVEVVEPTAGTITETIVSGSVGYTSTFPANGTTSGTVEVVEPTAGTITETIVSGSVGYTSTFPANGTTSGTVEVVEPTAGTVTETIVSGSVGYTSTFPASGTTSGTVEVVEPTAGTITETIVSGSKAFTSTFPANGTTSGTVEVVEPTAGTITKTIVSGSKTFTSTFPANGTTSGTVEVVEPTAGTITETIVSGSVGYTSTFPANGTTSGTVEVVEPTAGTITETIVSGSKTFTSTFPASGTTSGTVEVVEPTAGTITETIVSGSKAFTSTFPANGTTSGTVEVVEPTAGTITETIVSGSVGYTSTFPASGTTSGTVEVVEPTAGTVTETIVSGSVGYTSTFPASGTTSGTVEVVEPTAGTVTETIVSGSVGYTSTFPASGTTSGTVEVVEPTAGTITETIVSGSKAFTSTFPANGTTSGTVEVVEPTAGTITETIVSGSKTFTSTFPANGTTSGTVEVVEPTAGTITETIVSGSVGYTSTFPASGTTSGTVEVVEPTAGTVTETVISGSVSFMSTITAHDTSSGAVIVVEPTAGTVTETIVSGSIPFTSTIPAQGTTSGTVEVVEPTAGTVTETIISGSVGYTSTFPAQGTTSGTVEVVEPTAGTVTETIISGSVGYTSTFPAQGTTSGTVEIVAPTAGTVTETIVSGSIPFTSTIPAQGTTSGTVEVVEPTAGTVTETIISGSVGYTSTFPAQGTTSGTVEIVAPTAGTVTETIVSGSIPFTSTIPAQGTTSGTVEVVEPTAGTVTETIISGSVGYTSTFPAQGTTSGTVEVVEPTAGTVTETIVSGSIPFTSTIPAQGTTSGTVEIVVPTAGTVTSTTGSGTSWFTTTVPATGTRSGSVIVVSPTAPACSSTPFAECPNLNFNFHSKNVNFPPADIRVISVTPKGNNMYDATVQFTTSSTMSKKSLSELKILGLSQTYLLYSYNSKVDNISNPGSWTSTVTVQGTSTGSYICMPHFQIQYDWCSAGVTDMSECNTWSYQKSYDYITGCNNYDNQGNSQTDASDYCWNVC

SEQ ID NO: 22617 - protein, 532 aa, Schizosaccharomyces pombe
NKLLFNRFASSQSKDSNISEMNSKDSNTVPVYTTNTGCPIFNPMAAARVGKGGPVLLQDSHLIDVFQHFDRERIPERVVHAKGSGAFGEFECTDDITKYTKHTMFSKVGKKTPMVARFSTVGGERGTPDTARDPRGFALKFYTDEGIFDMVGNNTPVFFLRDPAKFPLFIHTQKRNPQNDMKDATMFWDYLSQNAESIHQVMILFSDLGGTPYSYRFMDGFSSHTYKFVNDKGEFYYCKWHFITNQGTKGLTNEEAAALDGSNPDHARQDLFEAIERGDYPSWTLYVQVMTPQEAEKYRYNIFDLTKVWPHKDVPMQRVGRFTLNQNPTNFFADIEQAGFSPSHMVPGIEVSADPVLQVRTFSYPDTHRHRLGANFEQIPVNSPKCPVFNYSRDGPMNVNGNQGNWPNYPSSIRPLAKVQYEPDEGHEKWVGQVTYHMDEITDVDFEQPRAFWQNVLGKKPGQQDNFVKNVAGHLSGAISPVRERQYGVFTRVDSELGRRIREATEAEVKKMEEKAPKPINKGEPHMFQGSS

SEQ ID NO: 22618 - protein, 383 aa, Schizosaccharomyces pombe
  unsure (1)..(383): unsure at all Xaa locations
MCPLFKTYLLYILKICSIPCLAYVVNFLVCFVLFTNIKLDVRKMAKRHAEENEDTVMSESLKVVDTDFINVGKYXXNXWSIDIYXLFILDFEFFDPQPIDFHAFKNLLKQLLGYDHTNVNLSALADLILSQPLLGSTVKVDGNNSDPYAMLSVINLNTRRVXNNSFYFFXICKPIQGGDASAMFYTRVQIFGIFSXRYLLDEPVIKQLTSYIISRLAKSNSRLENELQKLLEPNSGSQVGLIVNERLINMPVQVIPPMYNMLLEEMQWAINENEPYNFTHYLLLSRTYTEIESKLMDDERPSKKGKKSKKTSGEEVMFFHPEDEQFREVAIDIADYPFANQDFNPDANRVFQDAGIKPQGELLLMTNEDFKNLVPKLMEIYSA

SEQ ID NO: 22619 - protein, 426 aa, Schizosaccharomyces pombe
MKSFTRNLRRFQTPRRNLHGISYTPKKVEGVSFAGRETPTATGSLSVVINAGSRYQPDAGVSHLLEKFAFKTTEERSALRITRESELLGGQLSTQITREHIILTARFLNEYLEYYARLLAEVVDATKFLPFQLTEEVLPTARIESELFREDILRVAMAKLHEKAFHRGIGNEVYLPASASPSISEIKDFASKAYVKSNFSVISSGPDVQKASDLCAKYFAVIPDGSPLKSAPTKISSGESRVYSKGTNYFCLGFPAPAASPELFVLSSILGGDAAVKWSHGNTLLAKAAGTASEYKATAVADLTPYSDASLLSVVISGSCPKAIKATASESFKALKSLSSNIPNDVVKSGIAMAKTKYLSAFEPVTLNAISASSLVSASKGSDAFISGFDKVTPASISKVVSSLLAKPASTVAVGNLDVLPYYDEL

SEQ ID NO: 22620 - protein, 963 aa, Schizosaccharomyces pombe
MHISTLKVDQLQNEAVDINSNDTIDSINWKNTRNNHTTQASLQADNNDEQSNGQAPFSTTYSEINNIHDVPGNQDEWSSSPIAGIIVESEDEEVVENNLHSQMGTSCNKINSNSNKGKENMHFVLDDNGDSKGNASNQQVERDDKLDMETTRWNGKEFEEPLSTNKKLIIQSNNTSSQHSTPPLSISDTSTHTGSSTDNVEANPNTGFSSARKRSLRSSNLKKKFVPLSSPEESNESEFIDDDESDEVASIIDIKEDETFDSKVEIPEAAPSSSTESDEESIPLSYQSKRRRVSARASSSASSSSRTQAKSIPSHERTHYRLIRQHPELEHVWEKLEEEAPREVKQIEQPKELVLNLLPFQREGVYWLKRQEDSSFGGGILADEMGMGKTIQTIALLLSEPRGKPTLVVAPVVAIMQWKEEIDTHTNKALSTYLYYGQARDISGEELSSYDVVLTSYNVIESVYRKERSGFRRKNGVVKEKSLLHQMEFYRIILDEAHGIKSRTCNTARAVCGLRTTRKICLSGTPLQNRIGELFSLLRFLRADPFAYYYCLQCECKSLHWRFSDRSNCDECGHKPMSHTCYFNAEMLKPIQKFGYEGPGKLAFKKVHSLLKHIMLRRTKLERADDLGLPPRVVEVRKDLFNEEEEDVYQSLYMDSKRKFNTYLAEGVVLNNYANIFQLITRMRQMADHPDLVLASKRKTVDIENQENIVCKICDEVAQDAIESRCHHTFCRLCVTEYINAAGDGENVNCPSCFIPLSIDLSAPALEDFSEEKFKNASILNRIDMNSWRSSTKIEALVEELYLLRKKDRTLKSIVFSQFTSMLDLIHWRLRKAGFNCVKLDGGMTPKARAATIEAFSNDINITIFLVSLKAGGVALNLTEASQVFMMDPWWNGAVQWQAMDRIHRIGQKRPIKVITLCIENSIESKIIELQEKKAQMIHATIDQDEKALNQLSVEDMQFLFSN

SEQ ID NO: 22621 - protein, 579 aa, Schizosaccharomyces pombe
  unsure (1)..(579): unsure at all Xaa locations
MSSGSRVRGPNSALTEFLRVCDDSFLARSYXCIIQSQGINASALGRARPPRQSEESAGQSTGTESEVIQTPTSVEENNEDENSMSTTTIEIPVVKRRNLRNQKKKKKTDEEAEDNEDTFSMNSRAGFSYKAREHTGKLDFCAHCNCRFTITPYSKYSNSEKGWLCYPCSRGAEDRSVPELRTRKRKALTRKKVAAATMDEEISVPKLQDLCIRVIAEYINDIEAFGDIGQVNMDKISQIISKNRSLNDTTVKLFLSGGQTELKLYDCSKITADSLFQIAQYCPNLQTLHLTYCGQMQDQVLHFYADHLTELTDVSFQGAFLVSSSEWINFFKKRGSKLISLELTDTARIHVSVINAIVDCCPNLISLNLSRIFYLDDECVRLLAGCRNLVSLKIESPGGIINDGSILDVLNQIGSGLHTLSLSGCTKLTDEVLKQGIGPCCGRLKHLNLSGLELLTDDEASIVFGEWKIQSGLETLSLRRCLSLGDKTVRAVLVNSGHTLRTLDLNGMSFVTDEALQYIVNFPLPMLKALDVSWIRGMNDKLVCDFESKKPTLEKLLVWGDNHVLMPSNRLLLIGREVQ

SEQ ID NO: 22622 - protein, 579 aa, Schizosaccharomyces pombe; identical to SEQ ID NO: 22621
  unsure (1)..(579): unsure at all Xaa locations

SEQ ID NO: 22623 - protein, 180 aa, Schizosaccharomyces pombe
MFATRSFCLSSSLFRPAAQLLRPAGRSTLRNVWRRSIATEHLTQTEANSRLASQRVHRPNSPHLTIYEPQLTWYLSSLHRITGCVVAGTLYAFAMGYLVAPLAGYSLDTATISGLIQQVPTWIKVPAKFVISYPLTFHIFNGIRHLIWDTTKELSLKGVYRTGYAVLALSVLTSGYFAMI

SEQ ID NO: 22624 - protein, 384 aa, Schizosaccharomyces pombe
MVLPQNVNNNAPTSGRTCQKPTSAFFYEIMSDSKLADSLNCLSVSTPSTTANPGRQQLLRLAVSNQRQVNNVSLANGKENKRTSNSKFNSSLRKIEEPIAGVPSSAGPQWREFHIGMFEIGKPLGKGKFGRVYLAKEKKTGFIVALKTLHKSELVQSKIEKQVRREIEIQSNLRHKNILRLYGHFHDEKRIYLILEFAGRGELYQHLRRAKRFSEEVASKYIFQMANALSYLHKKHVIHRDIKPENILLGIDGEIKLSDFGWSVHAPSNRRTTLCGTLDYLPPEMVEGKEHTEKVDLWSLGVLTYEFLVGAPPFEDMSGHSATYKRIAKVDLKIPSFVPPDARDLISRLLQHNPEKRMSLEQVMRHPWIVKYKDSWTRKSSESS

SEQ ID NO: 22625 - protein, 384 aa, Schizosaccharomyces pombe; identical to SEQ ID NO: 22624

SEQ ID NO: 22626 - protein, 439 aa, Schizosaccharomyces pombe
  unsure (1)..(439): unsure at all Xaa locations
MSVSSYSSDASSTVMDESPPNGVTKSVSGKGPTVCYYXFLIIILLTEVCRAVVMMNMGGPSNLDEVRLXLKKRLYGVQPEKRFNFCCFYIHLXLLSTRELMFSGGPLLERLFTDGDIIPLGYFQNSLGKFIAKRRTPKVQNHYSDIGGGSPILHWTRIQGSEMCKILDKKCPESAPHLPFVAFRYAPPLTEDMLDELKKANVSRAVAFSQYPQWSCATSGASLNELRRKLIEKGMEKDFEWSIVDRWPLQQGLINAFAENIEETLKTYPEDVRDDVVIVFSAHSLPMSQVAKGDPYVYEIAATSQAVMKRLNYKNKFVNAWQSKVGPLPWMSPATDFVIEQLGNRGQKNMILVPIAFTSDHIETLKELEDYIEDAKQKGITGVKRVSSINGSMTAIQGMADLVAEHLKAKVPYSRQFTQRCPGCTSESCAERINFFQDF

SEQ ID NO: 22627 - protein, 829 aa, Schizosaccharomyces pombe
  unsure (1)..(829): unsure at all Xaa locations
MKEVRVVICGDQGVGKSSLISALIQEDNVTSIPKVACSHSIIYCSNALGFPIISIPSNPDSNDDVSLVLVDTQCENSXFNFLWIFFQSXYDDVXRDSNEREYLAAEIKKANVICLVYSDNYSYERVSIFWLPYFRSLGVNVSXSHSIXLVLLIXLRFQIVLCENKSEDLDNYQGLHTIEHEMIPLINEFKEIEACILCSALEKINVNEVRDLLXIIQFTCVVTNNKKLFYMCRACVIYPITPLWDAKERVCSYIXKIKPNNLTRQXEKATIHALSRIFCTYTFVCFIMXIFTNXPVLIDKNNDDLLSVDELNSLSEKCFSKNLSIEDASEILSKVKEICPEGVYEGQLTLPGFLAYNRVQVENGKQESTWGILRAFHYTDSLSLDDSYLSPKFEVAPGQIVELSPKGKQXFFFILLMXNAIRLXIFGDLFYQFDRDNDGALNNEELSALFRHTPGLPEIWVSSQFPNSTVLNEHGYVTYNGWLAQWSMITLFDYKTTLAYLAYLGFDTDGRGHNTDALKVMRKRVSQNRKVSKYDRNVFLCFVVGSKSCGKVSYLYHFCKFTISNLTFIXTALLSSFINNNTNRLTPNTVVNSVEFQSTQRYLVVWDIFIXYFLTFFVPALRNWXNDLDILAEPKSLEACDILCLLYDSSNPNSFSFIANLLVRHQFLFLSNLFSLRIYTRIFKRIPCVFAATKADLDRQQQVSYIKFKKCLVNKLCRRDTQSNQMSLTKQLGLPSPTHISTAAIWNTSKEFFIQVSIHKSYTFYLTNHFXLAESAQYPASSIIRIPEEDSNKTNYQLVAALTAFGALLLSVGGSLTWKIIKHQYYSKK

SEQ ID NO: 22628 - protein, 1284 aa, Schizosaccharomyces pombe
MLPYNSNYLSDNGKRKFSDENPQSEVYGSSQTGLPSSYGNPQSYGTPPVQQSSAMYGVNNSMGGGMYNTSENTQFMNTDYSQTSSYASTPMSNAYSRDAPAAINNNFGYSYVGQSSQPVPSYNPLPSYNTASLPNAGIPAAMPGMPSGYPGTVPIPQGGYNAHYSSPYNNGYPIGAVNPTSAIPAQPPAQPVNNVLPSYVRSNSRSSARSTARSAPRSTQRSRSSSANPVTTPPVNNTLLTPPAPPVELPPVTTTSPNAIIRSVQWIRSFVPQAPIHQVINTLAQTKWDETAALSILSQKYLSCDLGIPIQEHKRFKQSPVASNMPTYGSSNRTVQSQKRSIRDKYIQMPNDSTQASLMPSYTRKTSNASKKLTTEEDEFYDSEEEPEAIVHRDTSALERTVLNFINSSTAKELSDTASCPLSHSKLLLEHRPFQTLAEACIIKHPDDVPSKPGRRGRRREKNPMGQKIVNACMETMEGYYAIDNLIAKCEFLGNRISKGMASWGIKLEMSNGELNIVDMESVPTEAADNSDFPKFVTEQPKTLASDVQLKSYQLVGVNWLHLLYQQKLSGILADEMGLGKTCQVVAFFALLLEQGHHGPHLVVVPSSTLENWLRELARFCPSLRVEPYYGSQQERANIREAIEENEIKYDILVTTYQLATNNKEDRSFLKHQNFDVCVYDEGHYLKNRMSERYKHLMNLNANFRLLLTGTPLQNNLKELVSLLAFILPNMFDSDMDDLDVIFKAKPTADADIEQALLSKQRISRAKTMMTPFVLRRRKNQVLNDLPKKTQIIEHCKLSENQLEIYNRYAALQKNQQLRRDDKRNKRSKNDEESDGKSLSAGHVLMQLRKAANHALLFRKFYDDEKLKQMAKDIMQEEQYKNANEQYIYEDMEVMSDFELHRLCRSFPTLQSYTLKDDPWMDSGKIRVLKELLPKMKEEGSRILLFSQFTQMLDILEQVLDTLKISYVRLDGSTQVEVRQDIIDQFHKEEDVTVFLLSTKAGGFGINLACANVVILYDCSYNPFDDLQAEDRAHRVGQVREVTVIRLITDNTIEEYIQKLANTKLALDMSLSSDGKDREEIGERLVQDMLDEENNGNNTKPEITGNESDGEFKVSSSNNSKQTDAEETNTGVPLEGSQPNSVEKTDLADGDEKANIKTEMKSETVEGDNKELRETMKGENVQTDSNAAVPSSKSSTEEPNESVLSGHLDLDTEASPVVSTIEKTTKGDVSVTEEQQSANIDGQLEKPEIEESKKPDVLNQVSLSIEEEKPKNKESEVDNNAAKD

SEQ ID NO: 22629 - protein, 774 aa, Schizosaccharomyces pombe
  unsure (1)..(774): unsure at all Xaa locations
DFHRLSTHIERFEREQASLNMHVKTELEKHVEAVEVSTNIKLMRXLXLIXLTSLVGEIGTAXCSNEKSEASSGIAXREXSRSLSFLDIFXKTFLLMLIFFXMLTLCESAREMVDEFPLISRMSRIYKNCYATKQMISQLNNLVKETDVIEDMLREDLELDSDMPNLLRAHYKLSKLREFREEALYQASLEGQSDLPITLENSFSNLNTLSDNFDRLVLNFCRNIFQLVKSGHIKTIVQIFKIVEAEESSDEVLKSIRDAKSSLPDSQDGPFLSLQGMTRQLRNFRLRVLEEFQGAAAENFQRAWVSYLEDGSGELNLDFIFEDLKVAFYVLPDLTPPSYNIAKTFASIYQECLVGLVTKAVSLDTPAAVYLYLINFHREYRKFFEENAPFSVDEVEPGLEDGKDGILVREYTRLFTQKIREWSDKLFQSSVDTFMKRESEPELDSDGNYGLQGTIIFFQMITQQINIISHTNNSDVVGIVLSSIMYIMQSMQDQWKSVMRSELSQQLSGNPESVPPGLMEYLLAVANDNLKCAGFMDNTLLNTFELITSEREEDLREAFGKTVDGYILISDIGVSQIVAIISNDVKPALTSLFQPNWYQSSNMKLIVDTFRDYIVDCIEHMVPGLFDVFLLEASNALTISYLRSIFNKNACFDGDNAIQQIRSDIALAIRVFGEYMAAEHLRSTFEPIEKLLLGMLDADVETVSEYFHLLKEAYWDAPLSLVEAVLQNRTDLEKSIIKKMIDIVRHENDSLQIDTSQQPTVFSQVTSLSGSSIL

SEQ ID NO: 22630 - protein, 535 aa, Schizosaccharomyces pombe
MAKILTIVMLVFVSMAGWMFGADTGSIGGITNMRDFQSRYADRYDPVTDTYSYSSARQGLLVGMVNTGTTVGCLLSSPLGDRFGKRKCIMGWTLVYITGVIVQLTTIPSWVQMMVAKIWTGLGIGALSVIAPGYQSESSPPHIRGAIVTTYQLFITLGIFIAACINMGTHKYTTHPEAQWRVPIGINLLWGILMFFGMLFLPESPRYLAVKGRNEECMKILTRNAGLPADHPIMQKEYNAIQADVEAELAGGPCSWPQIFSNEIRYRTLLGMGVMAFQQLTGNNYFFYYGTQVFRGTGLNSPFLAALILDAVNFGCTFGAIFVLEYFGRRGPLIVGGVWQSICFFIYASVGDRALTRPNGTSNHRAGAVMIVFSCLFIFSFAQTWAPAAYVIVGESYPIRYRSKCAAVATASNWFWNFMISFFTPFISNSIGFKYGYVFAACNLCAAIIIFLFAKETKGLTLEEINQLYLSNIKPWNTGAYQRDREDIKQSDSEKERGPTSKLHEYVEHAPNSYASTHSTESENYPQQVTNPVGL

SEQ ID NO: 22631 - protein, 546 aa, Schizosaccharomyces pombe
MGKNLTIVMLVFVSMAGWMFGADTGSIGGITNMRDFQSRFADRYNPVTDSYSYSSARQGLITGMVNVGSFFGCFLSSPLMDRIGKRTSIMFWTIVYLIGIILQVTAVPSWVQIMVAKIWTGLSIGALSVLAPGFQSEVAPADLRGTIVTTYQLAVTGGIFIAACINMGTHKLHKTAQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDAVNFGCTFGGLFVLEFFGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFAHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 22632 - protein, 475 aa, Schizosaccharomyces pombe
MLSIIVFGASGDLATKMTFPALFALYVRKIIPEDFQIIGYARSKLSQEAANKIVTAHIPIDDTVGASQKALNTFVEHYKYVPGTYDKPESFEMLNSIIAEKETAPASECTRIFYLVLPPHLFAPVSELIKSKAHPNGMVTRLIVEKPIGFDYKSADAILSDLSKHWSAKDTFKVDHFLGEDMIDGFTAIRFANSMFEPIWNREHIESVRVDFREDFGCEGRGGYFEGAGILRDVVQNHLLQLLTLLCIEEPKSQDAEDIIKCKVDFLKSLHPVSKEDIVYGQYTKSANGKVPGYRELDGVADDSEVSTFCALQLRSEAPRWKGIPIIISAGKGLDRDYFEARITFKRREGGMFPTVDSSNVLVLRVYPKEFIALKGHIKQPGFSRQIVPVTLDVKYPEAFPDTWIHKAYEVVIADAINGKHTHFISDDEVRTSWKIFDDVLDTTGDLSPLPYAFGSHHGPDATLEFFKKRNLEWD

SEQ ID NO: 22633 - protein, 529 aa, Schizosaccharomyces pombe
  unsure (1)..(529): unsure at all Xaa locations
MLSANMLRRMHHGVAVTRMLLVSNGXVRXISILMLLVHRLIVMNFKRKSNQCAEKVQVKKSALYPVMAKLARTYATKSKXLLFWLRNGFLTVTIDYPAHTVINMPALSPTMTTGNIGAFQKKIGDKIEPGDVLCEIETDKAQIDFEQQDEGYLAKILIETGTKDVPVGKPLAVTVENEGDVAAMADFTIEDSSAKEPSAKSGEEKSAPSSEKQSKETSSPSNVSGEERGDRVFASPLARKLAEEKDLDLSQIRGSGPNGRIIKVDIENFKPVVAPKPSNEAAAKATTPAASAADAAAPGDYEDLPLSNMRKIIASRLAESKNMNPHYYVTVSVNMEKIIRLRAALNAMADGRYKLSVNDLVIKATTAALRQVPEVNAAWMGDFIRQYKNVDISMAVATPSGLITPVIRNTHALGLAEISTLAKDYGQRARNNKLKPEEYQGGTFTISNLGMFPVDQFTAIINPPQACILAVGTTVDTVVPDSTSEKGFKVAPIMKCTLSSDHRVVDGAMAARFTTALKKILENPLEIML

SEQ ID NO: 22634 - protein, 460 aa, Schizosaccharomyces pombe
MGKEKGHINVVVIGHVDSGKSTTTGHLIYKCGGIDKRTIEKFEKEATELGKGSFKYAWVLDKLKAERERGITIDIALWKFETPKYNVTVIDAPGHRDFIKNMITGTSQADCAVLIIGGGTGEFEAGISKDGQTREHALLAYTLGVKQLIVAVNKMDTTGWSQARFEEIVKETSNFIKKVGFNPKTVPFVPVSGFQGDNMIEPTTNMPWYQGWQKETKAGVVKGKTLLEAIDSIEPPARPTDKPLRLPLQDVYKIGGIGTVPVGRVETGVIKPGMIVTFAPAGVTTEVKSVEMHHESLDAGLPGDNVGFNVKNVSVKDIRRGNVCGDSKNDPPMGCASFTAQVIILNHPGQISAGYSPVLDCHTAHIACKFAELIEKIDRRSGKKIEESPKFVKSGDACIAKMVPSKPMCVEAFTDYAPLGRFAVRDMRQTVAVGVIKAVEKVAPGAAKVTKAAVKAGAKK

SEQ ID NO: 22635 - protein, 499 aa, Schizosaccharomyces pombe
MLHRRIHFKSQSTLDFDSVAVSISASTMKNELDKLVLNSRVSDKKTFGIQMDNFFALYRRYLLHTVKGYECDWDSIRPLGPEDMIDYGDLPLCKNAGKYLNRLAVVKLNGGMGNALGVNYPKAMIEVRDNQSFLDLSIRQIEYLNRRYDVSVPFILMNSYDTNDETCKVLRKYAGCKIDISTFEQSRYPRVFVDSQLPVPKAAPSPIEEWYPPGHGDIFDALVHSGTIERLLAQGKDYLFVSNIDNLGASVDLNILSHVIDNQIEYSMEITDKTKADIKVGILVNQDGLLRLLETNQVPEQHREEFMSDKVFKYINTNNVWLYLPAVKRVVENRELNLDIMPNIETVYYNNEPARIIEFTTAIGSAISQFKKTEGIRVSRPRFISVKNSSDLFLVRCDLYNVDHGSLKIEESRLGFPPPVVRMSNEFKDIAELFCRIPYMPSMKDLVSLSISGNVYFGRNVILKGNIVIVASENTILCIPSNAVLENCVVTGNCKIMEC

SEQ ID NO: 22636 - protein, 565 aa, Schizosaccharomyces pombe
MPAGTKEQIECPLKGVTLLNSPRYNKDTAFTPEERQKFEISSRLPPIVETLQQQVDRCYDQYKAIGDEPLQKNLYLSQLSVTNQTLFYALISQHLIEMIPIIYTPTEGDAIKQFSDIYRYPEGCYLDIDHNDLSYIKQQLSEFGKSDSVEYIIITDSEGILGIGDQGVGGVLISVAKGHLMTLCAGLDPNRFLPIVLDVGTNNETHRKNHQYMGLRKDRVRGEQYDSFLDNVIKAIREVFPEAFIHFEDFGLANAKRILDHYRPDIACFNDDIQGTGAVALAAIIGALHVTKSPLTEQRIMIFGAGTAGVGIANQIVAGMVTDGLSLDKARGNLFMIDRCGLLLERHAKIATDGQKPFLKKDSDFKEVPSGDINLESAIALVKPTILLGCSGQPGKFTEKAIREMSKHVERPIIFPISNPTTLMEAKPDQIDKWSDGKALIATGSPLPPLNRNGKKYVISQCNNALLYPALGVACVLSRCKLLSDGMLKAASDALATVPRSLFAADEALLPDLNNAREISRHIVFAVLKQAVSEGMSTVDLPKDDAKLKEWIIEREWNPEYKPFV

SEQ ID NO: 22637 - protein, 615 aa, Schizosaccharomyces pombe
  unsure (1)..(615): unsure at all Xaa locations
MEFPIDDEELLDERNKLLQICNMDEQTMFYKWESWCLQRGNTPKLDLDTFKAFAKDMKFQMERQVKATLKQNPERKSIKQIPGMNIDSMCVHXQMVLTNKYLDLGLPVKTTASGDSLMQESKPSTETFELNSSDAGRVLEVLNKELKIVTSKPSAPSKLVIVANFDLKAFNYRIMYQKLYDSSEVLDDRIELFSALTCRKYNISDEDLANPSELTQEPVVVVGRIVVESTNLGGRLNQNSILLESSRRLGAGVRVRLKVDDLPSYSIFPGQIVSVKGSNPSGNMFIAKEILPIPPLPFPSSSKQEHATFVANTNNQPISIYIASGPWSLRDDLSFSPLKSMISYVNKNPVDLVILCGPFLDINHILIRTGNITGTSATSLEELFKERVTPILSQLTCPCILIPHINDAASDHPAWPQDAFNRVALGLPSVCXVVXXFLLTNPXNFKCFPNPCMFSINDVVFGVSTNDILLHTSREELFRLPSHGNLFARLVSHVLHQRHFYPLFPGGSLEKCNPSNLDIAHLKLGEFLNTMPDILILPSDLRYFVKVCXFSTLFXLMLXNVENVVSLNPGKATKGINLGTFAKLTIAPLELGDNGSSNHYSHRVWLRTKAEILKL

SEQ ID NO: 22638 - protein, 952 aa, Schizosaccharomyces pombe
  unsure (1)..(952): unsure at all Xaa locations
MRCIVSYKSLRSCLVNVPELLLESISEPVQNYAVQAVVCKNDIKKTFYFGISGIPSQFSFEIDSTYAHTLKLAENQEVKIFVSNEMFLLISXINLSIIDCTHEIEQLEIEPVTSNDWEIAERNAAWLEENLLVQYRVATTERFIIYLPSGTFIQFQPLKLIPSSLCGRLLRTTEVLITPKPNTSAIEVKENRKVNLRCVVENRLLPDSVTADSPALCVFLPLNFPDRPDVVYMDGGNLKSTIVCQCVSCPFQIPGHFFISKSLALSYSIKTGFKFQIWKAHNPPSSSKFILEQKGLPPESNLSSELVAAKLKNSYLMDGMTLKLVDIAVSYSVSGLSGVVKNPIQDIKITSDTNVPVNAGIRNNSPRLSMQPFPHEFAQVRNAVFLHQNIYINGPKGCGKSNLVHSLFDYYSLNSIYFQMIVSCSEIDRSSFAKFQSFWNNVFIQAERYEPSIIYLDDVHCLISSSNENGELGFVEEREIAFLQHQIINLKRKRKIIFIGFGEEFLTFSENLVLPLLFQIKIALPSLAVTRRKEILTTIFQENFSDITMDSIEFISVKTEGYLMTDLVLFVKRLLSEAFVEKIQNGPKHLMNKGLIEKTLKDFVPLQLRKAKFVKSSIRWIDIAGMQEAKEAVRDIIESPVKYSLIYKQCRLRLPTGILLFGYPGCGKTYLASAISSTFPVQFISIKGPELLDKYIGKSEQGVRDLFSRAQMAKPCVLFFDEFDSVAPRRGQDSTGVTDRVVNQILTQMDGAESLDGVYIVAATTRPDMIDPALLRPGRLDKLIFCDLPNEEERLEVLQKLANRFHIENAAMLKKLSTLTDGYTYADLSSLLYDAHLIAVHKLLKRVSINAVDPSQTTSSFTNLTTESKRNASMLALPPESRYNQNMQSMSDSKSVVIEDYMLMEALKKNSPSLNSEEFEHLSNLYRDFRSKLFEPELNARNTDVGSKTRQI

SEQ ID NO: 22639 - protein, 429 aa, Schizosaccharomyces pombe
MFPHRVSHLSKLFSRRFPNWKRKVQTDSWSNVPEHIHSKIGRNLFQKEGHPICSLRQLLEQQFQKFEMNNVQKESPIVSVETNFDSLGFPKTHVSRSKSDTYYMNNKTCLRTHTSAHQPEEFSRLAKEGFKKNGFLITADVYRRDEVDSSHYPIFHQMEGALVWNRNDTAKMKNDLKKVALSPSLKSMVDDETTALETHNDMQDIYSLEETKFVSQHLKDTLTTVIHDLVSLAPSISSGAEQVRYRWTYDSFPFTKPSFQLEIDWKGKWLEILGCGVVQDRLLKGAGLNNYIGWAFGIGLERLAMILYGIPDIRLFWSLDERFSKQFLPNKISTFKPFSKYPACFKDIAFWINNDFNPNDFYEIIRDVCQDMVESVNLIDQYTAKSGKTSLCYRVNYRSMERSLRNEEIDKLQEKLRNRVANSLRVELR

SEQ ID NO: 22640 - protein, 375 aa, Schizosaccharomyces pombe
MRFAPYLISAVVITTIILGGAWWTSAMDTKLQTKMKEIIDQHTSTWTPVVSSVTSTQTDTLRVTISEVVSVTATLTETFTATPTVTSVVHALATTDPHPDNSKIVILMGSNFQNDANSPLHPFAQSIIKNRREYAERHGYKFEFLDADAYASRVTGHLMPWVKVPMLQDTMKKYPDAEWIWWLDHDALVMNKDLNVVDHVLKHDRLNTILTREAEYKSGAGIPADGFRTPKDQDAKDVHFIISQDFNGINAGSLFIRNSEVGRWIVDLWFEPLYLDHIQGYAEQQAFSHMVFYHPQVYKHVGVVPLKAINAYDFDDNIWGYDDGDLCIHFAGCNYFKNCPEKFLKYAQILSSKQGSDWMSAQEKDHIQNLLKPSS

SEQ ID NO: 22641 - protein, 879 aa, Schizosaccharomyces pombe
MTELLADEVFKDRVRIFQEYLEHDTDDANVTLYQEAILRMLNMGQRRLIVNIDELRDYNRELADGVLLKPLEYVEPFDEALRNVVSTLIDPVVHKDLKDKLFYVGFRGSFGDHHVNPRTLRAMHLNKMISLEGIVTRCSFVRPKVIKSVHYCEATKRHHFKQYADATMNGGLSFQSTVYPTQDENGNPLSIEFGFSTFRDHQSISLQEMPERAPPGQLPRSIDILLDDDLVDTVKPGDRVNIVGQYRSMGSKTSGNTSATFRTVLLANNVVLLGNKPGLGNVGGGALDITDADIRNINKLARKKNVFELLSTSLAPSIYGYEYVKQAILLLLLGGTEKNLTNGTHIRGDINILMVGDPSTAKSQLLRFVLNTAPLAIATTGRGSSGVGLTAAVTTDKETGERRLEAGAMVLADRGVVCIDEFDKMSDIDRVAIHEVMEQQTVTIAKAGIHTSLNARCSVIAAANPIYGQYDIRKDPHQNIALPDSMLSRFDLLFIVTDDIDDKKDRALSEHVLRMHRYLPPGVEPGTPVRDSLNSVLNVGATNAAGVSTENVEQEVETPVWETFSSLLHANARTKKKELLNINFVRKYIQYAKSRIHPILNQATAEYITNIYCGLRNDDLQGNQRRTSPLTARTLETLIRLSTAHAKARLSSVVEVKDAKAAEKILRYALFREVVKPKRKKHKKQRLEAGEEFDSEDDNSDDMDIEESEEEMDTNMVIDSGSRRVTRSQNATSQSQESGSEIGSSIAGTAGSYNVGTSNTQLSWPSTHSTLPATSRELASSDRNINTGTSVASEVSASVSEQSTVSLPREKMSVFMARLASLTKSELFSEECASLEDVLESINNIEDDVGFSREEAIVALKEMDAQNKIMFSDNVVYRI

SEQ ID NO: 22642 - protein, 231 aa, Schizosaccharomyces pombe
  unsure (1)..(231): unsure at all Xaa locations
MFANARAKRRSRASSPTPARLGGYAPLRVEITEEQRQDINEAFKLFDSDKDNAIDYHELRAAMRALGFNAEKSEVLKILRDFDKTGKGYLQMEDFVRVVSVHVLALIYFIRWKFKIGKTHTTGLKMSFFLNFFFHSYMACHSSSVERVYXLDIVTEKIVERDPLEEIKRAFELFDDDETGKISLRNLRRVAKELNENIDDQELEAMIEEFDLDQDGEINEQEFIAIMMDEA

SEQ ID NO: 22643 - protein, 464 aa, Schizosaccharomyces pombe
  unsure (1)..(464): unsure at all Xaa locations
MNENQKSFDSDKSESEDEQKNGRVKVRSRKTDDNEGYTWEGEYQRSWDIVQEDAEGSLVGVIAGLIQSGKRKRYGVSKLVFLCSSFVCXLPMLGIWKHISLLXHRXTVYXLVNLIXLLRDTTPLQRGIIRHMVLVLDLSNSMEERDFHHKRFDLQIKYASEFVLEFFEQNPISQLSIIGVMDGIAHRITDLHGNPQSHIQKLKSLRDCSGNFSLQNALEMARASLSHIASHGTREVLIIFGSILSSDPGDIFKTIDALVHDSIRVRIVGLAAEVAICKEICNKTNSSTKNAYGVVISEQHFRELLLESTIPPATDSAKTTDASLVMMGFPSKVVEQLPSLCACHSIPSRGGFHCPRCKAKVCTLPIECPSCSLVLILSTHLARSYHHLFPLKNWSEIPWSANPKSTHCFACQLPFPKPPVSPFDESTSSMRYACPSCKNHFCLDCDVFAHEQLHECYGCQCSGN

SEQ ID NO: 22644 - protein, 339 aa, Schizosaccharomyces pombe
  unsure (1)..(339): unsure at all Xaa locations
MPPAVSSETSTIVPQQVVSRKFEKLFYXPLVRIVHPLVLLSAVDSYNRSAKGTKRRVVGILLGQNNGDVVNVANSYAIPFEEDEKNASVWFLDHNFMESMNEMFKKINANEKLVGWYHTGPQLRPSDLEINNLLKKYIPNPVLVIIDVKPKSVGLPTNAYFAIDEIEDDGSKSSRTFVHLPSSIEAEEAEEIGVEHLLRDTRDASVGTLATRVTQQAQSLQGLGQRLTEIADYLRKVVDGQLPINHAILAELQSVFNLLPNIFSGPVVSEQALESEAQRAFNVNSNDQLMSIYISSIVRAVIALHDLLDSLAASKAMEQQDIKPTVQNGEVSANAEQKA

SEQ ID NO: 22645 - protein, 457 aa, Schizosaccharomyces pombe
MSLATLQGQSLDFAVKHSLDDLLKNPVRFRPAVVSSPSVPEGTYTVLNNPKQSTVSRKSFSAPTSPTRNKRSGSSSQEYKKSSGTRGDGANDFVDEDPAFIPPARILFPEEKLSMEWDNIMPNAPGLVNLGNTCFMNSVLQLMTQTPPLVQYLLSGQHSLSCRMNACVLCRMEQHVARAYPNKGTKRASAFKPSGIQSMLKVISSHFRPYRQEDAHEFMRYLVDAWQKSCLQNHKNLDHPSRETSVVHRIFGGYLRQQILCSVCKKPSNTYQALLDLSVDAKGSSLADSLKHFVHAEKLTKQNKYRCENCKQLVDASKQMTIYRAPNILTIHFKRFTFNGFQSSKISKQISYPESFNLGPYMSDPNCSCWYELIGVLVHAGGSTRSGHYYSFCKSSNGVWLKFDDDFVSNSSIDRVLNQQAYILQYKRKSTSSSKHKLNTENTVTKTSNKKRRKISF

SEQ ID NO: 22646 - protein, 407 aa, Schizosaccharomyces pombe
  unsure (1)..(407): unsure at all Xaa locations
MSERDTALEKYKSYLLQHREWDSKLKDLRFGNRDLVKKYDKTEDDIKSLQSVGQIIGEVLKQLDSERFIVKARXVITQTFGRLFALRGGYIQVKCENGCEDLIISNAYVGRXIPSXRIFCGVXMGTMFKCIXSFARSFFFLKISSVGKICVQKLFGSNLSIQQKFFLKCAHGIKIYNRKHETLCLLVSXQIVGKVDTSRIVILLFLQIYRCISTLFFISFHYFLFPXPILSSGPRYVVGCRNNVDQSHLVQGVRVSLDMTTLTIMRILPREVDPLVYNMSIEDPGDISFAGVGGLNEQIRELREVIELPLKNPELFLRVGIKPPKGVLLYGPPGTGKTLLARAVAASLGVNFLKVVSSAIVDKYIGESARIIREMFGYAKEHEPCVIFMDEIDAIGGRRFSEGTSAD

SEQ ID NO: 22647 - protein, 742 aa, Schizosaccharomyces pombe
MKRASLGGHAPVSLPSLNDDALEKKRAKENSRKQRELRRSSALHSITPRRESLNNSSPFNSSHQVPVLSNFEEWIKLATDNKINSTNTWNFALIDYFHDMSLLRDGEDINFQKASCTLDGCVKIYTSRIDSVATETGKLLSGLANDSKVLQQTEEGEDAENDDEDLQKKKERKRAQRSVKTLVKDFESIRAKKFELECSFDPLFKKMCADFDEDGAKGLLMNHLCVDQHGRIVFDSSDTVIKDLENKDVEAESQEAVVAAPIESHDTEMTNVHDNISRETLNGIYKCYFTDIDQLTICPSLQGFEFDSKGNLDVSLLKSLSDEVNMITTTSLVDNTMEKTDADAASLSSDSDGEEGHIVHALEEMAYDEENPYVDVVPKAMDESENPDFGVDTEVNMADGSTMNENYSIISTAAANGVYEYFDKSMKKNWAGPEHWRIQALRKNINNASTVFNSSNTAESSDNVSRSLSSTERKKRRELDNAIDFLQEVDVEALFTPATSSLKLPKSHWKRHNRCLLPDDYQYDSKRLLQLFLKPKMSVLPNADGEGQLQLNKALDDENDLDGIQPHGFDSDGSDNVDEGIPPYGFGDSDSPKQTPLLTPPSSSGFGDNLLLTARLAKPDMLNYAKRAKKVDVRVLKEKLWKCLDLENTIKENSINSHIEGSEMESEETNMPVKSFFSTVNQLEETYEKKELKDISTSFAFICVLHLANEHNLELTSNEDFSDVFIRPGPNLTTLEALENDV

SEQ ID NO: 22648 - protein, 341 aa, Schizosaccharomyces pombe
MFAKVAFKNFTPLKSIAPRSFSTTSSRAFKVAVLGAGGGIGQPLSMLLKLNDKVSELALFDIRGAPGVAADIGHINTTSNVVGYAPDDKGLEKALNGADVVIIPAGVPRKPGMTRDDLFATNASIVRDLAFAAGETCPEAKYLVVTNPVNSTVPIFKKALERVGVHQPKHLFGVTTLDSVRASRFTSQVTNGKAELLHIPVVGGHSGATIVPLLSQGGVELTGEKRDALIHRIQFGGDEVVKAKAGAGSATLSMAYAGARMASSVLRALAGESGVEECTFVESPLYKDQGIDFFASRVTLGKDGVDTIHPVGKINDYEESLLKVALGELKKSITKGEQFVA

SEQ ID NO: 22649 - protein, 576 aa, Schizosaccharomyces pombe
  unsure (1)..(576): unsure at all Xaa locations
MSDMINIRETGYNFTTILKRYVIALNCXKSNSLXLIMHLTFTHIRLEAATSRLEDLVESGHKPLPNMHRPSRDSNSQTHNISFNIGTPTAPTVSTGSPAVASLHDQVAAAISPRNRSLTSTSAVEAVPASISAYDEFCSKYLSKYMELSKKIGGLIAEQSEHVEKAFNLLRQVLSVALKAQKPDMDSPELLEFLKPIQSELLTITNIRDEHRTAPEFNQLSTVMSGISILGWVTVEPTPLSFMSEMKDSSQFYANRVMKEFKGKDDLQIEWVRSYLTLLTELITYVKTHFKTGLTWSTKQDAVPLKTALANLSASKTQAPSSGDSANGGLPPPPPPPPPSNDFWKDSNEPAPADNKGDMGAVFAEINKGEGITSGLRKVDKSEMTHKNPNLRKTGPTPGPKPKIKSSAPSKPAETAPVKPPRIELENTKWFVENQVDNHSIVLDSVELNHSVQIFGCSNCTIIIKGKLNTVSMSNCKRTSVVVDTLVAAFDIAKCSNFGCQVMNHVPMIVIDQCDGGSIYLSKSSLSSEVVTSKSTSLNINVPNEEGDYAERAVPEQIKHKVNEKGELVSEIVRHE

SEQ ID NO: 22650 - protein, 219 aa, Schizosaccharomyces pombe
  unsure (1)..(219): unsure at all Xaa locations
MLESLLPIIRMEDSEMSTLQLGCDLAALGFDLAPVEYVFLRRCXNLNFXFDCGYXPFLGEDRLISTNLFSPWAELNTKKPVSQPMFKLPACYKNVNPPPAISKIFQFSDETLFYIFYTMPRDVMQEAAAQELYVFSNFTFXLFFIFHLTXTEQNRNWRFHKELRVWLTPVPGMKPLQRTPQFERGYYMFFDPIHWKRIKKDFLLMYAALEDRAQSAVHS

SEQ ID NO: 22651 - protein, 528 aa, Schizosaccharomyces pombe
MFSKYLQSRVCGLHSFTNSSAQQLFSKSIAHSSRRNFVISSSCTKFRNVAIQRNAKREFSRCAALKNFSYHARCFHATRAVWEMTDPYKTLGVSKSASASEIKSAYYKLAKQYHPDANPDKAAQDKFVEIKQAYEVLQDPKKKKAFDTYGAGAFKNGEFTGGDFEGFQNGFAGASSFSSGFPGFNFEDLFGFSSRGPQARRNTSFDVFVGEDIEASITIDFMEAVRGAKKDLSYSVSSTCSSCHGSGLQPGSHKSTCFACKGTGQRLHFIPPSFHMQTTCDSCGGTGTTIPPNSACRSCMGSGTVRERKTVSIDIPPGIDDNTVLRVMGAGNDASTAKGGPNAKSRPGDLFATIHVRKHPFFVREGTNVTYNAKIPMTTAALGGTLRVPTLTGNVDLRVSPGTSTGDRITMAGKGIRKVNTSRYGNFYVNFEVTIPKILSPHERSLLEQLADALNDSTARRTQSSPSGTNSSTSTSSTSSKHSTGISTEPTTGEENKQDGSVGGFFKRAFRRLHPDEDQNPKKDESSS

SEQ ID NO: 22652 - protein, 821 aa, Schizosaccharomyces pombe
MGQTNSRHSLIETDEPTTSSRVSMLVDRVKLLWKRYTTPLSTEDGSREAHFAVPSENYADTPSRNTPNSSNGFPSETLVTSSAHCSTQPHKDEAYSHHGYSSTMALDDSSLAQTYHEYEEGTSGNSPLRRAIGSYDFLHPRPSGNSSRLDRNSSRPFTSSFHSAPFLSSYGSSNDPSQERVNEYSLPSNSNSTYTTPLQSINNEHPLPTVLENNALLNNSGNSPSLINHLRQYLNQDFSRLHQSPSPIPNSNDNDSQTRRSSWSSIASAFNDFPEEFPNASNPEAHSNFTPLNGNDESTVNMLSRLLSAAAIETVASIMNSEARNMDSQNMANGEPSRFRSVDGSFEQFLTDLRSGNLTNVLQNSSQNGNDQISSDPESNSSDLQYLRMFRFPSFHQSHNQPASNNEASDTNGPALVPVLIVCMRSISETSEDHAPTMTQENQSLHNESRENISINDITERMAQSTEFSTDLPPTFERSNSTFSHPEPTRSDFSQAFTPVSDFPANLFPGSRNLFPTSNSGNQSTSSFSRYNQPTVSVDLRNSSILRRAQEPVNGSTGENHIGDDYISSLLDSSNSNSQRPFSTVPSESNVFSRNASGNFSMSQTHQPTTDNTSSFSTQPGRLSTGLHHFPSDRDLLSNQTRRSSLARSYRFEEQLSVDDNTSDFSTLASNGAADMVTQTHSEGTFSNSTHGDWLIYVFGGLFPEHHPVLSTVSLFSDNPMYEDLLALTTYLGPAKKPVASHEDVKRSGGLFAYFDDASLSSADSCLICLETYTNGDICRKLQACKHFFHQACIDQWLTTGNNSCPLCRAHGVTTQAEEEN

SEQ ID NO: 22653 - protein, 436 aa, Schizosaccharomyces pombe
MPVFMFDEHDNLNENYNSHLSSDDEIAEEGYDFEELEASASTITSSSDLKDGKNAKDEKGTVEFKVAAHGDFISSKGDNYVPSGKMRPADFQPLTVLGRGSYGKVLLVKQKNTGRLFAQKQLKKASIVLRAKGLEQTKNERQILEEVRHPFICRLYYAFQDHDRLYLILQYAPGGELFSHLAEQRMLPEDVVAFYTAELTLALIHLHKLGIVYRDLKPENCLLDAEGHILLTDFGLSKVAENGADCRSFVGTEEYCAPEILLEQPYDHAVDWWSMGILIFDLLTGSPPFTANNHKRIMEKITRAKPNIPFYVTSDARDIINKFLKKNPKQRLGADGPEKGYDAIKKHRIYRRIDWNKLEKRMLPPPIVPCITNPEAAENFSVEFTKLPLSTTPILHEEFGNLTIGSHSSAFQGFTYVASPNFLNCEFLSNNAVSNH

SEQ ID NO: 22654 - protein, 701 aa, Schizosaccharomyces pombe
  unsure (1)..(701): unsure at all Xaa locations
MYQNGKPDAPTILGQKRELEDVEIQDDDIQVCXRVEPLGIRMLRHVANSVKEVSKEDLLKDVRVRSIQFDELESKIEGLQNLAEEKLKVLATLVSWWPEILQQFSVVFQGNELKDFESEGVFSILEKFPELSYFNDAVKNNKTKALSIIQKLLSTVDSSTNSVSRDPFSVLSIDDSALTEKLNTINLDIDKILDELDTTRSQLHSIIKLPDRSSSFTLQCINESVRPQSTKVKEEATTSSKGKDEEKKVSTVEQRTQLQQLSRLQDQQNGLMESRSQSLKILDSNVNEMDKLIMERENALNNVETTNLKKYSSFLALKEAVSMTSEQLRVLEHLLSECSHEINVLSQQSKNFNGVFESSYQPLINDLDHQISVMQNDEKRINNAKTELSLSLEKKLEAKKQKEKVYKDKLDELANLETMVLEKKKAVATREAANKIRLVDLNDLELQKDLSTYLSKELASTEKAFRLVKQQTVKSSHSHYQELITKFSVEKEKAEQKYFLTMKSTDSLHAEVKLLRQKYQKTNEIISKMLNSQDTAVHRIIEFEDQLARLSSVRNNSIKQSTTFQVKKSSQKSTIQNLEEKVSYLQQFMDKNNATLTDLEFQCSDLSSSIDILSKQDEEHEKEKRKLKDTGVSTSAEELKTFRAMCKCSVCNFERWKDRIISLCGHGFCYQCIQKRIETRQRRCPICGRGFGASDVIPIHL

SEQ ID NO: 22655 - protein, 301 aa, Schizosaccharomyces pombe
MAKQTLLSTPLHGVYIPVFLIIFGTYIVKREWVGYAIVVAFSLGFHKFWRGRVRKVLSDKIQQFELSDKAVLNHNTAIYRFRLPRANDVLGLPIGQHLKVFVDVDGKEYSRSYTPLSSDADKGYFDLLVKSYPNGKVSKKFSELKIGDTIGVRGPKGNWKHRTGLARHFGMIAGGTGITPMLQIIRAVLSNFEDPTEITLLYANVSEGDIVLRDEIDALAKKDPRFTVHYVLNNPPENWKGSVGFVTQELIKAHFPAPSPETKVLICGPTPMVNSLREATVALGYEKSRAISKLEDQVFVF

SEQ ID NO: 22656 - protein, 998 aa, Schizosaccharomyces pombe
  unsure (1)..(998): unsure at all Xaa locations
METKVHLPLAYQQQVFNELIEEDGLCVIAPGLSLLQIAANVLSYFAVPGSLLLLVGANVDDIELIQHEMESHLEKKLITVNTETMSVDKRXALVTYICTGPDLLIILREKSYLEGGIFAITSRILVMDLLTKIIPTEKITGIVLLHADRXAISKEIISYIWFLQSVSTGTVAFIMRLYRETNKTGFIKAFSDDPEQFLMGINALSHCLRCLFLRHVFIYPRFHVVVAESLEKSPANVVELNVNLSDSQKTIQSCLLTCIESTMRELRRLNSAYLDMEDWNIESALHRSFDVIVRRQLDSVWHRVSPKTKQLVGDLSTLKFLLRFVFSFLFRYKXSLTKQVLLVCYDCVSFLKLLDTLVLSVNVSSYPSNAQPSPWLMLDAANKMIRVARDRVYKESEGPNMDAIPILEEQPKWSVLQDVLNEVCHETMLADTDAGIKKTLFKGRNINKSFRNINNSIMIMCADERTCLQLRDYLSTVTYDNKDSLKNMNSKLVDYFQWREQYRKMSKSIKKPEPSKEREASNTTSRKGVPPSKRRRVRGGNNATSRTTSDNTDANDSFSRDLRLEKMYANYXVLHANKSSLLSHLSKRYEPEVGNDAFEVIDDFNSIYIYSYNGERDELVLNNLRPRYVIMFDSDPNFIRRVEVYKATYPKRSLRVYFMYYGGSIEEQKYLFSVRREKDSFSRLIKERSVSYSKLFKTCXSKKNMAIVLTADSERFESQESKFLRNVNTRIAGGGQLSITNEKPRVRSLYLMFICIKTLKVIVDLREFRSSLPSILHGNNFSVIPCQLLVGDYILSPKICVERKSIRDLIQSLSNGRLYSQCEAMTEYYEIPVLLIEFEQHQSFTSPVSLTKTIYVXQLLAFLRLSSEIGKNDVQSKLVLLTLSFPNLRIVWSSSAYVTSIIFQDLKAMEQEPDPASAASIGLEAGQDSTNTYNQAPLDLLMGLPYITMKNYRNVFYGGVKDIQEASETSERKWSELIGPEAGRRLYSFFRKQLKDYE

SEQ ID NO: 22657 - protein, 542 aa, Schizosaccharomyces pombe
MSASSRFIPEHRRQNYKGKGTFQADELRRRRETQQIEIRKQKREENLNKRRNLVDVQEPAEETIPLEQDKENDLELELQLPDLLKALYSDDIEAQIQATAKFRKALSKETNPPIQKVIDAGVVPRFVEFLSHENNLLKFEASWALTNVASGSSNQTHVVVEANAVPVFVSLLSSSEQDVREQAVWALGNIAGDSPMCRDHVLQCGVLEPLLNIIESNRRLSMLRNSTWTLSNMCRGKNPQPDWNSISQVIPVLSKLIYTLDEDVLVDALWAISYLSDGANEKIQAIIDAGIPRRLVELLMHPSAQVQTPALRSVGNIVTGDDVQTQVIINCGALSALLSLLSSPRDGVRKEACWTISNITAGNSSQIQYVIEANIIPPLIHLLTTADFKIQKEACWAISNATSGGARRPDQIRYLVEQGAIKPLCNLLACQDNKIIQVALDGIENILRVGELDRANNPDKINLYAVYVEDAGGMDLIHECQNSSNSEIYQKAYNIIEKFFGEEDEIEELEPETVGDTFTFGTTQEPAGDFQFSATNAEDMAM

SEQ ID NO: 22658 - protein, 542 aa, Schizosaccharomyces pombe; identical to SEQ ID NO: 22657

SEQ ID NO: 22659 - protein, 354 aa, Schizosaccharomyces pombe
  unsure (1)..(354): unsure at all Xaa locations
RFCLHAQGKLEDVIQEAIQQGFQSFSFTEHTPRDRVEDLYPEEVSVLAGXCVKHYYYFIGHFKFWKXIVGTKFHVTFELCYMILLLYXNAFTMDCXLXFIXLHLQPEDLFKTFDEYVNEARRLKQNYGDQINILIGAETEYIRPESVELLKSLNTKYNLDYFVGSVHHVNSIPIDFSPELWQKALQHVGNNPEQLFIDYFEHQYDLMQRLHPLVIGHFDLICLFAPEDAKEVFKNSKSVWELIQRNIKYAVSYGGIFEINTSAFRKGWKTAYPQQRLLELMVEQGAQLTLSDDSHGPHQVGLNYHLAKSYLDKCGITSLCMIEKGPDGNGTVVKNVTVDNVWSKFVGTNGITNT

SEQ ID NO: 22660 - protein, 483 aa, Schizosaccharomyces pombe
  unsure (1)..(483): unsure at all Xaa locations
MSEEVVQDAPLENNELNAEIDLQKTIQEGMIKGNSSLIYIIMPXLLTIILVSEYKLWKQNVPFLYDLVITHALEWPSLTIQWLPDKKTYVACQSSXAMIILAFTSNHLISFLTRFLKIPGTDYSIQRLILGTHTSGNDQNYLQIASVQLPNFDEDTTEFTPSTIRRAQATGSYTIEISQKIPHDGDVNRARYMPQKPEIIATMGEGGNAYIFDTTCHDALTTGEALPQAVLKGHTAEGFGLCWNPNLPGNLATGAEDQVICLWDVQTQSFTSSETKVISPIAKYHRHTDIVNDVQFHPQHEALLASVSDDCTLQIHDTRLNPEEEAPKVIQAHSKAINAVAINPFNDYLLATASADKTVALWDLRNPYQRLHTLEGHEDEVYGLEWSPHDEPILASSSTDRRVCIWDLEKIGEEQTPEDAEDGSPELLFMHGGHTNRISEFSWCPNERWVVGSLADDNILQIWSPSRVIWGRDHVQVSPRDLE

SEQ ID NO: 22661 - protein, 860 aa, Schizosaccharomyces pombe
  unsure (1)..(860): unsure at all Xaa locations
MDIDVLEFVDKVREYCXVVIDKLVIASIESAGDTLDRLPQLISLACEKGQETQVYERLNELASKSAIRVEQLSAENNQVCXSPVSLRYNLTIIRIFSKSVNQLSVVRSELRSLQSLMADLNTDIQASGRDLQNMVSNYIKRGSFNLKKLSLIKFLNFDYAENXQLYQKQQLNSLSTSERFLTKYHNLVRSCMQVLHQVQYSQELLSKKQYLPTLRICSEISEVHLKRLDGLGMYSTIQQYIVTTKEAICSAVMEDLHEWLFSIRQKLPLVGKSCSQQIDEARRRWAREYKEDLVNLSSKTSISLELYLLEMMDCMLRFVSVLLTFSVSPLDNEIVKISFEPLYICLQVHSYLGLLSSFRSSFERDRRRQQEFLAPKSLTTLDMAVVSEWLNSIAGFMIVEYYILQCIPNFRSYEEVQNIWTIICEKLVETILSVAFTEQSTTTIIKLKNQIVLLMHTMERFGFSVESLRNLCVELIDAFGGALILKHSVFFEEAFEKDVYAPMIVETQEEYDHYIAPYWNFPSEPFPRTMSFSKMCPLCCTTLSKFVRHFFMFLNDSVILATEVNEKAPRFYRRFILRSLVDRLKSLYPKLALSQMSQLVKNFYAFEDPLLQIEKSLVLNKPIHQIGAEASSSNNVKSTELLEGLANARKSALHEIFVKINLKIDDFLGLAEYDWTTTQVRKDVSGYLQEMVTYLQTMYLESLAGLPKHDKSYVYLETLDHLCTAMVDLLSDPSIRKVTTAAAEGFKLDVEYLESFAAQVPDQSIVNADSFIELRQCANLLLGDNMEEYLDTDKFMRDFNRLQPAVAIKFLERYNIPACLQDNFTNLLCRHINNYSANPLSNDRPKRRAIEILIATLKKR

SEQ ID NO: 22662 - protein, 860 aa, Schizosaccharomyces pombe; identical to SEQ ID NO: 22661
  unsure (1)..(860): unsure at all Xaa locations

SEQ ID NO: 22663 - protein, 363 aa, Schizosaccharomyces pombe
  unsure (1)..(363): unsure at all Xaa locations
MTVLNTTDKRKADDTVNKLDGKLKQPRLDNFFKTNTSSPALKDTQVLDNKENNSVSKFNKEKWAENLTPAQRKLLQXVLLTMXARKLEKVVNLFRLEIDTLESSWFDALKDEFLKPYFLNLKEFLMKEWQSQRVFPPKEDIYSWSHHTPLHKTKVILLGQDPYHNIGQAHGLCFSVRPGIPCPPSLVNIYKAIKIDYPDFVIPKTGYLKLFSLYIFSFXDLAFCXXSRYLVPWADQGILMLNASLTVRAHQAASHSGKGWETFTSAVLQVALNRNRKGLVILAWGTPAAKRLQGLPLKAHYVLRSVHPSPLSAHRGFFECHHFKKTNEWLEEQYGPEKCINWSAVSEQKAKIKSSELESSSTE

SEQ ID NO: 22664 - protein, 306 aa, Schizosaccharomyces pombe
MNAKLSSSGMVLKELPEVALQKISSNYYWAVFAVFLLCAIVFPLVSIFSLPQKQTYHRFFSILSLVSCLAYFTMACNYGLKNVFSSASFFREVSVRMVYYVRYIQWLINFPLIIVMLHWTVGVSILEIAYVVCYVLFAIVCLLAAALTSSPYKWAYYGFSFVGYFIALAHSVVLHKKYASRLETSARLGFLWSIVYLHVIWFLYYACWILSEGLNVISPIGEAIFYSILDLFEFGFFGAAFSWMLDLVGIENFKSPQSIPLGACSPADDKFSMCPDMEAQNQADDLAVETRIQISNLPSSPTKNNC

SEQ ID NO: 22665 - protein, 766 aa, Schizosaccharomyces pombe
  unsure (1)..(766): unsure at all Xaa locations
MSATNGPQPQDLNRIVLDYLAKKGYSRTEAMLRLEASGSGVSVEEKLKSIEETPDAYTHTYTILRDWVDSSLELYKAELHRILFPIFVHSYLNLLSQDHYEAGKLVILEEVTNLLHVCFDDLRTRGVFELFXILISFFIYXVYNLSLFLKLIPLDHPYLILYKDKXXFYXRAIAKQFYELFKDDHTDLHDFDVKNLKSLSLPSHVAEDRTAQQYRQNKYQLHFSRITFDLLLHFLFENVSNGGSIIIKLINQHIDIHIVPGRPTVLENAKVINEQEGITGQSFERGDAQLQPVKLQQMPMDKEMEKIVEMDLEEEDMMHQNDPNNQSPKLLKEFRKLHEPNAEDAPSRDYIPLPPHKGVDILSEVEAVKDWSKRLHLGPRASLPSVCMYTFHHTNNNMNCAEFSPDSTMIACGFQESYIRLWSIKADKKSLPKSTSVEDSDGSVRLLSHSGPVYGTTFSPDNKYLLSCSEDASARLWSVDTKTALVAYKGHTGPVWDVAFGPFGHYFATASHDQTAQLWSCDHIYPLRVFAGHLSDVDVXLLSFLRNVFPYDXLVFSCVTFHPNSAYVLTGSSDKTCRLWDVHRGHSVRVFNGHTQPVTAVAIAPDGHTMASAGMLYICYYXXFYXFDXRSEGLIHLWDIGTGRRIKTMRGHRGNIYSLSFSRESTVLVSGGSDCTVRAWDVFKTNYNNPVSSSLTGSVVTPFSAKTSTFNEVNWSTRYEKMXWNRYIYXPSQTVRDQMVALYTKQTPIFNVSFTRRNLCLAISVS

SEQ ID NO: 22666 - protein, 378 aa, Schizosaccharomyces pombe
MADLYTKDWTDVKDKPVARVVFIHGFGEHVNAYPEFFEALNERNIEVYTFDQRGFGHSRKGGPKKQGCTGGWSLVFPDLDYQILRASDTELPLFLWGHSMGGGLALRYGISGTHRHKLAGVIAQAPMLRCHPDTEPNFLLRKALTLVSKVHPNFLFDSDVQSQHITRDEAVNQRLQDDPLVSSVGSLQVFSDMLNRGTKTIELAPQFFLPLLITHGTDDNVTCSDSSKEFYENAGTKDKTYQSYPGFYHSLHIEKKPEVYEYLDKVAAWIYEHSKPSETVKSEQETAVEHPKPTATTSAPSASPTGVPVEEESHKATSDAVPPAEAKPEPVPASAAERAPTSESTTVPETIVASTTKVISEPAPRVTTAATADIVTNK

SEQ ID NO: 22667 - protein, 1175 aa, Schizosaccharomyces pombe
  unsure (1)..(1175): unsure at all Xaa locations
MTTELTNVSLEEAITEKTSENRRKRDSDVLQTEEVDLVCLNSCRFYNETRSQLREKRFFVGXNLYINILFLISNVKRIRASRNQDNRPERQSRLQRSSSLIEQVRGNEDGENDVLNQTRETNSNFDNRVGVIECIHLVNFMCHDSLKINFGPRINFVIGHNGSGKSAILTGLTICLGAKASNTNRAPNMKSLVKQGKNYARISVTISNRGFEAYQPEIYGKSITIERTIRREGSSEYRLRSFNGTVISTKRDELDNICDHMGLQIDNPMNILTQDTARQFLGNSSPKEKYQLFMKGIQLKQLEENYSLIEQSLINTKNVLGNKKTGVSYLAKKEEEYKLLWEQSRETENLHNLLEQKKGEMVWAQVVEVEKELLLAEKEFQHAEVKLSEAKENLESIVTNQSDIDGKISSKEEVIGRAKGETDTTKSKFEDIVKTFDGYRSEMNDVDIQKRDIQNSINAAKSCLDVYREQLNTERARENNLGGSQIEKRANESNNLQREIADLSEQIVELESKRNDLHSALLEMGGNLTSLLTKKDSIANKISDQSEHLKVLEDVQRDKVSAFGKNMPQLLKLITRETRFQHPPKGPMGKYMTVKEQKWHLIIERILGNVINGFIVRSHHDQLILKELMRQSNCHATVVVGKYDPFDYSSGEPDSQYPTVLKIIKFDDDEVLHTLINHLGIEKMLLIEDRREAEAYMKRGIANVTQCYALDPRNRGYGFRIVSTQRSSGISKVTPWNRPPRIGFSSSTSIEAEKKILDDLKKQYNFASNQLNEAKIEQAKFKRDEQLLVEKIEGIKKRILLKRREVNSLESQELSVLDTEKIQTLERRISETEKELESYAGQLQDAKNEEHRIRDNQRPVIEEIRIYREKIQTETQRLSSLQTELSRLRDEKRNSEVDIERHRQTVESCTNILREKEAKKVQCAQVVADYTAKANTRCERVPVQLSPAELDNEIERLQMQIAEWRNRTGVSVEQAAEDYLNAKEKHDQAKVLVARLTQLLQALEETLRRRNEMWTKFRKLITLRTKELFELYLSQRNFTGKLVIKHQEEFLEPRVYPANRNLATAHNRHEKSKVSVQGLSGGEKSFATICMLLSIWEAMSCPLRCLDEFDVFMDAVNRLVSIKMMVDSAKDSSDKQFIFITPQDMGQIGLDKDVVVFRLSDPVVSSSALPPSTAP

SEQ ID NO: 22668 - protein, 1066 aa, Schizosaccharomyces pombe
MDEEFENDFPYKVMLNQQQDPSDAQSSPTFVPSANPSLTTPWLQTTPSANRPTWLPLQQHMHQLRHTGLLPAVESSFVHGHRRSASAGVGMGNFSNQATIPSNSPAVSNMQPPTQGGQPLYPTNFFTTSVSASSDSFPNSPTVPSKFSLNPSVATSTNISPRRHAKSHSVASVSSPNSHNAVPFTPHAFVPPVNNASPLPALNTLPQLLRPRNLDAQWRPSSLSQTNSPTHAANPSFPGTIVTHNTSNFRPEGGGHRHRRSTGSLSVGSSGSGFSSGGSGNPRKNLFSPYLPQSSIPALLAERRLVTGILIVSKKNRSDAFVSVDGLDAEVFICGSKDRNRALEGDVVAIELLDVDEVWAGKLEKEENRRRKDPISTRGSFDNLRIDAVPFEVPQRSAIKARDDEQVEGQTLFLLDQKQLGADEKPKYAGHVVAVLQRAPGQVFSGTLGILRPSSAANKERQTSSGNQGSSNNSGNDKPKIVWFKPSDKRVPLIAIPTEQAPTDFLGNDQAYAQRLFLASIKRWPVTSLHPFGMLVGELGSMDSMSAQVSALLHDTGVHSEPWEGSAATSAVTALNALSDNFLNVAGCADYRSEDVFLFVKNDVSKAAVSEVKQHESNINSSSATDFVSSAFHIRPTSTGYHVGIHVTDVSRVIEPGSPLDRELQRRSIAVNLCQKSVPLFPTTLGEALSLREDKDCYTMSLLLDVSSTGKIRGTWIGWAVIRPRKAYTMKEADELLQTDARLRLFHTVSSRLRTHHLGTDVPLSRYCRLVRRWDEESCSFDPNETNLFISSAVEVLRETLLDAANRAVASHLRQEFRENAFLRTQRLPSRENCRILQSMAIQMGCVLDLSSTKSLLRSLSLIEDDTVRNILQLYYYKVTPRAVYEMQKYKGNLASQMMSLGIEDESDDLTHFTAPLERYGDIVVHYQLQLLLRGELASEKRLRVWSQAANDASRRLVISKFAQETSIHIKIFSDWAESQVWQDGLVCFVAPSYFDVFFPSLGMEKRVHLDLLNLTHVRFEEDQGILSLYDESGAVTVVKLLTSVKVKLFVQLSTPPLINVSNVEF

SEQ ID NO: 22669 - protein, 305 aa, Schizosaccharomyces pombe
  unsure (1)..(305): unsure at all Xaa locations
MNYQRLEKLGKYEFEVPKFAISLTXVGEGTYAHVYKGQNRVTGEIVALKVIRIDADEGTPSTAIREISLMKELRHPNIMSLSDVLQTENKLMLVFEYMEKDLKKYMDTYGNQGALPPSQVKNFTQQLLKGISFCHENRVLHRDLKPQNLLINSRGELKLADFGLARSIGIPVNTFSNEVVTLWYRAPDVLLGSRVYSTSIDIWSVGCIMAEMATGRPLFAGSNNEDQLLKIFRLLGTPTEQSWPGISLLPEYKPTFPIYKAQDLAYLFPTFDPLGLDLLRRMLRLQPELRTTGQDALQHAWFLTA

SEQ ID NO: 22670 - protein, 309 aa, Schizosaccharomyces pombe
KIKTYKPISPGLRHLKRPVSDYLWKGKPFRPLTVAKRKKGGRNETGRITVRHQGGGHKQRIRLVDFERKVPGVHRVIRIEYDPGRSGHIALVEKLNSETANKSYILACDGLREGDTVESFRSLLKTGSNGEPVEMDPVLAAEIEDGTFAAKNLKPGNCFPLRLIPIGTVIHAIGVNPNQKAKLCRSAGSSARIIAFDGKYAIVRLQSGEERKILDTSFATIGVVSNIYWQHRQLGKAGRSRWLGIRPTVRGTAMNPCDHPHGGGGGKSIGNKPSQSPWGVLAKGGYKTRRGKNVNKLLVRDRPRGKEKR

SEQ ID NO: 22671 - protein, 505 aa, Schizosaccharomyces pombe
  unsure (1)..(505): unsure at all Xaa locations
MSLTVWNIESIKDVAEMLGIGNLADEPAAAIAMDLEYRIHQVVQVGFVKVDYEILLSLEEAKITKKLLLVFYDAFQFARXSALFXHXTXFSNSIXFREATKFMVHSKRTVLTSADISSALRTLNVEPLYGFNNSRPLEFHEAAVGAGQNSLYYLDDEEVDFEKIINAPLPKVPRNISYSAHWLAIEGVQPAIPQNPTPSDHTVGEWASKGTSGVMPGASTAAKEARNGVTSMDNVEIKPLVRHVLSKELQLYFERITSALLDETNVELRDAALSSLRDDPGLHQLLPYFIMFLSDSVTRNLGNLVVLTTLMHMAWALLDNPNLFVEPYVQQLMPSILTCLVAKRLGSDPNNHEHYALRDLAAFLLGIVCDRFGNVYYTLKPRVTRTALKAFLDNTKPYSTHYGAIKGLKTMGKEAIRVLVVPNIKVYEVLVRKTLEKGNEEEIYEANKCMDALYDALLLLRDDQLPNQRTLPPNASGLLEKNVGSLMAEKIMKENDTSLLLGLLE

SEQ ID NO: 22672 - protein, 623 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGENDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEAPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVD

SEQ ID NO: 22673 - protein, 582 aa, Schizosaccharomyces pombe
  unsure (1)..(582): unsure at all Xaa locations
MSKRGADHQLTKDQDDSDDDRHGPVEVPKEASADVMATRKYVTMKHSSSIFXVLMYXIAKPKSRKRPTSGVSSPGIFANLAAKPVSLPASTTQFTFGKPAVTANNDSDIHLKKRGLNKSFIDAVIKSVDNNPFGNLSPLFDEYRQHFSSIEKKPAEGNAFIVSTSFLSNVFLEQPTSNAVVSEVNPQQQKSQDSSSFVTEKPASSEKEDKEKPLVPPGAPRFGFSAPALGSSFQFNSSAFTPKGSFGEKSATEAEAKEKETSSNQTATGTAATTTNQFSFNTAANPFAFAKKENEESKPLTPVFSFSTTMASADASKETKQTHETKDSKSEESKPSNNEKSENAVEPAKGNTMSFSWTPDKPIKFDTPEKKFTFTNPLSSKKLPASSDVKPPSAAAVGFSFGTTTNPFSFAAPKSSFPTSSTPASVGAEKSEETSNGNKSEQEEKENGNDETRSNDSLVSGKGKGEENEDSVFETRAKIYRFDATSKSYSDIGIGPLKINVDRDTGSARILARVEGSGKLLLNVRLCQDFEYSLAGKKDVKVPAASTDGKSIEMYLIRVKEPSTAEKLLAELNEKKVSKSEN

SEQ ID NO: 22674 - protein, 609 aa, Schizosaccharomyces pombe
  unsure (1)..(609): unsure at all Xaa locations
MEEPEEATQATQEAPLHVSQNIAKQVVNNENVFMKLVMTRMLDGKTEVIPLTTDVHNGFWRFGRHKSCEVVLNGPRVSNFHFEIYQVYKIIVASXTRLVLIELQSLXDIIIXRNDPGHRNDSDESENVVFLHGKSKGLKNLLKSSASSTFSNNFRHSSNGTFLNFVSESLIRLQFTDVIXERLAKNSRTILSNGDEIRIGLGVPKDEICTSFTLKEIVDVEFTSSLLTVLXLFLCQVPVKHSRDSQKNMIKSENSHYEIIRTLGSGTFAVVKLAVEVNSGKWYAIKIINKRKILLTSSEKRATEMFQREIDILKSLHHVSIILCSPFFIRKTPSXHLSFSQELVQCHEIFENDDELFIVMEYVEGGDLMDFLIANGSIDEQDCKPLLKQLLETLLHLHKQGVTHRDIKPEVYLVYXXESLTCRTFLXTNDFHLKISDFGLAKVIHGTGTFLETFCGTMGYLAPEVLKSKNVNLDGGYDDKVDIWSLGCVLYVMXVCRLXSISNEPSCLNFFQLLIHRLTASIPFASSSQAKCIELISKGAYPIEPLLENEISEEGIDLINRMLEINPEKRISESEALQHPWFYTVSTHEHRTPPSSSEHEATEQLNSSS

SEQ ID NO: 22675 - protein, 215 aa, Schizosaccharomyces pombe
  unsure (1)..(215): unsure at all Xaa locations
MSDYEEDEAFGMDGAVMEEEVDELEMIDENGQSQQGVSHPGEPSTTVITEDVASSKTAQSGKAVAKEDRTTTPYMTKYERARILGTRALQIRXVDAWIYNKASYKGTSVIAXVLNRYAVLQSWSLKKNDIVKNFFFIFXLGLSDYDEFCFFSIELSFNFXLFILSMNAPVLVDLEGETDPLQIAMKELAQKKIPLLVRRYLPDGSYEDWSVAELI

SEQ ID NO: 22676 - protein, 1333 aa, Schizosaccharomyces pombe
MSYANYRYMKARAKRWRPENLDGIQTSDEHLINLFAKILSKHVPEIGKFDPNKDVESYISKLDQHFTEYPSLFPNEHTKRQYTLNHLEELEQQFAERMFSENGSLTWQELLRQTGKVQGSNKGDRLTKTFEGFRNQLDKVQFIRKLMSKANVDDFHTRLFILWMLPYSLRKLKERNYWKSEISEIYDFLEDKRTASYGKTHKRFQPQNKNLGKESLSKKNNTTNSRNLRKTNVSRIEYSSNKFLNHTRKRYEMVLQAELPDFKCSIPCLIDTGAQANIITEETVRAHKLPTRPWSKSVIYGGVYPNKINRKTIKLNISLNGISIKTEFLVVKKFSHPAAISFTTLYDNNIEISSSKHTLSQMNKVSNIVKEPELPDIYKEFKDITAETNTEKLPKPIKGLEFEVELTQENYRLPIRNYPLPPGKMQAMNDEINQGLKSGIIRESKAINACPVMFVPKKEGTLRMVVDYKPLNKYVKPNIYPLPLIEQLLAKIQGSTIFTKLDLKSAYHLIRVRKGDEHKLAFRCPRGVFEYLVMPYGISTAPAHFQYFINTILGEAKESHVVCYMDDILIHSKSESEHVKHVKDVLQKLKNANLIINQAKCEFHQSQVKFIGYHISEKGFTPCQENIDKVLQWKQPKNRKELRQFLGSVNYLRKFIPKTSQLTHPLNNLLKKDVRWKWTPTQTQAIENIKQCLVSPPVLRHFDFSKKILLETDASDVAVGAVLSQKHDDDKYYPVGYYSAKMSKAQLNYSVSDKEMLAIIKSLKHWRHYLESTIEPFKILTDHRNLIGRITNESEPENKRLARWQLFLQDFNFEINYRPGSANHIADALSRIVDETEPIPKDSEDNSINFVNQISITDDFKNQVVTEYTNDTKLLNLLNNEDKRVEENIQLKDGLLINSKDQILLPNDTQLTRTIIKKYHEEGKLIHPGIELLTNIILRRFTWKGIRKQIQEYVQNCHTCQINKSRNHKPYGPLQPIPPSERPWESLSMDFITALPESSGYNALFVVVDRFSKMAILVPCTKSITAEQTARMFDQRVIAYFGNPKEIIADNDHIFTSQTWKDFAHKYNFVMKFSLPYRPQTDGQTERTNQTVEKLLRCVCSTHPNTWVDHISLVQQSYNNAIHSATQMTPFEIVHRYSPALSPLELPSFSDKTDENSQETIQVFQTVKEHLNTNNIKMKKYFDMKIQEIEEFQPGDLVMVKRTKTGFLHKSNKLAPSFAGPFYVLQKSGPNNYELDLPDSIKHMFSSTFHVSHLEKYRHNSELNYATIDESDIGTILHILEHKNREQVLYLNVKYISNLNPSTIMSGWTTLATALQADKAIVNDYIKNNNLNI

SEQ ID NO: 22677 - protein, 322 aa, Schizosaccharomyces pombe
MSSLEQLKATGTVVVSDTGDFESIAKYKPQDATTNPSLILAASKKPQYAALVDAAVDYAKAKGGSINSQIEIAFDRLLIEFGTKILAIVPGRVSTEVDARYSFDTQTTIEKARHLIKLYEAEGIGRERVLIKIASTYEGIQAAKQLEEEGIHCNLTLLFSFVQAVACAEANVTLISPFVGRILDFYKAKNNRDYTAQEDPGVVSVSNIFNYYKKFGYKTIVMGASFRNVGEIKELAGVDFLTISPALLEQLNNSTDAVPKKLDASKASSLNLEKVSYLTDEPKFRFDFNNDEMAVVKLSTGIAAFAKDADTLRTILKAKLEA

SEQ ID NO: 22678 - protein, 583 aa, Schizosaccharomyces pombe
MGFKLNPFSKKPKDEEPLPLEQYEASEQKILGLVTKKEAKLLAIAGTGFLLDSYDLFIINLVSPILAYLYWGGLTGHQDYPSGIRGVVNAATNIGNIMGQLLFGFLGDFFGRKFVYGKEMMVVIIATILIICLPDRIPTPTAKMMWLFAFRVMLGIGIGGDYPMSASITSEQSLINRRGALLAWIFSNQGWGTLAGCVATLIILACFEKPLNDRGEYTKLNGVWRIQFGIALFPAVIVLIPRLRMQESEQFKNSKNMKSPGEGDLDSASQIELHDFKKKESLTAEFTTSSPSTASLSDKKNPGSVHIRPNNEVAPSSAPSRAPSTTSVESNTEGKESDIQTGSSFVSYFKEWRHAKLLIGSALSWFLLDIAFYGINLNQSVILQEMGFNKGVNEYHILQKNAIGNLIIAVAGYIPGYWVSVVLIEVMGRKWIQIQGFLICCLLFGVLAGTWETISTGGRFACVALAQFFFNFGPNTTCFVIPAEVFPSRVRAFSHGICAACGKAGAILSALLFNKLTEVIGFGNVLWIFFGCMVAGAVVTLILPETANRDADLIDRLEIAAMQQGRTSIIDRSEKWAWWKHGI

SEQ ID NO: 22679 - protein, 564 aa, Schizosaccharomyces pombe
MFGVYFVLLFLSSALIHVANAGSNAEWRKRIIYQILTDRFAVDDGSTDNPCDPDANQYCGGTWKGIENKLDYIEDMGFNAIWISPIDKNIEGDIDGAGYAYHGYWNTDYESLNEHFGTEDDLVSLITAAHKAGIWVMLDSIVNSMALAPPLADADYSSLNPFNKESYFHPYCLIDWDITDNETNVMDCWQDSGVLLADLDVESSDVSSYLSDHFKSLISKYDFDGLRIDAVKMMNYTFFPDFVDATGVYSVGEVFSYDPDTMCSYMSVLPGVTNYFLQLYINFSFTATGAGFTLIPTYQEVMASNCSKYDSTLMLTFIENHDLYRFPYYTSDQSQIMGALSFVLIWDGIPSIFYGQEQGFNGGEDPANRPALWLTDYDQSNPYYTVIKTMVAFRKFVITQDPDWVTSTYQSIESAVDHYVGQKNDVLVMFNNMGVTNNLTIYEVETNYTANEVVSDVFGHRTLTVGADKTLTASMTNGYPLIMYPHSKMSGFTLPTVNRTVMPSTSATATTTVYTSYYSPSYSARSFTGTGSIFTISSSSRLILSFKTLVFGLGVTAMLFVLFF

SEQ ID NO: 22680 - protein, 662 aa, Schizosaccharomyces pombe
MTAQDSIPSLEQLVQQKRVKEEKAARPKFLSKAERARLALERRQKEVEEAKAKQNDKLLDLRKRTFTNHLENNELADDEKKSQVSSVSSNNSGTESSATDEAFSMTIRQRYMGIKPPVVKKRRRNADKKFVFDWDATDDTMKDAETSASPEATIAVFGRGKLGGFDDQSIRKAKSNSGLIQRLLQGTEQDKARAHELIQLQEKRAKKIDWDDVPWREKPLEAMKPRDWRILKEDYNISIKGDDLPNPLRNWEEAGLPSEMLKVLKKVNYKEPSSIQRAAIPVLLQRKDLIGIAETGSGKTAAFIIPLIIAISKLPPLTESNMHLGPYAVVLAPTRELAQQIQVEGNKFAEPLGFRCVSVVGGHAFEEQSFQMSQGAHIVVATPGRLLDCLERRLFVLSQCTYVVMDEADRMLDMGFEDDVNKILSSLPSSNASEKDGSILATANSSSSRRQTIMFSATLPPRVANLAKSYLIEPVMLTIGNIGQAVDRVEQRVEMISDDSKKWRRVEEILESNRFSPPIIIFVNLKRNIEAIAKQLNAIGWHAVTLHGSKSQEQRERAIEQLRNKTADILVATDIAGRGIDIPNVSLVLNYNMAKSIEDYTHRIGRTGRAGKSGTAITFLGPEDTDVYYDLRVLLSRSAKAHIPDELRNHEAAFVRHAAITQ

SEQ ID NO: 22681 - protein, 204 aa, Schizosaccharomyces pombe
MSIMEYNGGSCVAMAGKNCVAIASDLRLGVQSISLTNNFPKVFAMGDKTYLGLTGLATDVQTLYELFRYKVNLYKFREERQIQPKTFANLVSSTLYEKRFGPYFSFPVVAGVSNDNTPFICGFDSIGCIDFAEDFIVSGTATEQLYGMCESVYEPNLEPDDLFETISQALLNAQDRDCISGWGCVVYVITADKCIKRLVKGRQD

SEQ ID NO: 22682 - protein, 924 aa, Schizosaccharomyces pombe
  unsure (1)..(924): unsure at all Xaa locations
MASTATQNASTRYSQIWIDQPASLPFQDSINLIKEDKEKWKKEKTAFLIDYDWFEGYVDFIYGEGDNPGPITQWRLLDEKNELKHSLEESIDYSIVSASLWHMLVEWYEFSLKVSTVLVKGIINXIQNSYSYMFXKHCVLVLNISLIYVVCITSHGAXIYRFPWILRPLFNSHYVISXLKYRFGLEGLAIERKVLLVGLAAEQKPFVDIYPINFTLHVLFDPINGENTSYSPLYQIDEPYHSDEPYAFSFSRSDTLRSLYKQVMEAFQISDGTSFRLWYLNKSNLSSRFVSLSEFNDQPAIALLSEYAVCMTIFEIDIADGSLLLEFQHPNGEWLSDSITKEQNLTINKEIGLCGLYNLGNSCYMNSALQCMIHTHELTKYFLSDSYEKDINYNNPLGMMGKVALSYASLLKMIHHTADMHSVSPSSFKFIIGEFNTYFSGYRQQDSQEFIAFFLDGLHEDLNRIQIKPYFERPDLFDEHPLHVQRVANQCWDIHTKRNDSIIVQLFQGMYKSTLECSICYQKSTAFDPFMYLTLPLPTSAKWRHKVVYVPPFGTQSPVELYLELLMESTVIQMKFQATEKLQKMGLECGELTACDIYRGKVYKVLKNKDKISKKIHKWDHVVLYGSTANGLTIPIVHGCKRPAMPGSYQSNDVFGFPLQLNVRSRNVLTNDLVKEIVELYRVYAGIDVAIGTLQLGLKRMESKAGKWECIKEIEVKRFEIVEEEEIVIDDKTVIMCLWNDQQYEKLFYNCEWIFEKIQFHMESITLEDCLLEFSKPEQLDLQDSWYCPGCKAFRPATKRLEIWRLPKILVIHLNRFSGHGGDLRRRRKRRDLVVYPVFDLNLKQFLSPFIKDHEWLSSQKSMLYDLYAVDNHHGFMSNGHYTAYARDASSQTFFKFDDTAICEIDPEDIVTSSAYVLFYRAKN

SEQ ID NO: 22683 - protein, 546 aa, Schizosaccharomyces pombe
MSSSQQSGRANELRTPGRANSSSREAVDSSPLFFPASSPGSTRLTTPRTTARTPLASSPLLFESSSPGPNIPQSSRSHLLSQRNDLFLDSSSQRTPRSTRRGDIHSSVQMSTPSRRREVDPQRPGVSTPSSLLFSGSDALTFSQAHPSSEVADDTVRVIWGTNVSIQESIASFRGFLRGFKKKYRPEYRNELMPPPDAEQLVYIEALRNMRIMGLEILNLDVQDLKHYPPTKKLYHQLYSYPQEIIPIMDQTIKDVMLDLLGTNPPEDVLNDIELKIYKIRPFNLEKCINMRDLNPGDIDKLISIKGLVLRCTPVIPDMKQAFFRCSVCGHCVTVEIDRGRIAEPIKCPREVCGATNAMQLIHNRSEFADKQVIKLQETPDVVPDGQTPHSVSLCVYDELVDSARAGDRIEVTGIFRCVPVRLNPRMRTVKSLFKTYVDVVHIKKQDKRRLGTDPSTLESDIAEDAALQIDEVRKISDEEVEKIQQVSKRDDIYDILSRSLAPSIYEMDDVKKGLLLQLFGGTNKSFHKGASPRYRGDINILMCGD

SEQ ID NO: 22684 - protein, 139 aa, Schizosaccharomyces pombe
DLVASFDDIVKVIESPDAAGVHIVDARAHERFLGNVPESRPGLASGHIPTSINIPFTETTAAGITAPKPEEDLEKVFSSHGLTDKSVPIITSCGSGVTASVLFAALKECGFKDVRVYDESWSGYGKRANEDSSLLATGP

SEQ ID NO: 22685 - protein, 420 aa, Schizosaccharomyces pombe
  unsure (1)..(420): unsure at all Xaa locations
MKNDLILRAAKGIILSLXQFVSAYSHYEIIGEEVERPPVWIMVCKKKDDYKFANVLLEASWKISSWYVHDLNLIVCTNETIEYHKLRAKQSFFEMCQTPETACELTLQPVTRFKGLLDAAIIFSDILVIPQALXGMQVVMLEQKGPHFPKPLVVPEDIDLLEKTPNISAKLGYVMDAISLTREKLDGQVPLMGFSGAPWTIMAYMIEGGGSKTFAKAKSWLFRYPEASHKLLKIITDATVSYLIQQVYAGAQVXVNSDYFLYXFKXYIALQIFDSWAGELSPEDFTEYAYPYLVRICQEVKQHLKKKRRDEVPMIVFAKGAWYAIDQLCDSGYDVIGLDWTVSPKEAVRIRGNRRVTFQGNLDPNILXWHREIIEARTKEMIQDFGGGKQGYIINLGHGXYXLCQSDDVRFFXREMSSYG

SEQ ID NO: 22686 - protein, 111 aa, Schizosaccharomyces pombe
  unsure (1)..(111): unsure at all Xaa locations
MKLAIGRLLSPLFLKNPQKPLIITKRFYSTPGERRIKDILTEXLSPSSLRVIDVSGGCGSMYQVAIKSKAFQXENTLAQHRLVNSILKEEIRNMHGLNLSTEVEDDISAGG

SEQ ID NO: 22687 - protein, 662 aa, Schizosaccharomyces pombe; identical to SEQ ID NO: 22680

SEQ ID NO: 22688 - protein, 204 aa, Schizosaccharomyces pombe; identical to SEQ ID NO: 22681

SEQ ID NO: 22689 - protein, 290 aa, Schizosaccharomyces pombe
  unsure (1)..(290): unsure at all Xaa locations
SSIGTGYDLGLFFSPDGRLFQAEYAYKAVENARXGGLNFLIDXFXHCISTCIGIKCEDGVILALEKVVTSKLLKPRVNNRIGSVDRHIGIATTGFIPDGQHIVKRARDEATSWRDNYGSPIPGTVIADRLGNYVQLFTCYSSVRPFGVMSFVATYDSEGPHLYMVEPNGVYWGYNGAAAGKGRQVARNELEKLNFSSLKMKDAVKEAARMYVLLCXVQFFFILFANNSLFFRLYATHDEENNKEHEIEMTWVGVETNGIHTPVPDELLQEAEAYARRIADGEEEDIAMQE

SEQ ID NO: 22690 - protein, 521 aa, Schizosaccharomyces pombe
MRIWILIFFSFIKLVSSLQYTGNGVLALDFVAKTFPNQENQLEKRDYTYSPSGITSFPLDLQSYTYYTTTLSIGRPSISYTVAIDLDMPYTWLTYYNVMAFNPAYLGIVNSGTQWSTDELRYFLCKKESDSCYFGNASSSFHFVTSPSTFFIRYDDNITVAGINVQDSLSYSHYQALPDFQFGITLKEYVPSSMLPYKGVLGLAASTEINSIDYSDSISSFSPPTFLEQLVKEDILAYPAFSMYLDNQGNGSLLLGAVDTSKYQGQFVALKQTKLTHYAVSIYSVQFLNSTFFSNYSIITDAYFQTRETYIYLPAELAYSVMDNAGAYLSEGYFALNCDEIDLEAALIFQFGCNSTIKVPISLLVIGQVSNICLLGIRPSTDSEIVLGLLFFRNAYTFYHQSQKMIAIGQAFYNATSNLSAIVDQHIPGALTCSQYPTSVASTQLVQTSHFTSTSLSAVNISESVVYSYTSSSSMPSSAIPSFNISLISQNAVANAGNSFSPLSAMVIMMMSAVFLGLGII

SEQ ID NO: 22691 - protein, 636 aa, Schizosaccharomyces pombe
MSDNVQQQVDSVGSVTEKLQKTNISRPRKYIPPFARDKPSAGAAPAVGDDESVSSRGSSRSQTPSEFSSNYGGRREYNRGGHYGGGEGRQNNYRGGREGGYSNGGGYRNNRGFGQWRDGQHVIGARNTLLERQLFGAVADGTKVSTGINFEKYDDIPVEVSGGDIEPVNEFTSPPLNSHLLQNIKLSGYTQPTPVQKNSIPIVTSGRDLMACAQTGSGKTAGFLFPILSLAFDKGPAAVPVDQDAGMGYRPRKAYPTTLILAPTRELVCQIHEESRKFCYRSWVRPCAVYGGADIRAQIRQIDQGCDLLSATPGRLVDLIDRGRISLANIKFLVLDEADRMLDMGFEPQIRHIVEGADMTSVEERQTLMFSATFPRDIQLLARDFLKDYVFLSVGRVGSTSENITQKVVHVEDSEKRSYLLDILHTLPPEGLTLIFVETKRMADTLTDYLLNSNFPATSIHGDRTQRERERALELFRSGRTSIMVATAVASRGLDIPNVTHVINYDLPTDIDDYVHRIGRTGRAGNTGQAVAFFNRNNKGIAKELIELLQEANQECPSFLIAMARESSFGGNGRGGRYSGRGGRGGNAYGARDFRRPTNSSSGYSSGPSYSGYGGFESRTPHHGNTYNSGSAQSWW

SEQ ID NO: 22692 - protein, 310 aa, Schizosaccharomyces pombe
MEPLDAGKNWVHMDVIEQSKENIEPRKAGHSASALAKSSSRNHTEKEVAGLQKERMGHERKIETSESLDDPLQVWIDYIKWTLDNFPQGETKTSGLVTLLERCTREFVRNPLYKDDVRYLRIWMQYVNYIDEPVELFSFLAHHHIGQESSIFYEEYANYFESRGLFQKADEVYQKGKRMKAKPFLRFQQKYQQFTHRWLEFAPQSFSSNTNSVNPLQTTFESTNIQEISQSRTKISKPKFKFSVYSDADGSGKDGQPGTWQTLGTVDQRRKENNISATSWVGEKLPLKSPRKLDPLGKFQVHCDEEVSKE

SEQ ID NO: 22693 - protein, 1461 aa, Schizosaccharomyces pombe
MASKMPEGSPPTSRSIQSRNSSYSTSSNERIGTPSTISLSENSDLSKLQSTNDFESREDLSLTSDDNNDPEYVMCYNTVYHQKTKINDKLLSETEQLRKIYPLESRVFPKPTIVKEITNERTKRYTFYDDDAPLTNQHTVLDEATYNRILKRIDFFIEKVVEVPPTYHFLSLLNVQLRIQPIWWMDEFAERNGIESLLSALRNLGHYPERASKTPLESQIIQSLFHCLNSENCRRRYQSSAKCSVPGFNALGTIAETVLSKSLNSARMATFLLKFLCNKKGLSYFKAVIRAFEWLVEQKLSKTRFSAWMHSFNDVITGVRVCADSSPQAIVHMDEFEDTDCLIDYLVATLALIRDLCAAPPDLQLRCALRHELLSAGLQKAIDSLLKWRNRHVRDALQLLIKEHNADARRFRSGSDVNNVDRKCVKKQMNYREESHTPHGNTTRKTSTPVSNNRPTTPEQQAVWDVFQRIYTRFTGSEGSKESFIKLLEYFVTEPDNGKIQKSMQLLTHTLEALEGFKTAKADTNVGLTILSQRLLDKLGTAEEIAEYKTKYNGAMLENKHLKEQVESMLSQLNVGPRDPMQFLKKQLDELKAELNLRDNLLASMQREFETRYRAQIQAYNKLQSQMEHVQNSNEQHLQPGLLNKVSKSFDSVHRRNLSQDSLDAMTEQFSYHVEPNILSGSGIPVRVHTPSKTEDLDESFSGSEISSSPSPLLPDVSDTVEEQQKLLLKSPPPPPPAVIVPTPAPAPIPVPPPAPIMGGPPPPPPPPGVAGAGPPPPPPPPPAVSAGGSRYYAPAPQAEPEPKIDETSLTEEQKIQLEEARKQRKAADDAARAAIEKYTSIPSLRDLHKPTRPLKRVHWQRVDPLPGPNVFTKFCLNFDITAKVFIDNGLLDFLDEKFDNTPREDFVAVEISDQRSSLLPDTVEQNMAIILRSVSNMPVEDLVQKFLVEPDFLPASILYFDRASLASTNAYTDPFIPYSTDYTKKNPKEPTADVNSLSYFEKFFVLFVVNLRHYFQERMKALKFRSTLFGDLEILEVRMKEVIDTSDSIMEDKNFAEFFQVLLIIGNYFNEPYDRASAFSLYMIYRLETLRDSSSALTLMHYFDEIIRTRFPELLQAESTFKKIQSVSGYNIDAMVAGVDGAYDEFCDFQTSLKDGALSKCDQHHPDDKAYDILSEWLPEAKERIRNIKKLKTDMLTKLENTVKYLCEYDSIDKVRNSFFKNLNSFYEMYSIAKAENEERFEKEKRRIMSEDRDKLIRGRQKTSIVAKYRNKRELPEDSDDKQDTASKDKNSLETIDEKMEDASKIEGDAKTGDDNEMEDLDKMEDLEKPDYAEEKDPYITVMSELRSRIQNVPKRTVTVYSDEGVATLEPGAQGDDVVDKAKMILEKMEGHSQLLTSSANPDEEVLRAKLKAAERLQKPAIPRTRRKGHTEPKSAKSLLAELTNGSNASNLVENDRQKQ

SEQ ID NO: 22694 - protein, 1399 aa, Schizosaccharomyces pombe
  unsure (1)..(1399): unsure at all Xaa locations
MGSKGKKGKSSEVNLETSKNKEKNIKGKKKNSLDPIEKNKQETAGLQTTSRPTAKQLVGGSSWTGKIPVVLLNEHCQRSKWEKSDVKVVSQLLKDANXPIYRTHTYXNLLNRRQTKSKNYIFTSVVLAKKDPKNPSILDHVSLIPPKSYYENGYFPEKETLVEARNVGAVYALHRVRIYTYLFSSNHXPTLISNRXMSHKSLQHALPPEHRNIWFDMEKQKKEELKNKHSWLYNEDPFKAAKELQAARASSAAKPPPKASQKNEKVSLTSIKNTSLSHFSKFNFKYALPIHMSLENRRSLENLFRNMNTWDILEDTKNLEPDTSIVNDLISLGFRDIHAKEACQYCVSLEDALEWLIIHVPEDDLPTRFLPSDYTTGISVQNLNSANLAIHYNAKRMCVXHLFNTNYXQGFRETGYSFDLCFSTLQTFENNIQISSEYLQQHLIGESFDGNISLEPNSTEWDDDVSALQSILDNKVSKIENGCRVRIDYPTSEFGELFVDFRRPARSYPAHIPLMSLSSTKRMASYIKLSILKKMVVYAMDLRGECMLSWLYNHLQENIEDFLQNIGSLLNISAATIGVSLSSQNKSAPTAKKNNSFKPKLFRRSRELSEKLCNNWSERVKSPSYQLKVREREKLPAWESRRKIMDAIQHSQVVVISGETGSGKSTQVVQFILDHYLSSGEKDLQTVVCTQPRRISAISLAERVAFERDTTVGKEVGYSVHGEKSISKETLLEFCTTGLLLRRIQQHGLGFLSTLSCVVVDEVHERSIENDILLTLLKLVISRIPNLKVILMSATVNSDTFKYYFGNAGHLHIHGRTFPIKDYYIEDFAPKLNEDDDEEDVPRRKKKEYEIDYHLISRLVSSIDAELGSSSGSILVFLPGVSNIARCIREIKSKDGSKFEVLPLHASLNTSEQRRCFKTYTKRKIICATNIAETSITIDDVVAVIDSGRVKQIDYDVERDLVTFKETWASRAACQQRRGRAGRVKKGICYKLYTRGFEEKGMLGQTPPEVLRTALSQVCLNVVPLVKRFSSAGNSVNQGSIKKFMNSLIDPPNDATVDLALKKLIQVGALTVSEDLTGLGEYLVSNDVFLCETNIILGVITHDLKLGKLLVFGSIFGYLEPALTITAILSTKSPFLGDDEAREIRSKQSQGWGDVLADARVYHNWLEILETRGVKKTVQWCEEMHLHYTTLQQIRQNRNELSEAAQLLELTTKKLTGNFDWYSTENLTVLSTLIAAALSPNVVKCVYPDKKFVASFSGSLEMEQEARLTKFYDQNNQRLFIHPSSTMFVNSPNASRCTFVAYEQKVETTKPFLRNCTPINTYGMILLGANDILIDPLGKGLILDQAYCIKAWPKVVILLKMLKRCLDASLHERLESSSGLNYESEIHQCIRTLIAGNGV

SEQ ID NO: 22695 - protein, 282 aa, Schizosaccharomyces pombe
  unsure (1)..(282): unsure at all Xaa locations
MDSDMQNQNPHTNSKNSSSAGMAVDGHSVTKRXKINSFXEKSLXCICRLRSELMSLMVCNKLFYFVINXGFMTRMSNTPGISAFPDSDSNLLHWAGTITGPSDTVDFYFESLIFKVYEXCLVCLLVAALXWKINTHLCHYIFITVYSSFFFFIRLTXRKXYYEGLKFKISMSFPANYPYSPPTIIFTSPMWHPNVDMSGNICLDILKDKWSAVYNVQTILLSLQSLLGEPNNASPLNAQYVENISFTFFDYXQFLELQELWSKDPIEYKRLLMQRYKEIDEI

SEQ ID NO: 22696 - protein, 584 aa, Schizosaccharomyces pombe
  unsure (1)..(584): unsure at all Xaa locations
MAQKLDNFPYHIGREIGTGAFASYEFXFEKYYILTXASVRLCYDDNAKIYAVKFVNKKHATSCMNAGVWARRMASEIQLHKLCNGHKNIIHFYNTAENPQWRWVVLEFAQGGDLFDKIGGCMNLSFLLTDLQFEPDVGIDEDVAQFYFAQLMEGISFMHSKGVAHRDLKPENILLDYNGNLKISDFGFASLFSYKGKSRLLNSPVGSPPYAAPEITQQYDGSKVDVWSCGIILFALLLGNTPWDEAISNTGDYLLYKKQCERPSYHPWNLLSPGAYCKSXLKFLXTNDQRIITGMLRSDPFKRYSVKHVVQHPWLTSSTPFRTKNGNCADPVALASRLMLKLRIDLDKPRLASSRASQKXILHSCFIFLTLSISDSGFSMTQPAFKKNDQKELDRVEVYGALSQPVQLNKNIDVTEILEKDPSLSQFCENEGFIKRLVLFIXTXIFSNYMKKAKKAKNFYEICPPERLTRFYSRASRETIIDHLYDSLRLLAISVTMKYVRNQTILYVNLHDKRKCLLQGVIELTNLGHNLELINFIKRNGDPLEWRKFFKVCLYHRDFIYXSMXKNVVSSIGKPIVLTDVSQN

SEQ ID NO: 22697 - protein, 139 aa, Schizosaccharomyces pombe
  unsure (1)..(139): unsure at all Xaa locations
DLVASFDDIVKVIESPDAAGVHIVDARAHERYLGNVPESRPGLASXHIPTSINIPFTETTAAGITAPKPEEDLEKVFSSHGLTDKSVPIITSCGSGVTASVLFAALKECGFKDVRVYDESWSGYGKRANEDSSLLATGP

SEQ ID NO: 22698 - protein, 1213 aa, Schizosaccharomyces pombe
MSSKLVDAINEVAVSNKDKIELDGIKDDSFDGHLSITEATYDVDTFLKPSPALSKDWIRKLQKKWDREITYKGLYEYPETLARTQIRFQRHGLEGKIMGYKEVPELIEDLNSKNSSSFLRKPSSKNEFVRGSTSNIPFLADDSDVDAIAGEPSVKMALYGEDGLLQVPPGFSRGLSMTATSTTDNLNDEFDPEKWDTKKVKSSNRNFVTIHELNEHLKNVNSKHSEIDDLLPDKRSIVSLPPSTLNLHKQPDYAHVVDSSAPIENFQQLVPEMALDFPFELDNFQKEAIYHLEMGDSVFVAAHTSAGKTVVAEYAIALAQKHMTKAIYTSPIKALSNQKFRDFKHKFEDVGILTGDVQVNPEGSCLLMTTEILRSMLYRGADLIRDVEFVIFDEVHYVNDLERGVVWEEVIIMLPPHVTLILLSATVPNTKEFASWVGRTKKKNIYVISTLKRPVPLEHYLWVKQNMFKIVDQHGRFLMDGYKSANDALKKPDKPVIAKDNKNSARGRGAARGRGVQTNMMRGRGSAKSVERRDANTWVHLIGHLHKQNLLPVIVFVFSKKRCEEYVDTLTNRDLNNHQEKSEVHVVIEKAVARLKKEDRLLPQIGRMREMLSRGLAVHHGGLLPIIKEIVEILFQRGLVKVLFATETFAMGVNMPAKSVVFSGTQKHDGRNFRDLLPGEYTQCSGRAGRRGLDVTGTVIILSRSELPDTASLRHMIMGPSSKLISQFRLTYNMILNLLRVETLRIEDMIKRSFSENVNQTLVPQHEEKIKSFEEKLSALKKEMSDVDLKEIKSCLLSSESFKEYTKKMHFRAITTANGKRIFKDGRVIVFQQLDFTRTVGVLLGTSIRTNASDCTLEVAYLNPQNNLKRPSDLLAFADAFNDVYDNAIFDESNQFKYGLINLSGIERVCNTILRIDSGGIRDRRGGAFRKLSEQFASIKKFSDLLFEEVNWSKVRDFEFCEAFEKRNFLQNKLSGNPIISTPNFLTHFALAYQEYELESNIDNLSSYISDQNLELLPDYEQRIKVLQELGYIDAERTVLLKGRVACEINSTSELVLTELILENSLADFSCEETIALLSAFVFDEKTEVEPTISPHLQKGKEMILSVAEKVNQIQEHYQVLYFNEGNDFESQPRFGLMEVCYEWARGMSFNRITDLTDVLEGSIVRTIIRLDEVLRECRGAARVVGDSSMYTKMEECQNLIRRNIVFCPSLYM

SEQ ID NO: 22699 - protein, 104 aa, Schizosaccharomyces pombe
MATKLKSAKSIVPLLDRILVQRIKADTKTASGIFLPEKSVEKLSEGRVISVGKGGYNKEGKLAQPSVAVGDRVLLPAYGGSNIKVGEEEYSLYRDHELLAIIKE

SEQ ID NO: 22700 - protein, 500 aa, Schizosaccharomyces pombe
MTIDLNVIQSDIISARRAPENSLFIDGKFVSPIEPAAKPIPLINPATEEIIGTCANASAKDVDSAVENAYNTFRSGIWAKWPGKQRGLVLRKIAKMMREKRELLAGIDTINCGKPTPYALFDIDSCADMFEYYAEVAETDNPTVKVPLPNNPGFCAFEKRFPRGVIGVITPWNFPLKMALWKLVPAIASGNCVVLKPSELAPWSCLEFALICKEAGLPDGVLNVIIGSGKESGAALSCHPKIAYLAFTGSLATGKKIMHAAAENIVPLTLELGGKSPLIICEDADLSLAIPSAAFAIFFNQGEACTAASRLIVHESVADEVLGGLVSEANKLIIGNGLDPQVTLGPVVSKTQFEKIVSYIQSAINEGCKCVVGGLPRSEQKGYFIPPTVFTNVQTHNKIWREEIFGPVLAVKTFHTNEEALELANDSEYGLGSGVFSTNPKTLEFFSNNIEAGMCSLNNYHVVTHELPWIGWKHSGLGVGLSKHGYNEYMRLKQITQYVG

SEQ ID NO: 22701 - protein, 449 aa, Schizosaccharomyces pombe
  unsure (1)..(449): unsure at all Xaa locations
MGLPPKTIVLDNGAYHIKAGFAGGKVVXEEVHHVNKFHVSFTFFSXRXFLVEIPNCLTRSKDGNRLFLGNELANCNDFTTLQFRRAHEKVQHLXGSIIYEQNKYKDYVYXYXXGYLVHWSTETAVWDLVMRNVGVMEPSMADYSLLLTQPVFTMPSIEHNTIQLVFEEFQFDAYLPCTPAELIPWDHGSFTMNQEDAYTGQHGECVLVIDSGYSFTHIIPVIDFSVQEQAVKRVDVGGKLLTNYLKEVISYRKYNMMEETYIVNEIKESVCYVSQNFKEDMEICHEKPRSKLEICYALPDYSTGKHGYIVRDINQKIEQQVLNLSNERFMIPELLFSPSDIEIREAGIPEAVMQSVTHFPENIQAMLLENVVTIGGNCKFPGFHKRLSSELRSLAPANWEVKVFEPSDPICFPWKKASHMPLEHWNANKITRSEYSEHGANIMTRKRRI

SEQ ID NO: 22702 - protein, 545 aa, Schizosaccharomyces pombe
MNLGRCPLAPRSANIVLPKHDAVSKQKEYRIEEKTNEAQREEIITWKDNREDEGEVKTDFEVVNNENIITTTPKHQTVITPKSYRKSVKRIKHDAPQNEDIPVMKGLAPINADTESKAESMAAGKVLGSKNSSQKARLQEWKRQYKKAFPHFRFYLDGCDPSVAHRVKKQIQQLGGHVETFFSGNVTHVATVRAIQDVSVKYAKQDVITKARQLNMKIWSMEKLCNRVLKTLMENDQCTTNAPTKQGNDLSYLLYVEKVQGTNERDLSVPRQDFVHFRGPYLYVHDIANIYKPILLREWQKPLPDRDVPWPTFRATSIGRCPFVPETKYRLSTSKSLVAKNDQQLLQRQSQEPSLILRANSMKASLPDISNTGISGMNTNTTYNTNINNTPQTAISGITQDTSPSIRTNCHHCLDDGMQASGIVQSNLTSAAMSNNSAIRSGSAASVPVVTINGRDIAELKKRIIQQKSGMIGKDYSYKAMLHNTSQRKIRVDAKPGYCENCREKFDNFESHIRSSRHRRFAENNDNFKDLDELFALVQRPLRPD

SEQ ID NO: 22703 - protein, 415 aa, Schizosaccharomyces pombe
MDVSTQTRHATYFQDENQLQKDHIYVKKKSHIKLNTGVRAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRADSYDHDIRMLAKYLQEVTLMDEIFIGAHISFIAATAYYLSMQMLGHLDWTPCHVYYSGYTARQLKPCAIIIMECLVDAPNHHNAIYRKYSENRMKRVSAFAHNWVLSVI

SEQ ID NO: 22704 - protein, 1526 aa, Schizosaccharomyces pombe
MTEVISNKITAKDGATSLKDIDDKRWVWISDPETAFTKAWIKEDLPDKKYVVRYNNSRDEKIVGEDEIDPVNPAKFDRVNDMAELTYLNEPAVTYNLEQRYLSDQIYTYSGLFLVAVNPYCGLPIYTKDIIQLYKDKTQERKLPHVFAIADLAYNNLLENKENQSILVTGESGAGKTENTKRIIQYLAAIASSTTVGSSQVEEQIIKTNPVLESFGNARTVRNNNSSRFGKFIKVEFSLSGEISNAAIEWYLLEKSRVVHQNEFERNYHVFYQLLSGADTALKNKLLLTDNCNDYRYLKDSVHIIDGVDDKEEFKTLLAAFKTLGFDDKENFDLFNILSIILHMGNIDVGADRSGIARLLNPDEIDKLCHLLGVSPELFSQNLVRPRIKAGHEWVISARSQTQVISSIEALAKAIYERNFGWLVKRLNTSLNHSNAQSYFIGILDIAGFEIFEKNSFEQLCINYTNEKLQQFFNHHMFVLEQEEYMKEEIVWDFIDFGHDLQPTIDLIEKANPIGILSCLDEECVMPKATDATFTSKLDALWRNKSLKYKPFKFADQGFILTHYAADVPYSTEGWLEKNTDPLNENVAKLLAQSTNKHVATLFSDYQETETKTVRGRTKKGLFRTVAQRHKEQLNQLMNQFNSTQPHFIRCIVPNEEKKMHTFNRPLVLGQLRCNGVLEGIRITRAGFPNRLPFNDFRVRYEIMAHLPTGTYVESRRASVMILEELKIDEASYRIGVSKIFFKAGVLAELEERRVATLQRLMTMLQTRIRGFLQRKIFQKRLKDIQAIKLLQANLQVYNEFRTFPWAKLFFNLRPLLSSTQNDKQLKKRDAEIIELKYELKKQQNSKSEVERDLVETNNSLTAVENLLTTERAIALDKEEILRRTQERLANIEDSFSETKQQNENLQRESASLKQINNELESELLEKTSKVETLLSEQNELKEKLSLEEKDLLDTKGELESLRENNATVLSEKAEFNEQCKSLQETIVTKDAELDKLTKYISDYKTEIQEMRLTNQKMNEKSIQQEGSLSESLKRVKKLERENSTLISDVSILKQQKEELSVLKGVQELTINNLEEKVNYLEADVKQLPKLKKELESLNDKDQLYQLQATKNKELEAKVKECLNNIKSLTKELENKEEKCQNLSDASLKYIELQEIHENLLLKVSDLENYKKKYEGLQLDLEGLKDVDTNFQELSKKHRDLTFNHESLLRQSASYKEKLSLASSENKDLSNKVSSLTKQVNELSPKASKVPELERKITNLMHEYSQLGKTFEDEKRKALIASRDNEELRSLKSELESKRKLEVEYQKVLEEVKTTRSLRSEVTLLRNKVADHESIRSKLSEVEMKLVDTRKELNSALDSCKKREAEIHRLKEHRPSGKENNIPAVKTTEPVLKNIPQRKTIFDLQQRNANQALYENLKRDYDRLNLEKHNLEKQVNELKGAEVSPQPTGQSLQHVNLAHAIELKALKDQINSEKAKMFSVQVQYEKREQELQKRIASLEKVNKDSLIDVRALRDRIASLEDELRAA

SEQ ID NO: 22705 - protein, 1275 aa, Schizosaccharomyces pombe
MKLSNELFHRSSKDHGGKSRICLDSSEDTYPPHSSSPPSFQKRLSFSDFSTTRLFSPPFLSKRSNNSPHRFSYSPPQHPASINSRRVASYTVQSSPSRTTYRQLPNEPQNSAAYTTYSSFPNALFDDFSPNNPLDTDPFLTSPGNKQNTVDSFRPLPETPVSPGGSLVHPLPRPPLPSSVSSHSSPYSTTSSTSLYSLYNDISLSCSPEPYLPLSPTRSPARTPSPIRLYSSDALRPQSPLSPSVEYLTPPNPYSLKSDISSTRQLPKIPVQDYASGKISSPLITRTHRRAQSETLFSSCREPWLVGKLYKWCKEEVFTALGGLVHEGVSRREVAQVMATLFTIHIASMEFLIAEIIAKNILGDWINYGLVEVINLEKLQIAFTSNEPPSGSGVLPFLTNGGCYSYICRSRSCPSKYQCYSCRCARNSSLEFTSLPGQSSDTWSIFWNISSLNSLPSSLSKREIARQNNIHELICKESDYVADLNTLAELFRDGIVQQQDAIVPSNRVADFIQSVFGNVESIRQLHSRLFLPQLIMRERLQGPVVSIIGDILLEWIHAAKSSYINYAKQFPLADETYKLECQRNTYFARWLAACRSDPRCRRLDFQHFLQRPTQRLQRYTLELDTILKHTEQSSWDFQLITQAVKELRATCEECDAVIATVLEANRIRDLSYQLLFKNHESVNLELRDPEREFFFEGIVQRRSDSRLDWLDIHLFLLDNYLIMAKARKDKRTNASRYVVSKRPIPLDLLVLSPKMDDFQLKSNTNKFLGSLAGNLPQESLTTKSKRKSKVNLELMFDATAEKNNENSMNSAVFEKSQLYPFTIRHLGAYTASYTLYVESLQLRKLWVEKINVAKKRHSQKINIKNPFALKVVSDVAFQYPPSDLVNGNEPLNSFNEITLVEGSSIDRALNEVAWKHPIVSEELLPEPIAYGDISCIAQFNDYEGHVSVLIATSTGIFLGAFGDSSDIRDWKKISSQRRVTQLGVVEEFDILLELRDKTLYAHKLSRIIEMGLIESKIAVVIGTPHAVSFFKIGKLSEGASVKRERTLVFYKEGLGNTTTIICCEPVIGLGHNYQKTYAFKRKDVTSFRTLDDFHVTANCHSIDCFKYSIALCHNKGIDVLRLDPKLAVGFPSPSVLNDTLFRNRINNSKPLGVFRIHDPSLFACCYQFGAVFVNGEGSMVNKECWFDWIGKPNSVTSCHGYLIAFNDEFVEIWNTRTRKLNQIIQGNDIKYYPSNSDWLANGKYIMFGMVHPQYHDRHLILALNKAKTNSFIIED

SEQ ID NO: 22706 - protein, 1349 aa, Schizosaccharomyces pombe
MDYRHPNALGVNESSRAYEEIFGAPRKREPARTVSTPAFMEPAPVSKKPLPPPTRRLPRKPLPFRSTSLQPPSSQPPAPPTHQREASPVKNIEHSESFPSVFGTSNNHQIVPLTLKDGNDFGALYASLNTTPHFPQVSNHAPNNSNSPSLTWHTSSGDDSNQNPFFVRRQSQSSTSPVSDSVDENLLSAVSSVTESVETNLHLDQNYPYGSPVRSSKNPFLSSNSRLPTDDSSHTVGSHSFTSGTHPPIVSSNSAFTLPNAVTPAAQAPLIRSVSEYPANVSPPAQSLQLPKSTSNPADLHLSIASASSHKNIFSGLDVFSNVFHGPSTTLRDREHDMRNRSFDHSTLAHYEAVKQQRLGVEPTARSFTLSSYKSRASGNSLINDRSSTTTPTFVNSEASSPVHKNKRRRRIYAALLSRVASELLDRLQLGDITKDGLIYSNAFTGDHAVTVLMGIIHTSDRNLALLVGRSLDAQKFIHDVTYDHRLRDSHREIYQLQGTGYRPFLRANDNASINNKNHHKELEDNESGTRISPSTLGDTSFPNGIFTLLTHCYSPTCAKDHPCYSISCPRRLEQQHRLFAKMRANTEQSSSLAFDDKEQKLWIHSVPQEIAYSVSDRERKRQEVICEVIYTERDFVKDLEYLRDYWIKPLWASSCIPERKKEKFIRTVFLNALEVQAVNSKLAEALTKRQNYKPIVDNIADIFLEHVPKFEPFIRYGAGQLYGKYEFEKEKSSNPAFAKFVSDVERLKESRKLELNGYLTKPTTRLARYPLLLEAVLKYTDEGNPDKQDIPKVINIVRGFLSRLNVESGKAENKFNLFHLNQQLVFKPGEHYDLHLLDANRQLIFKGPLKKRSAGSTSSESASDVTLFLFDHALLIVKPKTINKRELLKVFQRVCFFYSFKLFFLTSIPIPLLLLQLFLVDDNGLRIPYSSKQQLAAVSKAANGKPPSRFYPFSLQLLGRRGYEITLYATTEVSRDKWLEHIDNQQTLLQHRNQWFESVTICSNFFVGDNKVNAIGVYDSGRRLLYGTDTGVYVSLRKANSPLQFKPVRALNIPNISQLEVIEEYSLLLLLSDKVLYSYPLEMIDADTTQAPKKARKVSGHTTFFRVGICLGKVLVCAVKSSVLSATIKVFEPVTNYSKTRNMPSLKKFLTVNQDPLRIVKELYIPTESTSVHFLKNKLCVGCTRGFEVVSLDNLETQSLLDPADTSLEFVEKKENVKPIAIYRMNGGEFLLCYSQFAFYVNRDGWRSRPTWFVVWEGSPQNFALSYPYILAFEPTFIEIRHVETSELIHVISGRNIRLLADGRGKLGDGGEIFYACDQRGENCETSVVCSLRLTSAAAHAKEQHVDK

SEQ ID NO: 22707 - protein, 504 aa, Schizosaccharomyces pombe
  unsure (1)..(504): unsure at all Xaa locations
MYSRIVLNDVEKKVVNLLKKTADFIESKSSSSSSLEVRLAGGWVRDKLLGLSSDDLDVTLNKVTGVDFANSIFEYVHSLDSDSVIPYKDALGKLTVNPDQSKHLETATLSLFDLDIDFVGLRAESYDDKSRIPSVTPGTVETDALRRDFTVNTLFFNIRTEKIEDITKRGYKDLQTKVLVTPISPLQSFLEDPLRILRGIRFASRFEFTIDPSVVSAIQDPKVCKAFEKKVSKERVGEEIEKMLKGANAKLALQLLYSTNTYQFTFDTLPAEKEFQIPKALEATESLFQSLALTFPKLMKLSEDEKIGLWLYVALIPWSSQTVMVKKKQFYIPAIIAKDKLKLRSTYVNQLNQCCTFNPIFDELVNDTSTKNCSSIGSLIRQLNKSWEVVFLTSVIYSCCKTPAASVSNTFSSYKSLYDFIYDKNLQNAYNMKPLLDVCNSFISVNNIERISXQFFRGKQIMKNVGVKPGPQLKETMDNMISWQFKHPEGSVEDCVAYLQSLKI

SEQ ID NO: 22708 - protein, 591 aa, Schizosaccharomyces pombe
MAEELKAKGNAAFSKKDYKTAIDYFTQAIGLDERNHILYSNRSACYASEKDYADALKDATKCTELKPDWAKGWSRKGAALHGLGDLDAARSAYEEGLKHDANNAQLLNGLKSVEAAQTQAASGAGGFNPFAKLGSQLSDPKFMEKLASNPETASLLADSAFMAKLQKIQQNPGSIMAELNDPRMMKVIGMLMGIDINMNAGEGAAEEQEKKEEFAPSSSTPSADSAKPETTNPPPQPQASEPMEEDKTAEELEEAATKEALKKKADQEKQIGNENYKKRNFPVAIEQYKKAWDTYKDITYLNNLAAAYFEADQLDDCIKTCEDAIEQGRELRADFKLIAKALGRLGTTYQKRGDLVKAIDYYQRSLTEHRTPDILSRLKDAEKSKELQDREAYIDPDKAEESRVKGNELFKSGDFANAIKEYTEMTKRAPSDPRGFGNRAAAYLKVMAPAECIRDCNKAIELDPNFAKAYVRKAQALFMLKDYNKCIDACNEASEVDRREPNTGKNLREIESQLSKCMSAMASQRQNETEEETMARIQKDPEVLGILQDPAMQAILGQARENPAALMEHMKNPTVKSKIEKLIASGVIRLG

SEQ ID NO: 22709 - protein, 506 aa, Schizosaccharomyces pombe
MDLAPRPLGRQHSKSQSAFAFDNTATSIAASTMKNELNHLASTVKDPLAKKAFQKEMDNFFSLFSRYLQEDARGSEINWDLVESPKPEQVVEYDTITEAGGLSRDYLNKLAVLKLNGGLGTTMGCVGPKSIIEVRDGNSFLDLSVRQIEHLNRKYNVNVPFVLMNSFNTDEATAKVIKKYEAHKIDILTFNQSRYPRVHKETLLPVPHTADSAIDEWYPPGHGDVFEALTNSGIIDTLIAQGKEYLFVSNIDNLGAVVDLNILNHMVETNAEYLMELTNKTKADVKGGTLIDYDGNVRLLEIAQVPPQHVEEFKSIKKFKYFNTNNLWFHLPSVKRVVNNHELSMEIIPNKKTIKHKGENINIIQLETAAGAAIRHFKNAHGVNVPRRRFLPVKTCSDLLLVKSDLYSINHGQVEMNPRRFGGTAPLVKLGAHFKKVADFSAHIPSIPKILELDHLTITGDVNIGRNVTLKGTVIIVASDANRIDIPNGSVLENCVITGNLNILEH

SEQ ID NO: 22710 - protein, 612 aa, Schizosaccharomyces pombe
MKLRLDPSTQSNYHDVSISKLDWHARIDFDQELLHGKVSFVIQSARVSQALSHIILDTSYLEIKNVTINDIPTPFRVDKRRGFLGSALHIVPADEIPSSKSCILTILYSTTKDCTALQFLKPEQTIGGKFPYVFSECQAIHARSFIPCQDTPSVKVPCTFKIRSKLPVIASGIPCGTANFCNGSLEYLFEQKNPIPSYLFCILSGDLASTNIGPRSSVYTEPGNLLACKYEFEHDMENFMEAAEQLTLPYCWTRYDFVILPPSFPYGGMENPNATFATPTLIAGDRSNVNVIAHELAHSWSGNLVTNESWQCFWLNEGMTVFLERKILGRLYGEPTRQFEAIIGWGELEESVKLLGEDSEYTKLIQNLEGRDPDDAFSTVPYEKGSNFLYEIERVIGGPSVFEPFLPFYFRKFAKSTVNEVKFKHALYEYFSPLGLASKLDSIDWDTWYHAPGMPPVKPHFDTTLADPCYKLAESWTNSAKNSDDPSKFSSKDIENWSAGQKSLFLDVVYEAVSFPHNYIKRMGDVYSFAESKNAELSFRFFKLALKSKYKPLYNTIAERVGSVGRMKFVRPIFRLLNEADRAFAIETFEKYKHFYHKICASQVEKDLGLSE

SEQ ID NO: 22711 - protein, 1076 aa, Schizosaccharomyces pombe
  unsure (1)..(1076): unsure at all Xaa locations
MQVDPVVYQLQRAVSQDPIAVKDAEGHLNNWKKEPGFFGKLYSIFLDKQNDMSLRWIAIIQLRNSIDIIWRKNTKMXVRSSLEESTCTVRLSXLLMYDCLAGSLLPEERDFIRCNALLGSIKSENLLSIQNALVVSRIARLDYPTEWPSLFHDLLGKLQQSLGTGDYDVALRLLITLHHIIKAMAGNRLLRSRQIFYKLAPELLTILQPILHSSLSSWMMILESSKEIKDSTLLSYMQISRYTLKACRRLVVFGFQNPSESEFSERMLAFCAVHQRKLLSMLGTMLQSSRSPIVVGECLEMAFAHAFLFNKPFFDFSFYSPCLTKFPATIDYISLHYDFLGQISSHLSSYKEKFEESSKNFEKLVIMSLRVFILVIQEFCNTKSSHPETAQVLYNSFLVDNRINNLLDLLITKLLILKEEDFEEWTDSPQQWVLEQSTQDVEFNVRVSXLXIWVFXXAYHXRXYSLCAEKLLKCFFDAYGDIIVSPFKDMIYSVFECPKTLTQAVQQDTLISSFGVGYTQLKSIFPFAKWLQEAAVPNMASINDIGISRVYRRRIAIFLSQWIEDSSSEQLLEVIYKLYCSFLNLTDPCNDAVVILTTIDAFKTVLDDWNFSENSFLSIKENLFVHVLSLFKAFESVDARTSILSLLGTLLARAGEHVAPMESTIASLLSQLWDGWKKEPLLRARVLAVMHQFVNVSVWLYTTDCFLILISRRSKAKSFEFSTFLYTVIEYCVNPESPEHVIFEADAMELWSTFLMYIQKLPETFTLLIPHLLYHLSQATSTLPFVLMIVSSYQLLDNTVLMKDYSFTIFEKLNDLLDDVKNETLQALCKTVCLLIETTPMDMIYESLLNSSLLSRLLLSIATNDKHPQVLIEYLLVVSRISLREPELILKVCQTKNINIAMLIGNWILLNDHINHSKDRKLNTLALSSLLRTNHPDVLAVLDSIMNLWFSVLSEVEEDANGDATIYYKNDDYSAVGFYLDETSEEMTRRKQVSEXEARNMFIVXMKKFYLFAFVLLILTFILAAFKDPVHSVNSRSFFISVFMFCRDANGGMENFQNQYLSTVNPALLEQFQSML

SEQ ID NO: 22712 - protein, 576 aa, Schizosaccharomyces pombe
SIQQNIEDEGKVNVREVNPDSYAERDHGYTAGIFSDAEENFGITQQVADSTQNPTSKPKSRHAHFHETVHENPSEYSRSKCKQPTNEKEYDKAIEALVAKAIVEEHSGQQFPVYKGLEQYTLLQKMGDGAFSNVYKAIHNRTGEKVAIKVVQRAQPNTDPRDPRKRQGVESHNILKEVQIMRRVKHPNIIQLLEFIQTPEYYYLVLELADGGELFHQIVRLTYFSEDLSRHVITQVAHAIRYLHEDCGVVHRDIKPENLLFDSIDFVPSRVRKYRAGDDPDKVDEGEFIPGVGAGTIGRIRLADFGLSKVVWDSHTQTPCGTMGYTAPEIVRDERYSKGVDMWALGCVLYTILCGFPPFYDESISLLTKKVSRGEYSFLSPWWDDISKSAKDLISHLLTVDPESRYDIHQFLAHPWISGSREPTFPATDAPNTAQRENPFTYDFLEPEDVAAAGSAARTPGVNSLREVFNISYAAHRMEQEKIRKRGQRGNQGIMNFMGDMDDLMEENDDYDDGTKSVEHSMKRVNLSGENDPSLASRQPAQSQQQSSQRSRNKFKGFQLNLSKATLYNRRHRQKV

SEQ ID NO: 22713 - protein, 1044 aa, Schizosaccharomyces pombe
MSDWRLTENVLDQNIPETKPRESKTRLEEIQRLALFQEELDIIEELDDPVDVWYRCIEWLLETRFLGMETVNKMLDDAIQYLERCRFALNDVRHLLIQLAKIKQSYETPDELQQAAKQFYQLASKGIGLELALFYEEYGSLLIRMQRWKEASEVFHAAVSREARPLVRLLRNAAEFSRAYDLHNAHPSIHDAPYSSPFPPPRIVLGSKPVSSSTLPSKPKSFQVFSDASSSRDSQNASDLPQAKSLESEANTPNLPLLYDKSSGKRVEYSAFNFLALYENGEERSMEECRAQRYLSSIQPNTAASFPKVVPKNEISVHHDSSSSNVSPIYKNPVAEQSDTPTRSLPKNYAYVAKSTSPELKVFDTVMPVALSPKPAQKPPSPTIHTKAALADILDIFNQPLRSESLEKSSKSPISAQSSYLGTPLKNDENSSNSGATSLTGRSQEEHLDFIPSLTPSKNYPSKIYSPNKNLDFSHTASKAETYKNSNELENVKREQPFSELLPSTLQEETATGTTSTTFANAKRRPEDSNISPTNPKKLHTLPRSPQYSTVDSNSVLSPAMPKGYMFVNENQSMKHESSVSNPVATIPHENGKHDFGQLSPIEHKPFFPKNDDELPGPSGYLTMPYEEAMASLSNLPTLINPLDQSLRDLLFQVLRPSLLRDKDYHEHETSFALVEHIESFVSKIKPKAGGPGRRRSSNRHSLDGPEFHLFYPPNTNLSVISKLGQGAFAPVYLVKSKIETENGDVSQGGAENNESKLFALKIETPPSCFEFYLTRQAMTRLKGLRETNSILPVHQLHMFHDTSHLLMDYRPQGSILDLVNSMHNSTFSSSGMDEILVVFFSIEFLRIIEALHTHKIIHGDLKADNALLRLETVADSEWSPIYSPEGLYGWSFKGIYLIDFGRGIDLSLFEEKVKFIADWDTDLQDCIEMREGRPWTYQIDYHGLAAIIYTMLFGQYIETRIEVINGQRRQVLTQRMKRYWNQDLWHRLFDLLLNPTLHVSEENLPMTEELSKIRIEMEEWLVNHSTGGSGLKGLLKSIEKRKI

SEQ ID NO: 22714 - protein, 264 aa, Schizosaccharomyces pombe
  unsure (1)..(264): unsure at all Xaa locations
PRNFKLLEELEKGEKGLGESSCSYGLTNADDITLSDWNATILGPAHVCFYWGIFQVLNXCKKNDRGLALKFMKTFESIHFEAYPVLILLTFNLYXFVINLSVHENRIYSLKIHCDANYPDAPPIVTFVSRINLPGVDGETGKVCVYXRKFVKYLMFSVNSFHSKYQYIVXKXEFGVGLTKRSXFYAKXKNQAFFSSYXRXLGKPHKIDCLRHWKREYSMETVLLDLKKYVYXTSYEXSSXLMFXRNASSSNRKLPQPPEGSTFF

SEQ ID NO: 22715 - protein, 746 aa, Schizosaccharomyces pombe
  unsure (1)..(746): unsure at all Xaa locations
MAKVQLSPKEITLFRTALVCXSSTINKLKISLTLXKCYETKQYKKGLKAIEPLLERHPEHGESLAIKGILLHSLGNTKEGYDNVRLGLRNDVGSGVCWHIFGLISRADKDYVQAAKCYINAHKLEKNNSSLLRDLALLQSQLRQYKALADTRNALLQDNPGVRANWSALAVAQFLRGEYASAYKIVDAFESTINQGVPVDTQEESEAMLFMNLVILKKDGVEDAYKHLLSIEKKVLDRVAFLETRAEYELYLSKMEEAKSTIYLLLDRNPDNHQYYYNLQRAYGYEDASGKVLDSAEWLNLYSQLAKRYPKSECPTRLPLEKLEGDEFLTHVDLYLRKKLKRGIPSVFVDVKSLYKDTKKCKVVEDLVSKYASSLSTTNKFSEDDDNSQIEIPTTLLWTYYFLAQHFDHVGELEKAEKYVDLAIDHTPTLVELFMTKARISKHKGELQTAMEIMDHARKLDLQDRFINGKCAKYMLRNDENELAAKTVSLFTRNEAVGGAVGDLADMQCLWYMLEDGKSFARQKKFALALKRFSTVFKIFDTWADDQFDFHFFAFRKGSLRTYLDLMSWEDSVYDDPSFREAAQGSIEIYFALFDLPFAKYSPKLPDFEKLSSGEINEEEEKKIYKKLKKDLSKRLERAEKLKEADKSRAKSEDGMPVKYDEDPLGENLVATSEPLKEAQKCLEKLLPYGDKNPSAYILAAQLYTRLKNFDTASKYLEQAKVILGQNDPTVISTEKFYNSIKTQSN

SEQ ID NO: 22716 - protein, 351 aa, Schizosaccharomyces pombe
TFSLPLLQSFIMSSYILFGLENPLLDYYVGGETATLEKYGLKSNDAVLASESQMGIYKEPCVSYSAGGAAQNSCRAAQYVLPPNSTVFAGCVGQDKFADMLLESNEKAGLRSEFSVDPTTPTGVCAVVLSNNNKNRSLCTNLGAANNYKLKDLQQPNVWKFVEEAKVIYVGGFHLTVSPESMLCLAQHANENNKPYIMNLSAPFLSQFFKEQMDSVIPYCDYVIGNEAEILSYGENHGIKSTDVQEIALALSSVEKVNKKRTRVVVITQGADATIVAKDGKVTTYKPNRVPSEEIVDTNGAGDAFAGGFIAALSQGQGIDYAVTLGHWLGQECIKVSGTTLPLPKKQFPLP

SEQ ID NO: 22717 - protein, 479 aa, Schizosaccharomyces pombe
MTAPSATAFSSATTQPTTEGNASMRKRTIPVVPSVPERKWDPKAPKHIQEQPWTMQNWWRHLNWLHCMLIFGLPMIAIYGVFTTPLQTKTLIFAIIYYAYSGLGITAGYHRLWSHRAYKAKKPLEYFLAAGGAAAFEGSIRWWSRDHRAHHRYTDTDKDPYNVKKGFWYAHVGWMIILQNPRRIGRSDVSDLNSDPFVMFNHRHFLPIASFMAFIFPSLFCGLLWGDYRGGYFYAGVCRLVFVHHATFCVNSLAHLIGSQPFDDTNSARNHFITALVTLGEGNHNYHHAFPNDYRNGLRWYEYDPTKIFIYIASLFGLAYNLNTFPDNEIQKGIVQQKQKVLDRWRAKLNWGIPLEQLPVMEFEDFLEQSKTRPLVLINGVVHDMTGFEHPGGQGLLRSAFGKDATAAFNGGVYDHTNGAHNLLSTYRVAVVRGGMEVEVWKSGAGAQLPMKDTQGQKIVRVGEQITRIQPPIEAAAAN

SEQ ID NO: 22718 - protein, 451 aa, Schizosaccharomyces pombe
MSTPYEPEFQQAYKEIVGSIESSKLFEVHPELKRVLPIISIPERVLEFRVTWEDDKGNCRVNTGYRVQFNSALGPYKGGLRFHPSVNLSILKFLGFEQIFKNALTGLPMGGGKGGSDFDPKGKSDNEIRRFSQAFMRQLFRYIGPQTDVPAGDIGVTGFVVMHMFGEYKRLRNEYSGVVTGKHMLTGGSNIRPEATGYGVVYYVKHMIEHRTKGAETLKGKRVAISGSGNVAQYAALKCIQEGAIVKSISDSKGVLIAKTAEGLVPEEIHEIMALKEKRASIADSASLCKKHHYIAGARPWTNVGEIDIALPCATQNEVSGEEAAALIKQGCRYVAEGSNMGSSAEAVEVFEKSRASGEGCWLAPGKAANAGGVAVSGLEMAQNAQFSTWTHAEVDAKLAGIMQNIFEQSTDVASKYCDSGSNNIPSLVDGANIAGFLKVATAMQAVGDWW

SEQ ID NO: 22719 - protein, 474 aa, Schizosaccharomyces pombe
  unsure (1)..(474): unsure at all Xaa locations
MSYKLDQLTRLPENKKCFDCDAPNPQWASCNLGIFICLDCSGQHRGLGVEKSFVRSITMDNWSERQVKMMEVSIRIDTGYWSLLVILPKKKHIYIIIHLAERVALLICEFACRYFEFFPSHLVPFFDKNNVXCXKQVHDAQLIITXSYKMQAHYNFINDLKQHIXPTFVACSXLTSIQVGGNSNAKTFLSTDPMFSAAGSIREKVXSLNLLYFFQFTLFXFYSHXLTHFKYNTDIAEDLRQKIRAEVDGVEWVKVDRPKSVSSHASVTSSSTVPTIPSVSKEANDKYFAKLGSINSQRPDDLPPSQGGRYQGFGSSNSVNPNSSARNNGGSFLDQLSSNPVSALSHGWNMFSRSVSQQIQDVNKSYIQPGITKVQTFYCIQKIKFLLYXLCFXVQDPETRKDYMNAINNFSSNVQEGAKQSFTQLKSFLDENVYSENPQNTRGTYDAEIDSPYSALAASPPPEDYSKKNFDKHD

SEQ ID NO: 22720 - protein, 290 aa, Schizosaccharomyces pombe
DLYGGSDRLLSFNQRQYGFKVDNVDTSDLAAFEAALRPDTNLVLIESPTNPRISICDIRAIVKITRSKAKDALLVMDNTMLSPVLCNPLDFGYDIVYESATKYLSGHHDLMGGVIATKSDEIAKSVFFNINAMGAAMAPFECFLLLRGIKTMGLRVERAQQNAIEIAKFLKSKGLQVNFPGLDPDAKSTAIFYSFARGPGAVMSVFTGDVEVSKTIVNTTKLFEISVSFGAVNSLISMPAYMSHASIKKEVRDARGLSEDLIRICVGIENVDDLKADLENALAQANFKQN

SEQ ID NO: 22721 - protein, 351 aa, Schizosaccharomyces pombe
MKEMINLDSSSEPSIVTKQFSVEECLSKLKEQHCYVPMRTIGRLRLRKSSDQTEKKCWKEKLMKIRSELEELWEQSMMYEEQKELTQLGEMLDRLWDKHINSEGSKSETISDTAISGNDDTMEKRLEQFSDDTLQDTLETEKNLNSKTSESLKSPTLSYPFDLDSLDKRIFKLESKIGYADEPLSELLNKCMEKLEIVEQDPQFWQSRIESWKQLLAKDFLKHHERNLCSIEKQTTLKNSSLKELCTEEDIVIMLEICSSQLPFVEQYMPILPLLLERLKSLQNMHTDAAEAISSWQGSKDVMMTMQSELNEWKNTVERLDHSKFYTQSVEEMRRLSDTVTQLEKRVLKLQ

SEQ ID NO: 22722 - protein, 572 aa, Schizosaccharomyces pombe
MVRKYGIFIDAGSSGSRLLIYSWDYDTDSSLSDKVKKLPLIETGIGDGGKWSLKVQPGISSFANNPKHVGKKHLKELLDFAAHAIPKDVHKETPVFLSATAGMRLLGVDAQNKILSHACRYIKKNYDFDIPNCSNSIRVIDGKAEGMYGWLATNYLLKTLEEKDTSTVGFLDMGGASVQIAFELPPSQLKNYKDSISTVHIGLQNGQQLEYPLFVTTWLGFGANEAYRRYLGLLIESENGKVGNTLSDPCSLRGRTYDIDGIEFAGTGDLKQCLKLTYNLLNKDKPCSMDPCNFDGISIPPVDFANTEFVGVSEFWYTTNDVFDMGGSYHFPNFYKKVDEYCGTEWETMLSRLYNKELTPSTDENKLEKLCFKASWALNVLHEGFDVPKSNTSSNDAKDGLSVIPAYHSPFTSLEKIERTEVSWTLGQVLLYASNQQLLAKPEYANYYMDPYGKLIASPSKHWMRLFPNKLFFILSFIFCLFFLFSLVLFGYDPKRRQRFKKFLLRLQRRKAPYIMSANGSYEDIADFSDDLEMSSPSKWHGPPIRTTSSHVLADRLSFTASRERTPRSPFP

SEQ ID NO: 22723 - protein, 493 aa, Schizosaccharomyces pombe
  unsure (1)..(493): unsure at all Xaa locations
MNLICSILPKKEPSYLKLWRKQVIYQVLTDRFALDEDNFYAKASGNLYLGGTWKGITRNLDYIKSLGCTAIWISPIVKNISETTDCGQAYHGYWAQDMTQLNENFGTEEDLKELVNAIHEKNMLCMVDIVVNHMGHAGSKPVNFLLYQPFNSGKYYHNWQFVQNYDDPHETITGWLGDSHVNLPDIRTEKNEVRKFFQNWVSDLIKRYQFDGIRLDTAKHVEKSFFPTFIEAANVFTTGEVFHGDPKVVGDYQKYLPSTLNFPLFFQLRETFLDPKHSMFSFYDKAVLDVRHYFKDVTVLCNFLENHDFPRFFHETKDIAVSLLNNISIXYLHFLYILTFIXLALNALTALIFMDGIPIIYYGQEQMFDGGSDPDNREGLWKSKYNTSNPMFRHLSSMIRTRQNLVETYPEFTYVLSFQLYIDDSVYVFTRPGVIIAISNEGSTSSFKVEIDLKEHWKEVPSSFTDILTQKTIPCKDHKLKIKSKSGLPKVSI

SEQ ID NO: 22724 - protein, 1133 aa, Schizosaccharomyces pombe
  unsure (1)..(1133): unsure at all Xaa locations
VTGETLVDSQKSLINNDTLLNEKLKEDFEENVSIGTCRCDHLVXKLLMTGLFTFMLLTGHDVKIHEELRRALPDYEESGFQRFTWHIKSWHELDRRAVSPQFAVGSRQFKITYFPQGTLQSAGFTSIFLEYIPSEEEKLSNKYGCCCQFAFVISNPRKPSLSVANSAHCRFSPEIVDWGFTQFAELKKLLCRQAPDVPPIVEDGALLLTAYVRILKDPTGVLWHSFNDYDSKIATGYVGLKNQGATCYMNSLLQSLYIIHAFRRIVYQIPTDSPQGKDSIAYALQRCFYNLQFMNEPVSTTELTKSFGWDSLDSFMQHDVQEFNRVLQDNLERSMRDTKVENALTNLFVGKMKSYIACVNVNFESARSEDYWDIQLNVKGMKNLEDSFRSYIQVETLEGDNCYFADTYGFQEAKKGVIFESFPPILHLQLKRFEYDFERDMMIKINDRYEFPLEFDAKAFLSPEADQSQNCEYVLYGVLVHSGDLHNGHYYALLKTEKDGPWYKYDDTRVTRATLREVLEENYGGDYIMHPPFRSPVKLKRFMSAYMLLYLRKDKLDELMNPVSADEIPEHLKEALNPSIQLAELRRKERLESHLYTKVQLITPEFYSEHHEFDIADFGNAYKEETIPQFRIKKEAKFSEFIPIVAEKLGYPQECMRFWYVVKRHNCTVRVESPVNELNSTMEEVKNVWNSQGEILRLYLEITPENELSSSLTHQNTGEWNAFIFVKYFDRKSQEISGCGTLHVNKSDEIRSICPLLCERANLPKNTPLNIYEEIKPGMVDFLRLEKTFTQSELSTGDIICFEPCRPSALEDDIVNSGFDSALKLYDFLSNKVLVLFRPRFIDQDSIIEFEMLLDRRIKYDDLCIELGQKLGIGADHIRLTTCNPLTYSAGMVVPNDSNITLYEILYSSEEEMPSNVIFYETMDVSLSDLDRKRLVRLRWLVDGLANIELVEAYINKSGDINDLFGAVCERFPDSDLRKKKVRVYEVFESRYHRDLSLRTLIRTINPAATLVGEVVPLDQLQLYPEEKIVQVHHFHKDIARIHGIPFSFVIKPQEKFIDTKLRLAARTQYPESIFSVIKFCVVDFDNNRVVYLNDEDITYDVVEKLNGTLALDRAKKDSKKPNILDRAIQMKN

SEQ ID NO: 22725 - protein, 609 aa, Schizosaccharomyces pombe
MLFLRFFIFTFFTSIFTVVVSEPPVSAKFAKRVLSATSSSSSTCPEFITIFSEGPSEYITTIYPSSKSSGRGTTNHSTIYTTINSGTVASTYTVTLADGDVVVKDIEPTAGTVTTTITSGSHEFTTTLAEASGTVPGTVEVVEPLAGTVTTTIHSGSVEYNTTLATASGTVPGTVEVVEPAVGTVTTTIYSGSEEFTTTLASASGSISGTVEVIEPTAGTVTTTIYSGDQEYTTILAEASGTVPGTVEVIEPAVGTVTTTTYSGSVEYTTTLVPASGSVSGTVEVVEPAVGTVTTTLQSGSQAFTTTVPASGSVSGTVEVVQPTGGTVTNTVYEGSQTITSTLATASGTVPGTVEVILPGPSTIYSGTVATTITYDVSSTPASTVVVIPTAVCNGERGLQYAVYNYDISSSKNQFCATSGVTDVSSFTQPAYFGSSDLDQSSPLFTGVLSSSDSVPQWTSSYNLPGYPPDATAMGSTSSACKVIVYQFFFRVPVTDTFSLDVTNVDDVFYGWFGDKAISGWSNTNYDTYAYWHATNGQTGIASFSMGSLTADTYVPVRFVVANGAGKGGFDFSFVDSEGNSYNPTSYAYTATCTESFLPFGQGNGGVDN

SEQ ID NO: 22726 - protein, 520 aa, Schizosaccharomyces pombe
MFSFRFSTLVFLFLSIFTVVLSEPRVSIGLAKRTISQTSSSSLYTCPDYITIFSEGTSEYTTTIYPSSKSSSSVANHSTIRTTIDSGTIATTYTFTLPDGEIVIRDIEPVAKTLTTTITSGSLELTTTLATASGTVSGTIEVVEPLAGTVTTTVYSGSVEHNTTLATASGTVPGTVEVVEPTAGTVTTTVYSGDQEYTTILATASGAVPGTVEVVDPAAGTVTTTIYSGSVEYNTTLATASETLPGTIEVVEPLAGTVTTTVYSGSAQYETTLATASGTVSGTVEVVEPAAGTLTTTVYSGSEAFTTTVASGTVEVVETAAGTVYQTSCMDLPLTFSLTVATASGTVPGTVLVYAPFAGYYTTTIYSGSQQYTTTVATAAGCVSGTVEVVEPTAGTVTSTVYSGSAQYETTLAEASGTVPGTVEVVEPTAGTVTTTIYSGGQEYTTILATASGAVPGTVEVVDPAAGTVTTTVYSGSQLFTTALATATGSIPGTVEIVDPAAGTVSITTYSGSMEYTSTL

SEQ ID NO: 22727 - protein, 401 aa, Schizosaccharomyces pombe
  unsure (1)..(401): unsure at all Xaa locations
MSLTENLQLLLNLDSLPSKRYVIVTIXSXIHKSFINKYTTRENLIKRKECGLTIMLCGASGTGKTTFFNTLFATSLQPEKSYETAKETIAKKTLEVKKNKAVIEEDGFHINLTVLDTPGFGDFIDNTSCWNTVAEYLDEQHERYLIHDQNSLRVPRKDTRVHVCLYFITPVSFGMLPLDVLAMKELSTHVNLVPVIAKADTFTTPELTQIKQKIRRILEAQSIDVFHPSTEYSDYETAELLDSSLPYAIISSVNEVCKDDGEKSQGRRYPWGTSEIYEETHCDFLKLKKLLINRHMLELINTTETNIYERYRREQLTNRKSGIPKLKKEHYERLNNEKRAIQQKITQMTNETESFFQAKEEKMIETRDALNSELSEYHERIRALETQIESLKSYKGRGHKK

SEQ ID NO: 22728 - protein, 401 aa, Schizosaccharomyces pombe; identical to SEQ ID NO: 22727
  unsure (1)..(401): unsure at all Xaa locations

SEQ ID NO: 22729 - protein, 1006 aa, Schizosaccharomyces pombe
MVATDSSDQVAKFDVSHKIIEDIVYSLSNRIFSYAEHVPLNRYLTQWNNSGRRNGFSNNVELFNLEARSGASAFLLGSYTAAISSPGVYSMMTPSSCLSLLNPLLSNIIPFYGASKPLVVHVAALAYLEQTYCADNVSVLDFSYANNFTVFASQSNVEAAHLALASTLAAKAAPVIHVYEPDAIVTTTDPSLPLLDSNAVVECFNSYQSEADPVSNASKALKHVNDYFNTSYAPAEYYGSQTASKVIVTFGKSETVAARALLAANPDVGVLSIRIFPFVAENIFNVLPTTCKSLVVLSQVRSTAVGTSSIYYSFLLATLLSTKPSALAISEHRYSLVESVTLSSLFDALHETLQLKAATPKAVHVDKSINVWESDVGDSLVLSLVSAYRTDKSRSVAFRPLFDNLTLAGVRFTVAQVSTANAVLTDVVKDVDADITILTTDRLPLHYRVLAKAAEHSICLLQSSIAPDEATKKLPYEFIADALEKGVKLVLIDPKKFAIDASNLPLLVSFIQLVKPGLGVDEALAVLAKQNNLTDTNLKDAVDSLKQSLSFINLDASALKDREPSEKELPSTAKETSFAPNAVKTLDEDITPQSSNWQTVAKQIIFPEAYKKKDALRPDVSEKVFTVHVRANKRLTPAEYNRNIFHIEFDLGDSGLTYDIGEALGVYGVNNKTHVHDFIEEYGLDANELIHVPSIQHPGHWETRTVFQALCQNIDIFGKPTKKFHEQLLEFETDEKERADLQILISPAGAPDFKRRAEVDMLTYADVLKEFKHAKLTAAQIAQIVPVIKRREYSISSSQKKHNDSVHLLVVVVGWKDGMGRDRYGQCSHYLSNLKVGEPLCVAVKTSVMKLPTSPLKPIVMAGLGTGLAPFRAFLQFKEWQRMQGIESGDILLYLGSRTQREEYLYGEDWEAYHSANLLTHIGQAFSRDQPYKIYIQDVMRSTKDMLKKALMDEGGSFYLCGPTWPLPEITSVLEEVIQSSYDEPVDARKIIEQWKEERRFVIEVY

SEQ ID NO: 22730 - protein, 690 aa, Schizosaccharomyces pombe
  unsure (1)..(690): unsure at all Xaa locations
MASNQPNNGEQDEQLAKQTSKLSMSAKAPTFTPKAAPFIPSFQRTFFNXNTIHMSXDDCLFXVKKLLTSCXAPGFVPVNNIAGGYPYAQYTGQGQNSNSPHPTKSYQQYYQKPTGNTVDEDKSRVPDFSKKKSFVPPKPAIPKGKVLSLGGNTSAPKSTKPISISLGGTKAPTTTKPAAPAAQSKTETPAPKVTSESTKKETAAPPPQETPTKSADAELAKTPSAPAAALKKAAEAAEPATVTEDATDLQNEVDQELLKDMYGKEHVNIVFIGHVDAGKSTLGGNILFLTGMVDKRTMEKIEREAKEAGKESWYLSWALDSTSEEREKGKTVEVGRAYFETEHRRFSLLDAPGHKGYVTNMINGASQADIGVLVISARRGEFEAGFERGGQTREHAVLARTQGINHLVVVINKMDEPSVQWSEERYKECVDKLSMFLRRVAGYNSKTDVKYMPVSAYTGQNVKDRVDSSVCPWYQGPSLLEYLDSMTHLERKVNAPFIMPIASKYKDLGTILEGKIEAGSIKKNSNVLVMPINQTLEVTAIYDEADEEISSSICGDQVRLRVRGDDSDVQTGYVLTSTKNPVHATTRFIAQIAILELPSILTTGYSCVMHIHTAVEEVSFAKLLHKLDKTNRKSKKPPMFATKGMKIIAELETQTPVCMERFEDYQYMGRFTLRDQGTTVAVGKVVKILD

SEQ ID NO: 22731 - protein, 237 aa, Schizosaccharomyces pombe
QQGAGNKLRPVTIKQILNASQVHADAEFKIDGVEVGQVTFVGVLRNIHAQTTNTTYQIEDGTGMIEVRHWEHIDALSELATDTYVRVYGNIKIFSGKIYIASQYIRTIKDHNEVHFHFLEAIAVHLHFTQKANAVNGANAPGYGTSNALGYNNISSNGAANSLEQKLAEYSLTPAQMTVMQAIHSAPETNEGVHVRQLAQSVGPGIDLTAVTDFLQQEGIIYTTIDENHFKSVLQDQ

SEQ ID NO: 22732 - protein, 338 aa, Schizosaccharomyces pombe
MGNSNSKSVKNDKENFEDPNATNFESVSQFKIRNVIGKGSWSTVFVVKHRQTKQRFALKCINKKKHDEHKIKKLRNEVLLLQSLNHPLLCKFYSEFEDETKIYLVTDLMLGGDLRYHISQRKFNESVIRIWMVELVSALIYIHSKGVLHRDVKPDNILLDEKGHCKLADFNVAAKVHTSSSPSKSNMTVGRVGTPVYMAPETLIHAVSYKESDWWSLGITFYECLFQVRPFPNHLLINWIRASEEEKASSADRLSSALHISRDKKLTTISKDARSAVMAFLEMDIKKRLGHSSKKLQTHPFFCSISLETVSKGNLTPIFRPKSGKVYVDPILDLEATF

SEQ ID NO: 22733 - protein, 1053 aa, Schizosaccharomyces pombe
MIYKLAARYPIQVIAIVGILVSMAYFSFLEALTQEDFPVLIRALKRFGILDGFPNTRLPNEMILKLSSVQGEDASVWEQIPAAELGGEGFVDFDITQWYYPANAKVDVAQLVEPYRNDCIFHDASGACHFFFKEVGNWTVSSIALPSNLANPPIDYFLDSSSTVIQRILPAIREHGISWSWLLQLIARTWMNTLKIASQASKTELLIVGTAYACMLISIVSLYLKMRRLGSKFWLFFSVLLSTLFSVQFAMTLVRASGVRISLVSLIESLPFLINVVALDKAAELTRQVITRCSVSDSHSPMHEDIAKACRNAAPPILRHFSFGIVVLAIFSYCNFGIKQFFLFAAVMIYDLLLLFSFFVAILTLKLEMRRYNAKDDVRKVLIEEGLSESTARHVADGNDSSATTSAGSRYFKVRYGTKIILFIFIAFNLFELCSIPFKHYAATSAAAARLIPLVRSQYPDFKSQRLLDDGVFDDVLSAISSMSNIESPSVRLLPAVFYGAELSSTSFLSTIHSFINNWSHYISASFLSKWIVCALSLSIAVNVFLLNAARLNSIKEEPEKKVVEKVVEVVKYIPSSNSSSIDDIQKDEIAQESVVRSLEECITLYNNGQISTLNDEEVVQLTLAKKIPLYALERVLKDVTRAVVIRRTVVSRSSRTKTLESSNCPVYHYDYSRVLNACCENVIGYMPLPLGVAGPLIIDGKPFYIPMATTEGALVASTMRGCKAINAGGGAVTVLTRDQMSRGPCVAFPNLTRAGRAKIWLDSPEGQEVMKKAFNSTSRFARLQHIKTALAGTRLFIRFCTSTGDAMGMNMISKGVEHALVVMSNDAGFDDMQVISVSGNYCTDKKPAAINWIDGRGKSVIAEAIIPGDAVKSVLKTTVEDLVKLNVDKNLIGSAMAGSVGGFNAHAANIVTAVYLATGQDPAQNVESSNCITLMDNVDGNLQLSVSMPSIEVGTIGGGTVLEPQGAMLDLLGVRGAHMTSPGDNSRQLARVVAAAVMAGELSLCSALASGHLVKSHIGLNRSALNTPAMDSSAKKPATDALKSVNSRVPGR

SEQ ID NO: 22734 - protein, 1837 aa, Schizosaccharomyces pombe
MHDSSWTEADILGVCSFLDIPKTKIDPLLQVDAFTSILIPLISKSKDYESIKNDRIVTEVNYEQQLRNSEKKLLQSNERYDLLEDERKLLENELSQIKEYLREKSSSYDTVLHDCSSLKSVNEALKQAQDQNLKQTAQLQNLLSDKEKEVEKKITIIKDLKDALASSTHQVLELQHTQQEKASLQTNYEFELQKLTQKNSILENNNTWLSRELQGVNDKLLSLHQEASLEKSQLSSQLSDAVLEKDALQRKVSSLSQQFTESNLRYQNIVAELSEMRKQYEFSQVSFEKEISSQKQISELWMEKCEDCSLRLKELQNSNGELEKLLEAAQSSFEEQLESHKEAEASLKSQINFLEKEVSSLESQLKLANERLRHYDEIEISDMSELKYSNLLNNSMKGFKGQSSVSDLYSERLYYKQKYEQTCQEVERLQRSYNHVMEEANLQHPLVKEQFKRFAHMQREIVAMSEQYQKSLEDCQKAKSRYEQLETLFKDKCTENKHYEQETKDLARQVQVLLHELDLCENGIVLGVDSRKKINSYVEKSLTEDETDTDQIISSRLVVFRNIRELQQQNQNLLSAVHELADRMEKDEKPDLDGAEIQEETLIKANETIDQLTKMLEEVSDQLRYSLKERDFFRSLVQENEKLLDMAPATPNSKLNTNLIEQTSYQRSLIRLEQLTNELESLKSISRNKEKKFEEAISSLQLEKSNIQLQLTSLTSERSLALEKLNDLEKSLVLSERSKDELDESYKSLQEQLASKKIEVQNVSSQLSICNSQLEQSNHIVDNLKSENLLLTSVKDKLKADLSNLESKLSSLQQDNFHMKAQIESSNQEYTATVDSMNSRILELSNDLRVANSKLSECSDDVRRLTLQNSFDLREHQTLVLQLQSNITELKQDITLQRTVRNQLEIQTTELKERLKFMEERQENLQSKLIAANKDTTQNPDNVEVEAISIELERTKEKLRMAELEKSNIQQKYLASEKTLEMMNETHEQFKHLVESEISTREEKITSLRSELLDLNKRVEVLKEEKESSSKELAKQLEDAVREKDSALSFKKDYEKIRSDADRVITSLKEDIEKERSLMKECHSNYESEIVSHGRTTQKLRDLRTEFDEVNTKYLKLKANFEQQHSGLSGAEKDWNIQRKAMEDEISSLKDYILGLENQNKLLHSQFDSLSQQITVLQQNSSENLNISANLEAVQDNDLRELVSYLRHEKEIMDNKYELTILDNRGLNQQVKSLQSTVDSLQLELNRLQSLPVSNDQTDTPIISGSQEVQLLYESNSVLRKDNDAKLGKIQELEKEVEKLNASLNPLQTEINELKAEIGAKTASLNLMKEYNSRWKLRFQSVLNKYERVDPTQLEELKKNCEALEKEKQELETKLQETAKETDTFKQQVNSLNEEVENLKKEVEQANTKNTRLAAAWNEKCENLKKSSLTRFAHLKQELTNKNKELTSKNAENEAMQKEIESLKDSNHQLQESASSDAEQITKEQFEQLKSEKERTEKELADSKNELEHLQSEAVDADGKTEISNLEKEIHELRSDKEGLVQQVQNLSAELAALREHSPTQGSLENADEIARLRSQLESTKQYYEKEKETEILAARSELVAEKEKTKEELENQLNEKSQRIKELEEQAQKNSSENTHDNIDDMIKQQVEEKLKENSANFDVKLKKVVAETEFRSKAKISVYEKKTRDLQNKITQLEETIENLNKQLSNPEKTDESTSSVTETKPVTSKPTASKADVGQNATEASSAKREPSGKSLSARLQGTGKQKGVQRPAVSRPVPMKPDSGKLSITGASKRIATSKNAAQNAKELSSTAKSGSLKRQRDDANKGGSSSNQKKAK

SEQ ID NO: 22735 - protein, 350 aa, Schizosaccharomyces pombe
MTIPDKQLAAVFHTHGGPENVKFEEVPVAEPGQDEVLVNIKYTGVCHTDLHALQGDWPLPAKMPLIGGHEGAGVVVKVGAGVTRLKIGDRVGVKWMNSSCGNCEYCMKAEETICPHIQLSGYTVDGTFQHYCIANATHATIIPESVPLEVAAPIMCAGITCYRALKESKVGPGEWICIPGAGGGLGHLAVQYAKAMAMRVVAIDTGDDKAELVKSFGAEVFLDFKKEADMIEAVKAATNGGAHGTLVLSTSPKSYEQAAGFARPGSTMVTVSMPAGAKLGADIFWLTVKMLKICGSHVGNRIDSIEALEYVSRGLVKPYYKVQPFSTLPDVYRLMHENKIAGRIVLDLSK

SEQ ID NO: 22736 - protein, 339 aa, Schizosaccharomyces pombe
  unsure (1)..(339): unsure at all Xaa locations
MSFQILPIPMWVGTQDNYAYLLLCEETRQAAIVDPAEVNVXVLIIESYSXETEEFLSLDTGVIXPRRHDRHGSQRKCLSLTEXSKAWNXSFLFNSMLTKLQVMPILKKKLKNKEIDLQAILTTHHHADHSGGNLNLKKEFPHVTIYGGSDQNGVSHVLQDKETLRIGNVQIEALHTPCHTRDSICFYAHSSNEHAVFTGDTLFNAGCGRFFEGTAAEMHIALNAVLSSLPNNTVIYVSDSFLFFFIFFYFFFPNKFPSLGHEYTKSNVKFASKHLQSEALNHLEGLCNHNQFIAGHITMGQEKQFNPFMRVTDPELQKHLGLNDPIKVMDELRTLKNQG

SEQ ID NO: 22737 - protein, 393 aa, Schizosaccharomyces pombe
  unsure (1)..(393): unsure at all Xaa locations
MQQSPTAGKVSXIKTESCLLKQIINCKAAVAWQPAAPLSIENVQVFPPRVHEVRIKIVNSGVCHTDAYTLSGKDPEGLFPVILGHEGAGIVESVGPQVTTVQVGDPVIALYTPECKTCKFCKSGKTNLCGRIRTTQGKGLMPDGTSRFSCNGNTLLHFMGCSTFSEYTVVADISVVAIERLAPLDSVCLLGCGITTGYGAATITADIKEGDSVAVFGLGSVGLAVIQGAVKKRAGRIFGIDVNPEKKNWAMSFGATDFINPNDLQSPIQDVLIHETDGGLDWTFDCTGNVHVMRSALEACHKGWGQSIVIGVAAAGQEISTRPFQLVTGRVWRGCAFGGVKGRSQLPDLVKEYLDHKLEIDKYITHRRPLKEINEAFTDMHNGNCIKTVLSIP

SEQ ID NO: 22738 - protein, 521 aa, Schizosaccharomyces pombe
MSSIKSKTIIEPSENDIEKGEVDFVSSSISNFEEAYEEGPSLKREFKSRHVNMISVAGAIGTGLVIGSGSALLKGGPGSLFIAYLMTGINLYVVLISLGEMAAFSSDDKGFSGFSSRYVDKALGFATGWNYFFKYAIVYPTNLTAVGIVIHYWRPDLNVGIWVAVFLVVILAINLLHVKYFGEVEFWLSAVKILVLVTLIITCIVITSGGTPVHHKIGFHYWRDPGAFAPYLVEGSTGRFLGFWACLVQSCFAYVGSEVVGIAFGEAPNPEKTIRKSSFQSLFRIATFYVIGVFVLGLCVPYDSDILSSNASKGNAAASPFVVAIKLAQIKVMPDVINACLLVFIISSANSDIYIGSRTLYALAKEGYAPKILMLQTKQGIPWVGCLVTSSFGLLAFMNTKSSSATIFGYFSSAVTVFGTINWINILLSYICYHRATIVQQIPTERIPFRSWGQPYIAYASLIFTGLITFFNGYNAFIHGFKYRSFITSYIGIAAYVIMILGWKFTFKAKRVTSSTVDFRK

SEQ ID NO: 22739 - protein, 405 aa, Schizosaccharomyces pombe
  unsure (1)..(405): unsure at all Xaa locations
MGIPKSSIYFCILLFCIISFYLQSSKDGPKELKVKYVFLKKATAKQRGESSLTDSDYFPKQPNMNATLFMLCRNRDIKDALVSIQSVEDRFNHRYHYPWTFMNDAPFTKEFITATSKMVSGDATYVQLNNEEWGIPINIDLNRMLKSIRDMTDDKVIYGFSLSYRIMCRFNSGFFYRNKALSHYDYYWRVEPGVEYSCDIPLVSAQEKLTIXLLFLXYDRILSLTNSLSDPFRKLSDENKAYGFVISMTDYYETLPSLWNVTRDFIHQNPQYLAQNNSLDFIVNDHQGLSGDYNLCHFWSNFEIANLNFFRSPAYTDYFAHLDKNYGFFYERWGDAPVHSLAASLFLNKSQIHYFEDFGYYHLPWYHCPTDVQSHATARCLCDPTGTIDYLPFSCAIKWLENINS

SEQ ID NO: 22740 - protein, 419 aa, Schizosaccharomyces pombe
  unsure (1)..(419): unsure at all Xaa locations
VXLTHKDPTPDTTSCNIIKKEGANIISVYARYPVVAAKGEGSYLFDKEGRKYIDFTSGVAVTSLGHAHPEVARLAADQCSKLVHSSNLFYNEPAIELSNVINNSLAKNSGIAGPTKIFFANCGTEANETALKFARKAAFEKYGEGKSQIVYFNNSFHGRSLGSLSITANPKYKRGFQPLLPDVVQAVYNDPASIEQFVNDKTAAVIVEPVQGEGGICPAKPEFLIALRKACDKVGASLIYDEIQCGLGRSGDLWAHSIVKDVASPDIITVAKPLANGLPIGATIVSSKIAAEIHPGEHGSTFGGNPVACRVGTFCVNELGSSKILQNVRKQHKALTSRFDDFVAKYPNLIRGYAGRGLLLGLQFTEPPAKFIELARQQGLLLLPGGNNNTRVLPSLNVKDEVIAKGLDIMESTLKALSK

SEQ ID NO: 22741 - protein, 513 aa, Schizosaccharomyces pombe
  unsure (1)..(513): unsure at all Xaa locations
MSDDRFAEDEIIQQRRKRRLEILKKYQQTGNGHSDLSIPEKKLKEDVDQVSTTKPIEAVPKMKTNASKIEINKEGSNSNTKLDVTNSTTSDSPSIKSSVQIEDTEDDMFADSPSPSVKRQNTGKGISTLTRSFADMQDNWDDIEGYYKVVLMEELDSRYIVQSNLGKGMFSTVVSALDRNRNQTFAIKIIRNNEVMYKEGLKEVSILERLQAADREGKQHIIHYERHFMHKNHLCMVFEMLSLNLRDILKKFGRNVGLSIKAVRLYAYQMFMALDLLKQCNVIHSDIKPDNMLVNEKRNILKICDLGSASDASENEITPYLVSRFYRAPEISKSKXTPNCLXFQKYGNXILLLITFVLFFQDLTFKIVLGFPYSCPIDTWSVGCSLYELYTGQILFPGRTNNQMLRYMMECKGKFSHKMLKRSQFLNDHFDADFNFIQIDHDPITNQETRKPVKFSKPTKDIRSRLKEVPTSTDEEFIIRQELMDLLEKCLELNPEKRVPPEVALKHPFFIKK

SEQ ID NO: 22742 - protein, 531 aa, Schizosaccharomyces pombe
MFWRLGQGFGFQSSSAIEAILDKPEDEINLKELLEENGVLDECKSHNPKLLEYLCKPEVLSQLIDYILEVDETEIPSADGGYEEPEHTRLSYIASEILSSDVWSICEACVENKTLMVKLWSFLDSEGPLNPLQASYFAKVNEHFLDKKTEETVAFIQSIDNFVEKILRHAETSAIMDLLLKFISMDRCNTAIGIADWLYSQGLIQSLLRLLSPYVDPDVQFTVADVIKAIIAISANSNEPGVIGPNSLSRELVSRQTITTLTDYMTDSKAPHSATSLINGVSIVIELIRKNNSDYDVTPVLQMPLDTHPPTTRDPIYLGTMLRLFAEKIPVFQKILLKPSTESDLMPTSFGKIKPLGFERFRICELYAELLHCSNMSLLSDPNGEAMVMQRDHLRDYLFRHNSCARDLVMSDEDDDDSTFSDKNSKDFKETEDMNGAEDMHGRAPQITKDNLNLTTTDSPMSEAEPVSEEEYKDVMETAKALHHGDDDAASDTSYEPLPESVIEDAKKLPVIGDFLKIEFIQNNVIPTILD

SEQ ID NO: 22743 - protein, 1362 aa, Schizosaccharomyces pombe
MSLHSKKSTSTVKDNEHSLDLSIKSIPSNEKNFSTEKSENEASESHVVDVVKDPFEQYTPEEQEILYKQINDTPAKLSGYPRILSYADKWDIMLQLAGTITGIGAGLGMPLMSLVSGQLAQAFTDLASGKGASSFQHTVDHFCLYFIYIAIGVFGCSYIYTVTFIIAGERIARRIRQDYLHAILSQNIGYFDRLGAGEITTRITTDTNFIQDGLGEKVGLVFFAIATFVSGFVIAFIRHWKFTLILSSMFPAICGGIGLGVPFITKNTKGQIAVVAESSTFVEEVFSNIRNAFAFGTQDILAKLYNKYLITAQRFGINKAIAMGLMVGWMFFVAYGVYGLAFWEGGRLLHAGDLDVSKLIGCFFAVLIASYSLANISPKMQSFVSCASAAKKIFDTIDRVSPINAFTPTGDVVKDIKGEIELKNIRFVYPTRPEVLVLDNFSLVCPSGKITALVGASGSGKSTIIGLVERFYDPIGGQVFLDGKDLRTLNVASLRNQISLVQQEPVLFATTVFENITYGLPDTIKGTLSKEELERRVYDAAKLANAYDFIMTLPEQFSTNVGQRGFLMSGGQKQRIAIARAVISDPKILLLDEATSALDSKSEVLVQKALDNASRSRTTIVIAHRLSTIRNADNIVVVNAGKIVEQGSHNELLDLNGAYARLVEAQKLSGGEKDQEMVEEELEDAPREIPITSFGDDDEDNDMASLEAPMMSHNTDTDTLNNKLNEKDNVVFEDKTLQHVASEIVPNLPPADVGELNEEPKKSKKSKKNNHEINSLTALWFIHSFVRTMIEIICLLIGILASMICGAAYPVQAAVFARFLNIFTDLSSTDFLHKVNVFAVYWLILAIVQFFAYAISNFAMTYAMEAVLQRIRYHLFRTLLRQDVEFFDRSENTVGAITTSLSTKIQSLEGLSGPTLGTFFQILTNIISVTILSLATGWKLGLVTLSTSPVIITAGYYRVRALDQVQEKLSAAYKESAAFACESTSAIRTVASLNREENVFAEYCDSLIKPGRESAIASLKSGLFFSAAQGVTFLINALTFWYGSTLMRKGEYNIVQFYTCFIAIVFGIQQAGQFFGYSADVTKAKAAAGEIKYLSESKPKIDTWSTEGKKVESLQSAAIEFRQVEFSYPTRRHIKVLRGLNLTVKPGQFVAFVGSSGCGKSTTIGLIERFYDCDNGAVLVDGVNVRDYNINDYRKQIALVSQEPTLYQGTVRENIVLGASKDVSEEEMIEACKKANIHEFILGLPNGYNTLCGQKGSSLSGGQKQRIAIARALIRNPKILLLDEATSALDSHSEKVVQEALNAASQGRTTVAIAHRLSSIQDADCIFVFDGGVIAEAGTHAELVKQRGRYYELVVEQGLNKA

SEQ ID NO: 22744 - protein, 654 aa, Schizosaccharomyces pombe
  unsure (1)..(654): unsure at all Xaa locations
MDLLGLKELDNNKLVSKAKENGVEFSDLFLLSSGYLRDRENASASVSSKNERMVLNEERQNCWTKRNDPKGLTYYQLLKPSEVEILSRPETRRKRMACQVFFLNYYISTIEYHKLRKERLEEFTACTSSLKQSKQKRLWKEHCGRERAFLRKKRTKIQCSHFDLLVKLGQGGYGSVWLAKKRNTHELLAMKMMKKSTLQQLNEVRRHYXRSXKKTNNGSGKHILNERDILTNTNSEWLVKLYYAFQDKEKVYLAMEYVPGGDFRTFLTTKGLLHENQTRFYLAEMVAAISAVHKLGYMHRDLKPENFLIDQKGHIKLSDFGLSTAIVTSNQVNRLQHALVSAVNPQRPYLTQKQRRNIYKALLEKNENKVKTFXFKRKLKKNXVNSVVGSPEYMAPEVVYGKKYDRTVDYWSLGCICYECLVGYPPFSGSTLQETWTNLYYWREMLQRPSKNENGIYDKKARSVSDEAWSFITKCLTEPTSRFQSTIEIQKHPFFKRLHWNGLRKRAVPPFVPRLENQLDTSYFDDFNDEQVLDAYKDVYEKQRKAEQKAKSNGVMNGNQRQFLGFTFKYRPNARKPLVGRHREKRQLRKEKPEKKNNSTKQKDLITVSHNKGTTAIEDLDEDKRSKTKGHKTKSSRVHRLLERKGKDLYEFLL

SEQ ID NO: 22745 - protein, 508 aa, Schizosaccharomyces pombe
MSSISIDEKLKDPESVQNKEILDVDVGDLSPKGVDAAFNYALDVDYDEIDPETERRLVRKIDCTIFPVMCLVYCIQFLDKTSNSYAVIMGLKEDLKMEGQMYSWSGTAFYLGYLVFEFPASLLLQRFPLSKTLCVFLVIWGFLLCMTSVANYPGFIALRVLLGMMESAASPGFILLTAQWYKRSEQQLRTSVWVAFNGLGQILGSCMAYGLAKRTSLPMRGWKLIFIICGVLAIFLGFVILAVVPDNPFKAWFLTEEDRKLVVKRLRANKQGVGNNHFKLYQFKETMLDIRTWIMFVSSVLLNIPNGGIGTFSSLLIKGTMGYDTLQTLLMGLPAGACEFGGLIAFGFLSLFIHKRMVLATITTCIALIGSCLLSFAGPPRAQLAGYYLLMVSPGAMIVMFAIISSNASGYTKKVTVGVIYLIGYCVGNLIGPQTFKAADAPEYMPAKNTMVGCYAATLVTFPALYYVNWRENKRRDQLAAEGKIEHRPNAEFEDLTDFENLDFRYTL

SEQ ID NO: 22746 - protein, 435 aa, Schizosaccharomyces pombe
MVSEISDLSLAKEKSEAQFIARNPKSNDFHCKACDSLPGGNTRTVLHGAPFPIFIEAGYGSKLRDVDGHEYTDFLNELTAGIYGHSNPVIKKALMQGFDEIGISLGGTTTCELNYAEALKSRFLSIEKIRFCNSGTEANITAIIAARKFTGKRAVIAMHGGYHGGPLSFAHGISPYNMDSQDFILCEYNNSTQFKELVNSSQDIAAVIVEAMQGAGGAIPADKEFMQTIQLECEKNDIVFILDEVMTSRLSPGGLQQIYCLKPDLTTLGKYLGGGLPFGAFGGRADIMSCFDPRLPGSLSHSGTFNNDTLTLTAGYVGLTELYTPEAVKRLNALGDGLRKDIESYCHNTKMSITGLGSIMNIHFTESGRVNSYNDTAGEVIELKDLLWMDLLKEGFWIARRGMITLSLVLTESELEAFKLTIKAWIHRRMSLIRI

SEQ ID NO: 22747 - protein, 662 aa, Schizosaccharomyces pombe [sequence omitted]

SEQ ID NO: 22748 - protein, 229 aa, Schizosaccharomyces pombe
MAQFTLWSHAHGPNPWKVVQALKELDLTYETRYVNFSKNEQKSPEHLALNPNGRVPTLIDHHNNDYTIWESDAILIYLADKYDTERKISLPRDHPEYYKVIQYLFFQASGQGIIWGQAGWFSVYHQELVISAITRYRNEIKRVLGVLEDILKDRDYLVANRFTIADLSFISWNNFLEIIFAEGKFSIEEEVPQLDFEKEFPRTYSWHQRLLARPASKATFEERSKALDN

SEQ ID NO: 22749 - protein, 581 aa, Schizosaccharomyces pombe
MFLKYILASGICLVSLLSSTNAAPRHLYVKRYPVIYNASNITEVSNSTTVPPPPFVNTTAPNGTCLGNYNEYLPSGYYNATDRPKIHFTPSSGFMNDPNGLVYTGGVYHMFFQYSPKTLTAGEVHWGHTVSKDLIHWENYPIAIYPDEHENGVLSLPFSGSAVVDVHNSSGLFSNDTIPEERIVLIYTDHWTGVAERQAIAYTTDGGYTFKKYSGNPVLDINSLQFRDPKVIWDFDANRWVMIVAMSQNYGIAFYSSYDLIHWTELSVFSTSGYLGLQYECPGMARVPVEGTDEYKWVLFISINPGAPLGGSVVQYFVGDWNGTNFVPDDGQTRFVDLGKDFYASALYHSSSANADVIGVGWASNWQYTNQAPTQVFRSAMTVARKFTLRDVPQNPMTNLTSLIQTPLNVSLLRDETLFTAPVINSSSSLSGSPITLPSNTAFEFNVTLSINYTEGCTTGYCLGRIIIDSDDPYRLQSISVDVDFAASTLVINRAKAQMGWFNSLFTPSFANDIYIYGNVTLYGIVDNGLLELYVNNGEKTYTNDFFFLQGATPGQISFAAFQGVSFNNVTVTPLKTIWNC

SEQ ID NO: 22750 - protein, 578 aa, Schizosaccharomyces pombe
MSSESRENEVKAETKDEIANDGSPQLNGDNNIQSSDGHNDENEESLSRKRDSSGATVGDLKQEEKESMPKKEPEPTVKKIRGSGMPPPQQKYCLAIVRQLKRTKNSAPFKVPVDPIKQNIPDYPTIVKNPMDLGTIEKKLTSYEYSVPQEFIDDMNLMFSNCFLYNGTESPVGSMGKALQEVFERQLKQLPDAEQPAAAPVKKSKQKSASTAPPRTRRNSSVSSTSASVAASTAPKAASPAVLPEGKPRRRKNNSQMRFCSTVLKELYKRQYESFAFPFYQPVDPVACDCPDYFDVIKEPMDLSTIQSKLNKNEYSTLEEFESDILLMFNNCFTYNPPGTPVHVMGRQLENVFKEKWEARPKFDDATLVKQQEAETDALFDNGEEEEALMSEEEINGAKFAAVDKQISMLQDTLEAMKAKKMNRMRKPRRRDLTKEYGPITYAMQNELAERCNYLSAEQLSNVAEILREEMPWLRDTDEIEIDVGNMKPEVFHRIYRYVCKPDADSSEPASPVLMPTKPEKKKGRVLSETEQAEKIRRLQQQLDRFAGKTSPTSPESNNAANVSDSESDNESESSESA

SEQ ID NO: 22751 - protein, 630 aa, Schizosaccharomyces pombe
  unsure (1)..(630): unsure at all Xaa locations
MKLSSFGLFLALQLLPALGLPSRIDEVDVSDPELIGLLKPDNVDKPANSIPLSKRSTSPSYAPYTVACPSGSLLRPASDGLSTGEQEFVDKRVSKVNSALESFISKTGLKIDTKSVLNDTDGPRLGIAISGGGFPAMLTGAGAINAFDARNGNTTSLGGILQSSMYLTGLSGGSWLVGSVAVNNFANITFLHDDVWNLDHSLFAPYDDAFENFYIYQEWFEQVLQKKNAGFNVSITDLWGRALALKLVNPLTGGANTTFSSVTNETWFQDGEFPFPIIIADNVIEGETVIPLNDTVFEFTPIEFGTWDTGVESFIPMEYTGTHLINGIPLNESCVRNFDNAGFLMGTSSNVFSGILPATNASLTASNNTFNNAVLSFLEMLAEDQLDVGLYPNPYQGYGNASNTTTTNPLEPYPIIELIDGGSDSEGIPFWPLLHPQRDVDVIFAIDGGYQSATSGWPDGSSLVSTYERVLATNSSGVRGFPYIPDTNTFLALGLNTHPTFFGCDGRNTTAGNHTVNDDTPPLVVYFPNYPWTMYANVTTYTVQLEDTLSSGMIENAAVAATQNNSDSFAVCVACALVQRSLERKNMSTPSQCASCFNQYCWNGTIASTTVTTYAPTVLSAKIXYATLTT

SEQ ID NO: 22752 - protein, 911 aa, Schizosaccharomyces pombe
MRFQTTAISDYENSSNPSFLKFSAGDTIIVIEVLEDGWCDGICSEKRGWFPTSCIDSSKIQNFFSSFHSSNEKDPNAQCCAPFHVEAHLQDSAWFEKHGVQAINSIPSSEEFLRKNLQNDIHHLVKGILTTAAAVSQSIKKEGTQVIVFGIETVRSMVLSFPLIILSTLDENFLSEVAQVFSSLNLLPELSRMGCTYGELCIRFTKLLKQLANKFLFFFRPDVSFPSYFLGSLIAHEIHFLPWDFNMLCSNSVQSAHTNLQPDITSFVAILSLSHEAYHCTENEFWNLEAQKLTENTTQKVLQLVAEDALEAWKLDILEDIDRCIQCCRRFLSANQRINYSSSENNPFSFTSQDVEALKDELSSNLCDLYLWSIDLEQISPSDCLLDNYSLFVDLLVTLKVSLLRIKSIIVQFSERIVFLSLEYKFLTNIQPELNDAEKSQLDGFDLNKTNWFDSKGLVCYLMKQTSPEPLLIRNLLFSFWSCNGKIEQDGKIKTATLVFIINYLLRTDIDSTFFTTIFLNTYASMISSSDLFSILGAHFRFICSLNFGKISFISHEFYRVSKRFLDILLIWFESYLVEELDNSKSIFFLFKIYKVFEVFVVPHFASAEELLHSLSHLLHHPSTKRSHKMLEGKELSQELEDLSLHNSPDPIIYKDELVLLLPPREIAKQLCILEFQSFSHISRIQFLTKIWDNLNRFSPKEKTSTFYLSNHLVNFVTETIVQEEEPRRRTNVLAYFIQVCDYLRELNNFASLFSIISALNSSPIHRLRKTWANLNSKTLASFELLNNLTEARKNFSNYRDCLENCVLPCVPFLGVYFTDLTFLKTGNKDNFQNMINFDKRTKVTRILNEIKKFQSVGYMFNPINEVQELLNEVISRERNTNNIYQRSLTVEPRESEDQALQRLLIDSGIF

SEQ ID NO: 22753 - protein, 379 aa, Schizosaccharomyces pombe
  unsure (1)..(379): unsure at all Xaa locations
MEPGIPPMIDKAPAYSHVLIAGGIGGATADFLMHSLDTVKTRQQAALYTNKYNGMVKCYSTILCEEGVFHGLYSGVCPMLIGSLPATALFFSSYEYTKRHLMSNYNLPETLCFLLAGFVGDLFASVVYVPSEVSIAYSGKTKYFXKXISSFYPSKGFPLLYEKQLYTNERFSXVLKTRLQLQGRYNNPHFQSNYNYPSFRGAVKQIAKQEGMKTFFYGYRATILRDIPFSGFQLLFYEKLRQVAQKECGQKDIGVFRELITGSLAGAGAGFLTTPLDVAKTRLQTMIRTTDKVSDDINSGRYFFAKDENSKSKSAASLVKPKIGIRHVLGGLYKSEGLLGLFRGFGPRIFWTSSQSSLMFVFYEGIIRLFNKNNVLERD

SEQ ID NO: 22754 - protein, 379 aa, Schizosaccharomyces pombe; identical to SEQ ID NO: 22753
  unsure (1)..(379): unsure at all Xaa locations

SEQ ID NO: 22755 - protein, 346 aa, Schizosaccharomyces pombe
  unsure (1)..(346): unsure at all Xaa locations
MTDKYAFSLTTFSPNGKLVQIEYALNAVNAGVTSVGIKGTTXSWVLKXYNLCIPFGSVFCFCVINTNIIIATDGVVLATEKKPTSELAIGASLEKVCAITPDIGMVCLHIGFSEVKNWNFGFXRFYVQVYSGMGPDFRVLVDKSRKVAQTTYKKIYNEYPPTKILVQEIASVMQESTQSGYAFYHXIDFIXTILCXMQHCLSKFVSLIFIILFFFYSTLSXLHYLVGVRPFGVSLLVAGMDEKGPSLYQVDPSGTYFAWKATAIGKSSTAAKTFLEKRYNDELELDDAVHTAILALKETFEGELTEDNIEIAVVSTKPTDSGIVGVPGGHFCRLSQSEIRDYLDQV

SEQ ID NO: 22756 - protein, 373 aa, Schizosaccharomyces pombe
  unsure (1)..(373): unsure at all Xaa locations
MVRSRVSPGLKLQSDASNQSNDKENKLLAYVNDNRHFSLIRYDLRILVYTIAKGLCKRIHYLKYXLEDCRALHLADLITLMNGFCGVMSIFSSLRYCLSGQQSAFHLWNAMYFMPFALFFDFLDGKVARWRGKSSLMGQELDSLADLVCITSQICSETIFTLVALTXXKHEEHDKRLLWLNFFFILAKSSFFFLLLVFYIMSVCSMSLNFSQXTCDCVXFLIIYIFSLSYPVFLYHYTNKIISFGVSPAVFAFCCGFQTFLDTVILSLFVLCGLTRLARFNVSVNSIPKDGSGKSQFFEGTPIPTTLSLVTVCGVCILKGKTHENLPWGEWCGNTPFAFHPLVVLFVLSGIAMTSKKLKVPKSTFLLHSLKYV

SEQ ID NO: 22757 - protein, 604 aa, Schizosaccharomyces pombe
MSVEVDKSSHSKPKIEKKSKRNKRKWLNDENKTHVTASEAAIERLKKSASFSQAAQQALKQSRKEDNERDIEMQDVDAEAQPHDLLPIPQPSVEDFVDSKPHVKNITSVLPKWLAEPITVDPNTTVEFSSLNISSKLVERLQKQNITRGFAVQAAVLPLLLQDGRHGPMYSYGGDVCVSAATGSGKTLSYVIPIVQCLSHRTVPRLRCVVIVPTRELTVQVAKTFEYYMSGAGLQVCAWTGQKSLRHETYQLNGDENECRIDVLVSTPGRLVDHIRNDESFSLQHLRYMVIDEADRLLDQSFQDWVDTVMMEISHPKCLQNKSNILDLDQNISPTFLPDIDTLLPYRLPSPLQKLVFSATLTRDPSKIASLKLHNPRLVLVQNKDMEVDDGGEIEDDAIVFSVPPTLQEYHVSVSSEKPILLYHLIHSKNLTNILCFVKSNEAAARLHRLLELIHESLNQSFSCGLFTSSLSRDERKKIISRFATGDLNLLVCSDLMARGIDVANTQNVINYDPPLSVRSYVHRIGRTARAGREGFAWTLVQSHEGHHFSKLVKQLRRTLPIKRIKIEFSHISEEFVVAYDKALEALRVEVFNSRYPQQKSFLT

SEQ ID NO: 22758 - protein, 1292 aa, Schizosaccharomyces pombe
  unsure (1)..(1292): unsure at all Xaa locations
MSVGNVGKQREKTKDSSAKTKQKTLFGFFSKIPNVKQEKSDSTLSSSSNHDSNHDTPADVDNSSNVNKNSSSPERELPTSPSHHANTEIDSSSSMLPPPSSDPFSSPLSSSLHRSSPKRPHDSLGEESPGKLLRTSVKQEPDSEEEIDSPTKKKSFKSLDTSIFQAEDQFRHPVSSKLENSELSEVDKPFIASRRSRKVWVIEXYILLXKNKRGNTHFTPILTRFLFXLIMTNNMLPVSYAESDEDEDFDDAPTKGSRHKRIVSDDESDDYVEPDHISEASSEASLPIDEVESMDEDVDGYSDHSVSVAAPIPKKESRKESSNSLYESYRLGSQIASPSPSVSGSASPTKSNKNGVLNREEKRRQRMEAFKKENNERYEWLLDVRDADQNRVGDPNYDPRTLYIPPSAWATFKPFEKQFWKIKKDLMDTVVFFQKGKFYELYENDAAIGHQVFSLKLTDRVNMKMVGIPEASFDYWASQFIAKGYRIARVDQLETALGKEIKDRQRTQKEEKVVQRGLTQVLTSGTLVDEAMLTSDLSTYCMAIKESLQSDNEEPSFGICFIDTSTGGFHMCEFTDDIHRTKLDTLLTQVRPKELILEKSKISQKSIRAIKYCVSSSSIWNFIKPYTEFWDNERVEREIIAGDYFKNGLEGAPKILKSYLSEKPLAISAFGALFWYLRQLKLDKDMCSMGNFDEYDASQQSTSLLMNGQTLKNLEIFSNSFDGGSEGTLFHLLCRCVTPFGKRLFHTWLCHPLRSGTAINARLDVVELIADNPVIRDTIWGFLHKLPDLERLISRVHAGRSKPADFVRVLEGFQRINSAFDQLREEFMEVAEGTLLGEIIQSAPNMKEELEAWTRAFNWQKASEEGVFEPEIGFEAEYDTSQKYQSELKNELYALLEQYKKQLRCSSLNFKNIGKEVYQVEVPSDVKVPVNWCKMSGTKKTNRYYNDELRKKIKKLLEAEELHLAIMSRMQEKFYIRFDSNYEQWLALIKYTASIDCFFSLSQAAAALGEPYCRPEIIEQKDGHLYFEELRHPCINASAASTFVPNDVVLGGESPNMIVLTGPNMAGKSTLLRQVCIAVIMAQLGCWVPAKRASITPMTSIYTRLGANDDIMSARSTFMVELSETKKILDECGPKSLVILDELGRGTSTYDGHAIAYAVLHHLVSNIGCLGFFSTHYQSLCVDFMHHRQVRLMQMAAAVDEKIRRVTFLYKLEDGICPKSYGMNVASMAGLPEKVIDAAEEKASELEQASASFINASDDIALMSDFLQVLRISKSIEPLTAVNIPLILDSFE

SEQ ID NO: 22759 - protein, 649 aa, Schizosaccharomyces pombe
MFSIFKRRSVQAALAASGLVGGAVFYSDFIKRPAPSHFNPQFTPFTKSLAPPPSRETLLKNVEDISKFDVLIIGGGATGTGVAVDASTRGLNVCLLEKTDFASETSSKSTKMAHGGVRYLEKAVFQLSKAQLDLVIEALNERANMLRTAPHLCTVLPIMIPVYKWWQVPYFFVGCKIYDWVAGSKNLRASTIFSKETTVAIAPMLDDSNLKASCVYHDGSFNDTRMNTTLAVTAIDNGATVLNYMEVKKLLKSKDNKLEGVLAIDRETGKEYQIKATSVVNATGPFSDKILEMDADPQGEPPKTAQFPRMVVPSAGVHVVLPEYYCPPNIGILDPSTSDNRVMFFLPWQGKVIAGTTDKPLSSVPTNPTPSEDDIQLILKELQKYLVFPVDREDVLSAWCGIRPLVRDPSTVPPGTDPTTGETQGLVRSHFIFKSDTGLLTISGGKWTTYREMAEETVNELIKDHDFGKALKPCQTKKLILVGGENYYKNYSARLIHEYHIPLRLAKHLSHNYGSRAPLILELYSKTDFNKLPVTLADKEVFAPSSDASSDKSVSYASFDEPFTVAELKYSIKYEYTRTPTDFLARRTRLAFLDARQALQAVAGVTHVMKEEFGWDDATTDKLAQEARDYIGGMGVSSDRFDVKQFEVK

SEQ ID NO: 22760 - protein, 370 aa, Schizosaccharomyces pombe
MGQTLSEPVLDKHSSSGGDRWLHFGVSHMQGWRISMEDAHCALLNFTDSNSSNPPTSFFGVFDGHGGDRVAKYCRQHLPDIIKSQPSFWKGNYDEALKSGFLAADNALMQDRDMQEDPSGCTATTALIVDHQVIYCANAGDSRTVLGRKGTAEPLSFDHKPNNDVEKARITAAGGFIDFGRVNGSLALSRAIGDFEYKKDSSLPPEKQIVTAFPDVVIHNIDPDDEFLILACDGIWDCKSSQQVVEFVRRGIVARQSLEVICENLMDRCIASNSESCGIGCDNMTICIVAFLHGRGLEDWYNWITQRVNSGEGPCAPPSYAELRGPNTIADARNLQLEYDHIASHEYGSGDTYDSDSDDETIAYDRYYLH

SEQ ID NO: 22761 - protein, 305 aa, Schizosaccharomyces pombe
HDYSDMDNYPRPSHADYTYLEKYGVKASSGGGRSSARETIGRVAAGAIAEKYLLEAYGVEIVAFVSSVGKIAIPLHETASSAILDPEDDTFESPITAEYLKFLNKITREEVDKTTVRCPHAATAAKMAERITRARDNHDSIGGTVTCVIRNVPTGLGEPCFDKLEAKLAHAMMSIPATKSFEIGSGREGCKVAGSKHNDLFYRNADTGKLGTLTNNSGGVQGGISNGENVYFTIGFKSPATIGVEQSTSRYDGSDGVLAAKGRHDPCVVPRAIPIVEAMAALVVMDAVMIQQSRIASRNLLPNAQ

SEQ ID NO: 22762 - protein, 712 aa, Schizosaccharomyces pombe
  unsure (1)..(712): unsure at all Xaa locations
MSSSNEQICLDEDWVSLILILXLYXLIMVRIQKFGDREIEFVDEAQKSEVDETEKSIKRFPLSVLQRKGLALINLRIGVVKTGFGGKTYIXAFETTXXLFFNSFNLXNIDFEKDPAFSNGEELPANSFSPGDVVSIRQDFQSSKKKRPNETDISVEGVVTRVHERHISVALKSEEDIPSSVTRLSVXVLINVSLQKNDXQLKSVKLVNRVTYERMRHTMLEFKRSIPEYRNSLFYTLIGRKKADVSIDQKLIGDIKYFNKELNASQKKAVKFSIAVKELSLIHGPPGTGKTHTLVEIIQQLVLRNKRILVCGASNLAVDNIVDRLSSSGIPMVRLGHPARLLPSILDHSLDVLSRTGDNGDVIRGISEDIDVCLSKITKTKNGRERREIYKNIRELRKDYRKYEAKTVANIVSASKVVFCTLHGAGSRQLKGQRFDAVIIDEASQALEPQCWIPLLGMNKVILAGDHMQLSPNVQSKRPYISMFERLVKSQGDLVKCFLNIQYRMHELISKFPSDTFYDSKLVPAEEVKKRLLMDLENVEETELTDSPIYFYDTLGNYQEDDRSEDMQNFYQDSKSNHWEAQIVSYHISGLLEAGLEAKDIAVVTPYNAQVALIRQLLKEKGIEVEMGSVDKVQGREKEAIIFSLVRSNDVREVGFLAEKRRLNVAITRPKRHLCVIGDSNTVKWASEFFHQWVDFLEENAIVMDIDATMFE

SEQ ID NO: 22763 - protein, 505 aa, Schizosaccharomyces pombe
SFLWVPVSQYAYRAISTKALRHVLNLSYDFHLNKRAGEVLTALTKGSSLNTFAEQVVFQIGPVLLDLGVAMVYFFIKFDIYFTLIVLIMTLCYCYVTVKITSWRTEARRKMVNSWRESYAVQNDAIMNFETVKNFDADDFENERYGHAVDIYLKQERKVLFSLNFLNIVQGGIFTFSLAIACLLSAYRVTFGFNTVGDFVILLTYMIQLQQPLNFFGTLYRSLQNSIIDTERLLEIFEEKPTVVEKPNAPDLKVTQGKVIFSHVSFAYDPRKPVLSDINFVAQPGKVIALVGESGGGKSTIMRILLRFFDVNSGSITIDDQDIRNVTLSSLRSSIGVVPQDSTLFNDTILYNIKYAKPSATNEEIYAAAKAAQIHDRILQFPDGYNSRVGERGLKLSGGEKQRVAVARAILKDPSIILLDEATSALDTNTERQIQAALNRLASGRTAIVIAHRLSTITNADLILCISNGRIVETGTHEELIKRDGGAYKKMWFQQAMGKTSAETH

SEQ ID NO: 22764 - protein, 679 aa, Schizosaccharomyces pombe
  unsure (1)..(679): unsure at all Xaa locations
MQPQEVDLMENSTMRNGARVLPPEAISKRHIGPYIIRETLGEGSFGKVKVRLLIFNIMRIETNVLVVATHYKTQQKVALKFISRQLLKKSDMHMRVEREISYLKLLRHPHIIKLYDVITTPTDIVMVIEYAGGELFDYIVEKKRVSGAVCEFLLQXISEVMLDWFDLSKCTSYPIVFFKNRKRXIVFASEMLLMKACLQIXMHEFMYLLTVFKDTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSMFGHFFFYLSLAKRIXVVFYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSFPFLDLCAMLVCKLFSA

SEQ ID NO: 22765 - protein, 448 aa, Schizosaccharomyces pombe
MGLKLWVKQRRSLPFIIGTIAIALFTDLFLYGIITPILPFSLVDRVGISPDRVQSVISTLLAVYAVANIAASSPIGFLADKFLTRKVPMLIGLIFLTSATALLTFGNSVPMLIVARVLQGLSAAVVWTVGLALLVDVVGADNVGSTMGGIFGFISLGEIIAPVFGGIVYESLGYYASFGVCFIILLLDIALRFLMIEPREMKNDSTLQDVERTSILQRQDTQDHELKPKRSGLFSSLCLPIYSLLHHKQIFGPFWTSFVNSCLFSAFDATIPLELKTLFDFNSLQCGLMFGVLSTPYFFCGAWAGAMVDRRGSRTIGKRAYAILGCTLFLLCIPRTNTSLNIYLFSAFLAINGVVLAFTSSPGFVQSSHYVAEYELEHPTFFGHNGPYTQLFSAYNIVYSLGMIIGPLVAGFLRDQFNFITSIACLSLLCFSASLMANSCFTDRLDSE

SEQ ID NO: 22766 - protein, 426 aa, Schizosaccharomyces pombe
MNSTTPTYHLIPKGGKHGEFRQESDTFGPIQVPAEKYWGAQTQRSLQNFRIGGEKERLPLPLVRAFGVLKRAAASVNREFGLDPKLADAIEQAAQEVIDGRLDDNFPLVVFQTGSGTQSNMNSNEVIANRAIEILGGTLGSKKPVHPNDHVNMSQSSNDTFPTVMHIASVLQIHTHLLPAMKHLHRALKGKEEEFKNIIKIGRTHMQDATPLSLGQEFSGYVTQVGYGIERINNALPRLCLLAQGGTAVGTGLNTFEGFDVKVAEKVSKLTNIEFKTAPNKFEALAAHDAIVEMSGALNVIACSLMKIANDIRQLGSGPRCGLGELILPANEPGSSIMPGKVNPTQCEALTMVCAQVMGNHATITVAGASGHCELNVFKPLLAKNILSSIRLLGDACESFTDHCVVGIEPNYEGIARHLRDSLMLV

SEQ ID NO: 22767 - protein, 347 aa, Schizosaccharomyces pombe
MKGSHPNAGSLLEPLHKLNPFSENSTSGHRKNASDHSADGETRPIAIEMKDSKGNTVPVGNSRPSKASNWLAGLMEDKNQRWRRSMEDTHICLYDFGGNQDDGFVAVYDGHAGIQASDYCQKNLHKVLLEKVRNEPDRLVTDLMDETFVEVNSKIAKATHNDICGCTAAVAFFRYEKNRTRRVLYTANAGDARIVLCRDGKAIRLSYDHKGSDANESRRVTQLGGLMVQNRINGVLAVTRALGDTYLKELVSAHPFTTETRIWNGHDEFFIIACDGLWDVVSDQEAVDFVRNFVSPREAAVRLVEFALKRLSTDNITCIVVNLTRNPGDLDDSGLTADNDSYSNDYY

SEQ ID NO: 22768 - protein, 345 aa, Schizosaccharomyces pombe
MVKVIYKFAVFAAVNFFLMSSIVLYFNNEFLMFADRCTKDIIPSEELRYLRQVLNDSIPSKDEPLPTLKLDSLNDISGEPVIPKIIHQTWKTTEVPEGWKGAQQSCIDLHPDYEYILWTDEMSRNFIADNYPWFLPYFDAYPFNVQRADVIRYFVLYHYGGNYIDLDDGCRQRLDSLLYYPVWVRRTDPVGVSNDVMGSVPHHPYFELIIQNLEKNAKSYWLPYLTIMLSTGPLSISFLWEKYKRQLPNPPAFYDHIRVLLERDYKFSNDSYFTFYEGSSWHNNDAGIILWANRHLAYVIVAGFCLYFILSYMFFSKLLDSRYVQRFVTSKRKQPTLPLALQEDV

SEQ ID NO: 22769 - protein, 496 aa, Schizosaccharomyces pombe
MIVSWSLKDAVVVVVGSGKNAYRRVNLCLSENSSKIFWFCRSSADGGFDVGHLQLDAKKSDAIEILPISEFDPVRSLTTLGKEETDFLVDAVFVSESNHHEKEILHRTCKRYRIPLNIIDNPSLCSFTLPATWSEPPLQISLSTSSNGCRLAQRLLRHVVSSLPSGMPEAIERFGRVRAITKTPEKKQWINHVSDFWPLEKLVRMTEDDLLAIVSDNFSLPLSSSQSSSLANSYESLSTTLDKPSLTLDPEAFPTHKRGSIALIGSGPGSPDLLTVAARKAIMKADYVLADKLVPEAVLQLIPRHTPLFIARKFPGNADKAQDELHQVAFDALSRGDYVVRLKQGDPYIYGRGGEEYLFFTQHGYVPTVIPGISSALMAPISAGIPVTHRGVADQFLVCTGTGQKGSMPKIPSFVPTQTTVFLMALHRLEILVQALIESGWPRVLPVCIAERVSCPDQRFIFSTLEDVVEEYNKYESLPPGLLITGYSCNTLRNTA

SEQ ID NO: 22770 - protein, 261 aa, Schizosaccharomyces pombe
MSTPPANVTTAHVLDLFSLKGKNCVVFGAAKGIGFSIATAFAQAGGNVIITYLTTDPTEKAKKLAEETGVQVHTLKIDISRSDTVEAGVEEIQKIFKEIHVVVANAGMPFRRSVLDSPPHEFEKVMNINTNSVYRVAYYMGKIFKKQGFGNLIATASMSATIVNAPQHIAAYCASKAAVRQLCKALAVEWAEFARINSVSPGYFATDMPGYEFLKQWEPYVPFKRLGLTPELRGTYLYLASNASSFVTGLDLIVDGGYTCL

SEQ ID NO: 22771 - protein, 305 aa, Schizosaccharomyces pombe
MFDLDEWIATVRKCKYLPEHQLKRLCEMVKVILMEESNIQPVRTPVTVCGDIHGQFYDLLELFRVGGELPSTNYIFMGDFVDRGYFSLETFTLFMLLKARYPDKITLLRGNHESRQITQVYGFYDECQTKYGNANVWKYCCQVFDFLTLAAVIDNKILCVHGGLSPEVRTLDQIRILARAQEIPHEGSFCDLMWSDPEDIESWTVSPRGAGWLFGSKVTTEFSQINDLTLIARAHQLVQEGYKYHFADKNLVTVWSAPNYCYRCGNVASVMKVDESLEPEFRIFSAVADEDRTVPPSRKRSEYFI

SEQ ID NO: 22772 - protein, 650 aa, Schizosaccharomyces pombe
HINMSKSIGIDLGTTYSCVGHFSNNRVEIIANDQGNRTTPSYVAFTDTERLIGDAAKNQVAMNPHNTIFDAKRLIGRKFDDPEVQSDMKHWPFKVISKDGKPVLQVEYKGETKTFTPEEISSMVLMKMRETAEAYLGGKVTDAVVTVPAYFNDSQRQATKDAGLIAGLNVLRIINEPTAAAIAYGLDRSNQGESNVLIFDLGGGTFDVSLLTIEEGIFEVKATAGDTHLGGEDFDSRLVNHFIQEFKRKNKKDITGNARAVRRLRTACERAKRTLSSSAQASIEIDSLFEGIDFYTSITRARFEELCADLFRKTMEPVERVLRDSKVDKASVNEIVLVGGSTRIPRVQKLVSDFFNGKEPCKSINPDEAVAYGAAVQAAVLTGDTSEKTQDLLLLDVAPLSMGIETAGGVMTPLIKRNTTIPTKKSEIFSTYSDNQPGVLIQVFEGERARTKDCNLLGKFELSGIPPAPRGVPQIEVTFDVDANGILNVSALEKGTGKTQKITITNDKGRLSKEEIDRMVAEAEKYKAEDEAESGRIQAKNHLESYAYSLRNSLDDPNLKDKVDASDKETVDKAVKETIEWLDSNTTAAKDEFEAKQKELESVANPIMAKIYQAGGAPGGMPGAAPGAAPGAAPGAAPGGDNGPEVEEVD

SEQ ID NO: 22773 - protein, 192 aa, Schizosaccharomyces pombe
MSLQIGKPAPDFKGTAVVNGAFEEIKLADYKGKWVFLGFYPLDFTFVCPTEIVAFSEAASKFAERNAQVILTSTDSEYSHLAFINTPRKEGGLGGINIPLLADPSHKVSRDYGVLIEDAGVAFRGLFLIDPKGVLRQITINDLPVGRSVDEALRLLDAFQFVEEHGEVCPANWHKGSDTIDTKNPEKYFSKH

SEQ ID NO: 22774 - protein, 1144 aa, Schizosaccharomyces pombe
  unsure (1)..(1144): unsure at all Xaa locations
MEKRNETGNNRLKRSNNRGKSKKDWKDASVETTPRETSVDEDNTSVFEDVEAQDSRQKRFSSTLEGNRFEELRSLREKEREVAIQNGLIDDPTKPRQLDEAVTFVGTCPDMCPEYEREQREYQNNLERWEINPETGRVDKNLAVKAFHRPAAGNEQALPSDVRPPPVLKGLIFFFLLILLIRKFIYICISKKLFKGSYXIXVRYEFXPPAXILPFYIYIIHFAILGCYLFFLSQLHFYSHMTXKSLDYLVDKIVCGPDPLENTHFFVRDRTRSIRQDFTLQNCRDLDAVACHERIARYHILCIHQLCEKKQFSAQQEVEQLRKGSKLKMLILWDLNFLXAFXLAALFLFIYFIILTFXYLQSLCEFYDDLRKVKIRCPNEPEFRSYAIITHLRDPDVVRQSQILPIEIFDDQRVQLALRLSALAQKNNERVGHILPRNTEACPNLYTRFFKLVQSPAVTYLMACLLESHFMSIRKGALKAMRKAFMSAHANFPCGDLKRILHFDTVEQAASFSRYYGLEVSDDNGELSINLNKTAFFNGMXFINYRTNSXDSKPDFRQLFSQTLVESKLQNRSFADIINGSRYNIDRVSPNTAFSTNIPLSLPFANKEPQPIAGFKKNTPETSVVSKNLSTFNGKFNVNAPVFTPRSFPTKPFSATDISSVQPTNLPNGSTNGTETFIPPVQNSITSNKEAVKPIKNKPKPISFESLSAVGNLIISDSLSRIVRQILQNLYTEWVHEKTNLVFATMFRTIFREVLLDGIASEVYLKSLKKHAISQISVRAHHSWVKKQEKMMLEMREKNRQEKYFSVLNSVVKAESSNITRLPIKRTFYGDTRNLDKASEKLRAEHDRTRRLWKPVLMDSLFSNLQKFPVYEDWHLLIFNASTSSMMKTWLCAKFSLKETNKTSFWHSSYNLFNRQYHVDMPDNVSDLPQTRLCYGACVYNVGLLDEEKRKDLANSDLNSSPKLIQGNDSRSAHESSANKLFSFVHDISRLTITKLPLLLIFWSDSNLDMQGITQKYRFLELITSTWSAISSIHVLTITNDRDMDLEHSLKVLLDNVTVEKSPFAQLEELEVVRKKREAEIEASSKTVKRLASNNKFLTDSNVEGLLEAPTSLENSLVEDDKWASLRQKIKAARDLLKKVETFY

SEQ ID NO: 22775 - protein, 389 aa, Schizosaccharomyces pombe
MNSTEEIDLYNRWKALERQLEMLDLQEGFIKEDCKSLKRELIRAQEEVKRIQSVPLVIGQFLEAIDQNTAIVGSTTGSNYVVRILSTLDRELLKPSASVALQRHSNALVDILPPEADSSISMLRPDERPDVSYADVGGLDVQKQEVREAVELPLTQGDLYRQIGIDPPRGVLLYGPPGTGKTMLVKAVANSTAANFIRVVGSEFVQKYLGEGPRMVRDVFRMARENAPAIIFIDEIDAIATKRFDAQTGADREVQRILIELLTQMDGFDQGANVKVIMATNRADTLDPALLRPGRLDRKIEFPSYRDRRQRRLVFQTITAKMLLSPEVDLDTFIMRPDASSGAQIAAIMQDAGLLAVRKSRGVILQSDIEEAYARAVKPTDMEQFAFYK

SEQ ID NO: 22776 - protein, 628 aa, Schizosaccharomyces pombe
  unsure (1)..(628): unsure at all Xaa locations
MRNTHNPNETEASEDAENDTQSESDLSFDHGSSEKLNRASLPKTQNSAIPQSNALNTTPNESTSQIDSSPKIPSAVPHISTPNPSSGASTPNIKRVSDFKFGEILGEGSYSTVLTATENSTKREYAIKVLDKRHIIKEKKEKYVNIEKEALCILSKHPGFIKLFYTFQDAHNLYFVLSLARNGELLDYINKVCINNVHAAXXWIAYXLLQSCLFSYXMFYFLLTHNLLGRFNEICAQYYAALIVDSIDYMHGRGVIHRDLKPENILLDDNMRTKITDFGSAKILNSSHGSHEEDTHHADKPQAHSRSFVGTARYVSPEVLSDKIAGTASDIWAFGCILFQMLAGKPPFVAGNEYLTFQSILHLSYEIPPDISDVASDLIKKLLVLDPKDRLTVDEIHQHPFFNGIKFDNTLWELPPPRLKPFGHTSVLSLSVPNASNKHENGDLTSPLGVPSMVSASTNAAPSPVGTFNRGTLLPCQSNLEEENKEWSSILQDDEKISKIGTLNVYSMSGINGNDAFRFFSSLFRKRKPRTFILTNFGRYLCVASDGEGRKTVKEEIPIKSVGMRCRMVKNNEHGWVVETPTKSWSFEDPNGPASAWVELLDKASSISLPFGNHSVTSFSRSIARSAV

SEQ ID NO: 22777 - protein, 682 aa, Schizosaccharomyces pombe
  unsure (1)..(682): unsure at all Xaa locations
DCLKNFAIGKYAILFVIEVSPSMLDPVDEFTPSSLQMALICAYQLAAQRVITNPSDIMGVLLYGTVSLMLHLNSPTFTSAIKCLXPQRRESSTGRFANQMMLLDIDPPDAERIKSLQSFEKRXKLLTDYFLSCFFPTDYXFCSIVXDFQFSKEKFKPCSCQVSLSSVLYHCSVIFTTKAENFEKRLFLITDNDHPAWDATERDIILQRAKDLRDLDIQVHPVFLDPPTHSFRINIFYSDFLYIVYGRQDVSNLVNRGQAQLQHMLNMITALQKPKRAHFHLKMDLGNDVRIGVEAFILLKRLESAKTNWVYAKGERFAVAVPQSKQVSFATKKELKKDEIRRSYSYGGSSVVFGSDELNKVRSFEPPTLRIIGFRDFSTLKPWHCLKPAVFLRPKDDEIIGSGAVFSAIHKKLLASNKIGIAWFVSRPNANPCFVAMLATPGSIHIRDDFELPLGIFLVQLPTADDIRSLPPINPNPISMPSNLIETMQRILRGMELRSYQPGKYNNPSLQWHYKVLQALALDEEIPTDFVDNTLPKYKAIQKVXKLXLPCTTMLTFXRVGEYMGDVNNIVAEYRNDISDKNGIKEEEEDQGPIVKKARIEKSGKPIFAEDDRLKQLYIEGVLDKEIKVKYFIYLVRSXLVTVHMKALKVSQLKDILRDRGLRVSGKKADLLDNLTNYVKKL

SEQ ID NO: 22778 - protein, 509 aa, Schizosaccharomyces pombe
MIIKKKESFKSPGRLWRVTKIRKLTAAKKNELQNRKCNQASNEEKKILYKSNFLDRFIPSKANSDAFRIMENAFTEKLNTQESLLPDILNLNVKGVLHYKDNKKQKTTRLIESTNYQRQTIHGASSSLVIEVEENGHLSNMQGSLYETPLRILDAPGLLDDFYISPLAWSTNGELAVALAQNVYLWSEISGPSIMELSPTTYEVSSLAYSSDGGFLAIARVNGFVEIWNRKTKNNRCDYKFHHDGDISCMAWSPINWTLLVGGSTGNIYVYRRTKSMMRRVHTIKKVHQEQVCGLEWNYDGTQFASGGNDNLVCIFDIDSLENKKFYWIHLAAVKALAFCPWQKSLLAVGTGSNDQQIYFYDTFRGHRIHSLFCGAQVTSVIWSRRYKEFCYSLGYSPEGTNSSLIVYRWPQLTKVFDIPSAAIDGWGQDLRTIMAIHTHRKYSNNTWEEGEYVVVANSDETVKFYKIWGNEMQEIHNDRVLYREGIFGSHILEMLENIPEQVLTNGVR

SEQ ID NO: 22779 - protein, 395 aa, Schizosaccharomyces pombe
  unsure (1)..(395): unsure at all Xaa locations
MASNSIKIFAGNSHPELAEKVARRYELVRXLYDKIXGFRRAGEKCERNAPVVWELMGVWXISXIVNELTKNLXIRIGLSLGKVAVVQYSNRETSVTIGESVRDEDVFILQTGCGSINDHLMELLIMINACRSASARRITAIIPCFPYARQDKKDKSRAPITARLVANMLQTAGCNHIITMDLHASQIQGFFNVPVDNVXVQRXRCLRTICLYMYSNILFSCYAEPSVLRYIRENIDTTVNPTVIVSPDAGGAKRATALADRLDLDFALIHKERQKANEVSRMVLVGDVRDKLAILVDDMADTCGTLGLAAKTLKDNGAKAVYAIVTHGILSGKAIKVINESALEKVIVTNTIPHDDKRSLCSKIETIDISGVLAECIRRIHHGESVSVLFSVAPA

SEQ ID NO: 22780 - protein, 433 aa, Schizosaccharomyces pombe
MLTRSVLRKAPRAFSPFLQKRNLALHEYISHDILRKFGVDVPRGAPARSGEEAEKVARDLKVTDLVVKAQVLAGGRGKGQFDSGLRGGVRPVYDATEARMFAEQMIGHKLITRQTGPAGKICNVVYVCERKFIRKEYYFAILMDRENQCPMIVASDQGGVDIETVAAENPSAIIKRSLPNSPNLDPHIAEELVDKLGFSSSSKPKAVDAIVKLYKVFNDCDATQVEINPLAETTDHKVLCMDAKLNFDDNAEFRHSNIFVLRDISQEDPDEARAAKVGLNFIKLDGNIGCLVNGAGLAMATMDIIKLHGGEPANFLDVGGNANAEAIREAFSLITNDPKTTAIFVNIFGGIVRCDVIAKGLISVVSALNLNIPIICRLQGTNQGAAKEVINNSGLRIFSFDDLDEAAKKACRFSRVVEMAREADVNVSFELPL

SEQ ID NO: 22781 - protein, 1283 aa, Schizosaccharomyces pombe
MFAVQGNQKFPKGLTKDNIQSLYQQWQVMRNQGATEENNPEFAQISSILRMVQRAHYARMQQMRNQSSEFPDAENTNLRKQQDTLPTTGFNNLPEGKAGMQTLPGRPASNGPTPPNPGNGNVGLNNPSYMNSQASPNIMNAPLQRDTSVPPAPSMVHPHTNTNANSNNLKVYANQLSQQNTSNPTYHNAYDMASMMKNGSRMNNSFPPTTPYPPANDTTVNSSLPHSFASPSSTFEQPHTVQSRAPSVDTTSSSHSFSARNIPANVSMQQQMGRRGSIPVNPSTFSASSPPSGSMLASPYNGYQNDAASFAHSKLPSSANPNTPFNSTATVDVGAAGSHFPYPQPSNLDAINAKTYFQSSSNSPAPYVYRNNLPPSATSFQPSSSRSPSVDPNTVKSAQHIPRMSPSPSASALKTQSHVPSAKVPPTSKLNHAQLAMLKSQIVAYNCLNSPNGQVPPAVQQAIFGRVYGASNEVSPSMPFQQNVPQMSSVKKDTPTRDANMRTSKAPYIQNIPNQFQRRAYSATIPVKNESLAKPSVSPMPLQQSTGKTEVAKRAQFPTNVNYSSCVDPRTYVKTPIPFSKFSSSENLSLIPSLLPPSISWDDVFLSSEIAIACSIANRIDFLEKENRPKSVNKKILQQDKSKSMIELRCLRLLEKQRSLRETINSVIPHSDSLAAGNLRLMFRNVKRQTMQEANLVLALAEKQKTEHAMRQKEKLLTHLRSIMLHRKSIVTKVDKQNKAKTQRCKDIINFHAHLEKEEKKRIERSARQRLQALRADDEAAYLQLLDKAKDTRITHLLKQTDQYLENLTRAVRIQQSNIHSGNTSGKGSNSAELEAPISEEDKNLDYFKVAHRIHEEVEQPKIFVGGTLKDYQLKGLEWMLSLYNNNLNGILADEMGLGKTIQTIAFITYLIEKKNQQGPFLIIVPLSTLTNWIMEFEKWAPSVKKIAYKGPPQLRKTLQSQIRSSNFNVLLTTFEYIIKDRPLLSRIKWVHMIIDEGHRIKNTQSKLTSTLSTYYHSQYRLILTGTPLQNNLPELWALLNFVLPKIFNSIKSFDEWFNTPFANTGGQDKIGLNEEEALLIIKRLHKVLRPFLFRRLKKDVEKELPDKVEKVIKCPLSGLQLKLYQQMKKHGMLFVDGEKGKTGIKGLQNTVMQLKKICNHPFIFEDVERAIDPSGTNVDLLWRAAGKFELLDRILPKLFLTGHKTLMFFQMTQIMTIMEDYLRSKNWKYLRLDGSTKSDDRCSLLAQFNDPKSDVYIFMLSTRAGGLGLNLQTADTVIIFDT

SEQ ID NO: 22782 - protein, 195 aa, Schizosaccharomyces pombe
  unsure (1)..(195): unsure at all Xaa locations
SNEEIERIRKRFIKIDANQSGSIDRNEFLSIPSVASNPLASRLFSVVDEDGGGDVDFQEFINSLSVFSVHGNKEEKLKCKLNQLVVPLQIMFXHYCFIXLAFKIYDIDRDGYISNGELYLVLKMMVGTNLREDQLQQVCYRQNLLSQNLTPIITRLVDKTIMEVDKDRDGKISFEEFKDIVSGSNVTSSMTLDSF

SEQ ID NO: 22783 - protein, 379 aa, Schizosaccharomyces pombe
MVADTKLYDCLEVRPEASEAELKKAYRKLALKYHPDKNPNGEKKFKEISLAYEVLSDPQRRKLYDQYGITEGNAAPPPPGAEGGPGAGFGGFPGAGPGGARTFHFNMGGPGGAQFFSASDPNDIFERVFGHAFAGGGGMGGGMGGMGGMDDDMDMDGGFGTRTRGGGMPGGFANMFGGGGAGPHARRSHPSFGGSRPSQPPAQNEVITRPLNVSLEDLFTGCTKKMKISRHIIDASGQSVKADRILEIKVKPGWKAGTKIKFAGEGDEKPDGTVQDIQFVLAEKPHPVFTRSGDDLRMQVELSLKEALLGFSKQISTIDGKKLKVSSSLPTQPGYEITYPGFGMPLPKNPSQRGNMIIECKVKFPTELTPAQKTAAEAF

SEQ ID NO: 22784 - protein, 139 aa, Schizosaccharomyces pombe
MVRFKSRYLLFEVLYPEAKEFFDYPTIPSDSSITTSSLSKIIRTMVAENFGDVGIGKVASSLTVKYFSPNTSTGILRVSRQHFRLAWAALVLIRELYGKPVIIRVVRVSGTIKKAELAAIERNKSEIHNISLMDEPIEV

SEQ ID NO: 22785 - protein, 1537 aa, Schizosaccharomyces pombe
  unsure (1)..(1537): unsure at all Xaa locations
VVAKCSQCWIPDEQSQWIPGSIKDCRVEGEKAFLTVQDENENVRKLLFSLVSLLGQLRLISXCDLVRETVITVKPDDLNYEGRNGLPFLRSINSDADDLTDLSYLNEPSVLDALSTRYNQLQIYTYSGIVLIAVNPFQRLPNLYTHEIVRAYSEKSRDELDPHLYAIAEDSYKCMNQEHKNQTIIISGESGAGKTVSARYIMRYFASVQALIQSTDSNFHEAPQLTAVENEILATNPIMEAFGNSKTSRNDNSSRFGKYIQILFDGNATIIGAKIQTYLLERSRLVFQPNQERNYHIFYQILAGSSSEQLEKWKLVENSQEFNYLKQGNCSTIEGVNDKEEFKATVDALKTVGIDNDTCECIFSLLAALLHIGNIEVKHSRNDAYIDSKNENLINATSLLGVDPSSLVKWLTKRKIKMASEGILKPLNEFQAVVARDSVAKFLYASLFDWLVATINKALMYSADKSNQTAKSFIGVLDIYGFEHFKKNSFEQFCINYANEKLQQEFYRHVFKLEQEEYAAEGLNWSYIDYQDNQQCISMIESRLGILSLLDEECRMPTNSDENWVSKLNDAFSKPEFKNSYQKSRFGNKEFTIKHYALDVVYCAEGFIDKNRDTISDELLELFTNSDVPFVKDLVLFRLEQTAPPADTKKIKTKPKSNTLGSMFKSSLVSLMSTINETNAHYIRCIKPNEEKEAWKFDNQMVVSQLRACGVLETIKISCAGFPSRWTFDEFVSRYYMLVPSAVRTTESLTFSKAILEKHADPTKYQIGKTKIFFRSGVTPLLESARDKALKHAAHLLYEAFAVNYYRTRFLLSRKRVRSFQAVAHGFLSRRHTEYELLSSNIIKLQSLWRTALKRKEFIQTKNSILKVQSIIRGFLLRQTLEEKTKHDATLIIQSLWLTFKAHKHYKELQYYAVRIQSLWRMKLAKRQLTELKIESTKASHLKQVSYRLESRLFEISKQLDNSEQENNKFRERIAELESHLSNYAEAKLAQERELEQTRVLISDQSQDGELKELLEEKENALIMMEEEMRQVNDANTELLRVNATLKSQLKNYDMIIVEQTSQLKEKNRIIASLTKATKILNSASSIEQSRNSEEKSRRDSSLMEMRTQKEMLVLLMNDGLKHDLDKLTEYAGRTFTTLKTLLLKDNDVEAQKLDHLFLAKLLFIIISQMWKSNLCQESVALVERYCVHTLEYVFQKTSSANERPDIGFWVANTHALLAFVYTKQQAFKHSSAFTLLSTESHESVQTIFEMIESHLSKIFFEWVRQVNNFLKPLIVQAMIITGTNTDAGDENRKLRIKFFEKPKYKITDVIHVLNKVHDSCQAYKVNYEIYNALIRSIYRFINVEAFNSLFIDERGSWKRGTNISYNYHVLKDWCLESGVPEAYLQLEELLQTSKILQFVKDDPNYVARVRDFYALNFLQIKTLLHRYDYADYEAHVPKKTMSELSKNIVAEGINQREQLTYEVLDYRLQDSFEESPSLEKIKIPDDCNVTYLRRIIDLASAEESVEQALITVGNVADNDVQNSSDEENQVPNGIKV

SEQ ID NO: 22786 - protein, 1955 aa, Schizosaccharomyces pombe
MSGNNENVSGITGHDAVSDDQYAYDSEVYDDQNAYQRQPADAYSNEEFLDQADYDSMYGEGYNGYDYPTGVTESYGDEYTPVDTASSGINQYSTEKGKFTRPSDEYESEYSDYNAQPSDANNFYNLRGDGRYNAYDPSSDSLANVYNSVPYGSSPYDFSNSSFVGNSGSGTPLDGDSGSFYADSANLTNREPYPAWTPENELPLTKEEIEDIFIDLTNKLGFQRDSMRNMYDFFMCLLDSRASRMTPDQALLTLHADYIGSDIANYKKWYFASQMDREDAVGLANVGIYGGKVTSIKEKGKFFSRNKKAPKVVKPPRKSRFKRKKKKEQPEEAEDEYIDVNTDDSLESAEYRWRSHMRSMTQFERAQQIALWLLLWGEANNVRFMPEVIAFLFKCAYDYIISPEAQNVTEPVPEGYYLDNIVSPLYQYMHDQQFEIINGKYVRRERPHDQLIGYDDINQLFWHAEGIARLIFEDGTRLIDIPASERFHRLPEVQWNRAFYKTYYESRSWFHLITNFNRIWVIHFGMFWYFTAFNSPTLYTKPFHQRDGPKPTGASQWAAVACTSVVSCIIMAAASLCEYLFVPRRFPGSKPIWKRLCIIVLIAIINLIPIVYIFGFSSKHQQRSGRRIAVGVVAFLMSIATYVYFSLVPLQSTFGKLSVKDSRKYLANKYFTSNFAPLKFDNQALSVIIWVCVFTCKFAESYFFLTLSIRDPIIVLSTMRPYLCSIYWAGSRLCFVQPRIILGIMYFTDLILFFLDTYLWYIIFNTIFSVLRSFVLGISILTPWRNIFSRMPQRIYGKILATNDMEIKYKPKILISQIWNAIVISMYREHLLSIDHVQRLLYHQVPAEEGRRTLRTPTFFVSQDDNIVHTTFFPANSEAERRLSFFAQSLATPIPEPVPVDNMPTFTVLIPHYAEKILLSLREIIREEDQLSRVTLLEYLKQLHPVEWDCFVKDTKILVEENAPYENDSVSEKEGTYKSKVDDLPFYCIGFKSAMPEYTLRTRIWASLRSQTLYRTISGFMNYSRAIKLLYRVENPEIVQMFGGNTDRLERELDRMARRKFKLVVSMQRYAKFTKEEYENAEFLLRAYPDLQIAYLDEDPPEEEGAEPQLFAALIDGHSEIMENERRRPKYRIRLSGNPILGDGKSDNQNMSLPFYRGEYIQLIDANQDNYLEECLKIRSVLAEFEEMETDNVNPYSESARERNKHPVAILGAREYIFSENIGILGDVAAGKEQTFGTLFSRTLAQIGGKLHYGHPDFLNGIFMTTRGGVSKAQKGLHVNEDIYAGMNAMLRGGRIKHCEYFQCGKGRDLGFGSILNFNTKVGTGMGEQMLSREYYYLGTQLQLDRFLSFYFAHPGFHLNNMFIMLSVQLFMVVLINLGAIYHVVTVCYYNGNQKLSYDTSIVPRGCYQLGPVLSWLKRCVISIFIVFWISFIPLTVHELIERGVWRATKRFFKQIGSFSPLFEVFTCQVYSQAITSDLAYGGARYIGTGRGFATARLPFSILYSRFAVPSIYIGARFLMMLLFGTMTVWVAHLIYWWVSIMALCVAPFLFNPHQFDWNDFFVDYREFIRWLSRGNSRSHANSWIGYCRLTRTRITGYKRRVLGQPSDKISMDTPRAKFTNVFFSDVLIPALLAAGAIIPYFFINSQPGNPMFITDPNNPSPYVHDTKTGTNPILRLVIISLIPIAAGFGMSGFFGGMACCLGPAFGLCCKKFPSIFAAIAHTIQIFIFIAIFEVCWFLDGWSLPKTVLAFCAVTAIHRFIFKILTLLCLSREVKQDSANISWWSGKWYGKGYGYHAFTLPAREFVCKAIELNLFATDFFLGHLLLFFMLPVICIPYIDRWHSVLLFWLRPSRQIRPPIFSTKQNRLRKRIVRRYSALYFSILVIFLILIIVPLAAGAEIRQGLTASEAVAKGAVGWNQTNSSIGSGIIQPRDTNYTANYSFWYDRYHFEFNTTY

SEQ ID NO: 22787 - protein, 537 aa, Schizosaccharomyces pombe
GLRAEIGAGFARMNCLTVIQASQGFAEYLLQTVPSAAKLGVVIGHDHRHKSNTFARLTAAVFLQKGFKTYFFDHLVHTPLVPFAVKTLGTAAGVMITASHNPAAYNGYKVYWGNGCAIIPPHDKGIAACIEKNLTPITWDKNLVENHKLADRDFAVGLLKNYWSQLHEFHSENNFSLEMKSLKFVYTPIHGVGLPFVTSALHLFGEQGDMISVPLQDSPNPDFPTVKFPNPEEEGALDLAYEQADANGISYVLATDPDADRFAFAEKINGAWRRFTGDEVGCILAYFIFQEYKNVGKPIDDFYVLSTTVSSAMVKSMAKVEGFHHVETLTGFKWLGNKALELEKQGKFIGLAYEEALGYMVGSIVRDKDGVNALITFLHLLKRLQLQNLSITEVFEQMSKKYGYYTTQNSYFLSRDTPKLRALVDALRHYDTKSGYPATLGSKKITNVRDLTTGYDSSSTDGKATLPVSKSSDNVTFELENGEVIMTIRTSGTEPKLKFYICARGHSLEDSIKNATEVKQAIKSEWFHPQQNGLEEP

SEQ ID NO: 22788 - protein, 250 aa, Schizosaccharomyces pombe
  unsure (1)..(250): unsure at all Xaa locations
MNHIFRRSIPITARLPSLGIRSLATATASAHPPVQLYGLDGMYCKRXFLIATILTDIFIVIQKSEFFVLVINSFLLFRSYASSLYTAAVKESKLDNVEKALNKLSGVLQQRPEFEQYISSPWLTREDKKILVSSLTQMTGNEPLLKNFYNVLLDNHRLYLLTRIQKQFSTLMRAKRGEIEVKITSATPLDSKILSRLESRIAKSKYGKGKLLVSNKVTPSIIGGLIVEIGDNILDVSVGSRLNNLNKLLS

SEQ ID NO: 22789 - protein, 829 aa, Schizosaccharomyces pombe
  unsure (1)..(829): unsure at all Xaa locations
MKTPKFITYVTRGFKGLESKSVENNKDHIVENSSPIASKFHEFDEQKKSFEIINYAGHEKFVDDITERESSVPGNAVYDITVRDIDAIVPVTDDVDIPASSKSKLILLFPFFFFFRSCHSGFPLLSLQPXYXLLTFFVAFRMWILAFGLATVIAGVDAFFLMRYPSVSIAAIVALLVAYPLGQLWYYIIPQWEIKLPRGIRVSLNPGRFNRKEHACLYIFVNICVSAKLVNTLIIEQIKFFGVNIGIGRAILFNLCSYLSSFGWSGLALPILVYPPTLIWPSVLSSCALFKIFHDNDNTKACNWTISRLRYFFIVFVASFIWYWFPDLIFPALSSLGAWISWCKPSSAVLSQIFGVKTGLGLFPLTLDWAQISSLSNPLITPWWATCCIFTSFVFWIWIVLPGLYYQNYWQVAHFPIMTNSIYTVSGKSYDAQKVVDSKWELVTQKYQEYSPVMLPIAFIINIALSLGAFSSMMISFFLRFPTDVIQPICHVFKYSDIHTKLLKKYKRVHWGFYLASIIVSLGLGFAFTEGWHDIQIRSYGFVVSMVIGAALYIPLSLIESRSSFTISMQAFFEIVAAFWFNGQPMALLYFYSFGFGTLQHAMHMTQSAKIGHYMKVPPRLVAALLFTSGIWSSLVNSAVTGWIMYHVRDVCTSNAENNMTCRSPKTQFNSHLIWGLVGNHIFSSDGRYSFVMWFFLVGAVVSVVVYLLQISFPKSSWKHVNPALLLGGAAQIPSVTGINYSTWAAVAFCFNYLIRRGYYSWWKKYNLITAAAMDCGVAIAGLFIYFCVVYTGGSSNFSWWGTTVSSAGCDKKGCAHLSVSDISKPSGW

SEQ ID NO: 22790 - protein, 384 aa, Schizosaccharomyces pombe
  unsure (1)..(384): unsure at all Xaa locations
MASKQRENVFPTRMTLECSXXVANFIRTLTTMKTRLKGAQTGHSLLKRKSEALKKRFREIVVNIEQVSAXIRLVILDIELFILNKNNRHMXFIKICSNSNFCXKMFPWHNRYLSVSWSFTNLLCIIGILGFYSLFRLGIFVRMNPLTNDILIGKQKMGRVMQIAAFSMAEVGFAMGNNINFEIQQSVKQPRLRVRSKQENISGVFLPTFEMNLDESIDDFQLTGLGKGGQQIQKARQVYEKAVETLVQLASYQSAFVLLGDVLQMTNRRVNSIEHIIIPRLENTIKYIESELEELEREDFTRLKKVQKTKENAEKADSVTKEEHQGGSNTLQQTKDVGGAIAPAAEVGKEVINEVENSKDDTYSLPSTSTDDEEENDSDEEVIF

SEQ ID NO: 22791 - protein, 698 aa, Schizosaccharomyces pombe
GKTSFLYSGCSKFGGRLFNNSIVHGWLRTRSYALASGLHPLRKQKLAHFEDLANANMSDPYMQAKLYKELADNFPEAIISRYETQGVARNSACDRYYQEALRKKSWSRSLSNNISLSQSSSSPATSSFSDPKAFSAGVPKFTSDTSSTVSSTPSLNHSLQNSMPPSTPTPPPVWAPTIVSSALGTSSKTPVYVVVDEPRFTKFFRIFKFIAGLSVASYFVLLGMSIFAETSGLNNIMTNTTEQEPMEERAINVRFSDVQGVDEAKEELEEIVDFLRDPTHFTRLGGKLPRGVLLTGPPGTGKTMLARAVAGEANVPFFFMSGSQFDEMYVGVGAKRVRELFAAARKQAPSIIFIDELDAIGQKRNARDAAHMRQTLNQLLVDLDGFSKNEDLAHPVVFIGATNFPESLDPALTRPGRFDRHIHVPLPDVRGRLAILLQHTRHVPLGKDVDLSIIARGTSGFAGADLANLINQAAVYASKNLSTAVSMRDLEWSKDRILMGAERKSAFITPENKLMTAYHEGGHALVALFTKNAMRPYKATIMPRGSSLGMTISLPDMDKDSWTREEYLAMLDVTMGGRAAEELLYGKDKITSGAHNDIDKATQVARRMVTEFGMSDRIGPVSLEAEMDNLSPATRALVESEIKSLLEASYERSLSLLKSHKKELDALATALVDYEFLTAEEMNRVVKGDRDLLRNKLS

SEQ ID NO: 22792 - protein, 537 aa, Schizosaccharomyces pombe
MEAAPSEKVPAKKLSSSENLDIGVSEVVTVDAAENNSNGIKRGLKTRHVSMMALAGIIGPGVFIGMGSALHIGGPVGLIVGFAIVSIVVFGVMLSIGEFNSLFDFNFNTHAARWVDPAFGAAIGWNYVIVWLTNIAAEYTSLTSILQYWGPHVPSYGFFLIFWGFFTCYQMLGVSVFGESEYILAFIKLLFITGFYIFAIIYAAGGIPHHKPPNLFKEMPLAHGFGGIVSAFVYAGVFFSGVESVSMTAAESKNPKKAIPLAVRQTFWRILYVYFGISISYGITVAWNDPNLSSGSKTLKSPMTIAIMNAGWNHAGDFVNAVILITCLSSINSGIYIGSRSLYNLAKDGMAPKIFKRVDKRGVPWVAVHSVHLFGFLSIMNYSTGAVKAYGYIINLAGVSAFIVWTAIIFVHFRFRRGWVKQGYALSDLPFKSPLYPFPQLIGFVIGIILTLVQGWTVFKPFAAGDFVDAYILLPLFFVIWLSYKFIKKTKWVSYEDMDFINGRRVIEPTYSNEQSSDKETEDGKKTSFWNRVWKEV

SEQ ID NO: 22793 - protein, 416 aa, Schizosaccharomyces pombe
MTVDLREEKELAQQRFKEICKHAKIVDTHNDFPYLLRVQLRNKLQLAEFDFENGLTSHTDLVKMRQGQVGVQFFSCFIECKNPNYLYQDFDTPTTVVRDTLEQIDVTRRLVCKYNNDLKFVDCADDAIAAFRNNGKIAIALGVEGLHQVDTSLAVLRQYYSLGVRYITLTHNCDNPFATAASSITGGLPDRGLSAYGIECIFEMNRLGMMVDLSHVSHRTMHDALDVTKAPVIFSHSSAYTLTEHERNVRDDVLERLKTNGGVVQVNFYQDFIRKPGSDRATIDDAADHILHIIKVAGWEHVGLGSDFDGIPQGPKGLEDVSKYPDLICKIIERTNATNEQIEGLMGLNVLRVWKKTELVALQLSKKLEPIESSWSGRKWEFYSYAKEFPELFPDAYKLNEKSTVWNYDQPLNIEK

SEQ ID NO: 22794 - protein, 335 aa, Schizosaccharomyces pombe
MGSLEVPCIDLSENDTSIVVKELLDACKNWGFVSLKNHGIPLDEIDRTFKLADKFFDIPVEEKQKYLFKGGRLHSGYTGHFGEKLDMEHQSRGDLKESYDLAGFPDPKLENLCPFIAEHMDEFLQFQRHCYKLTLRLLDFFAIGFGIPPDFFSKSHSSEEDVLRLLKYSIPEGVERREDDEDAGAHSDYGSITLLFQRDAAGLEIRPPNFVKDMDWIKVNVQPDVVLVSLFLTPYSNHLHRVNIADMLQFWTSGKLRSTVHRVRIDPGVKTRQTIAYFVTPDPETPLSPLFEEKTGKDIETVTAGEWIDGRINFTYGYSAPPKGYLGSQNDGIVA

SEQ ID NO: 22795 - protein, 1333 aa, Schizosaccharomyces pombe
MSYANYRYMKARAKRWRPENLDGIQTSDEHLINLFAKILSKHVPEIGKFDPNKDVESYISKLDQHFTEYPSLFPNEHTKRQYTLNHLEELEQQFAERMFSENGSLTWQELLRQTGKVQGSNKGDRLTKTFEGFRNQLDKVQFIRKLMSKANVDDFHTRLFILWMLPYSLRKLKERNYWKSEISEIYDFLEDKRTASYGKTHKRFQLQNKNLGKESLSKKNNTTNSRNLRKTNVSRIEYSSNKFLNHTRKRYEMVLQAELPDFKCSIPCLIDTGAQANIITEETVRAHKLPTRPWSKSVIYGGVYPNKINRKTIKLNISLNGISIKTEFLVVKKFSHPAAISFTTLYDNNIEISSSKHTLSQMNKVSNIVKEPELPDIYKEFKDITAETNTEKLPKPIKGLEFEVELTQENYRLPIRNYPLPPGKMQAMNDEINQGLKSGIIRESKAINACPVMFVPKKEGTLRMVVDYKPLNKYVKPNIYPLPLIEQLLAKIQGSTIFTKLDLKSAYHLIRVRKGDEHKLAFRCPRGVFEYLVMPYGISTAPAHFQYFINTILGEAKESHVVCYMDDILIHSKSESEHVKHVKDVLQKLKNANLIINQAKCEFHQSQVKFIGYHISEKGFTPCQENIDKVLQWKQPKNRKELRQFLGSVNYLRKFIPKTSQLTHPLNNLLKKDVRWKWTPTQTQAIENIKQCLVSPPVLRHFDFSKKILLETDASDVAVGAVLSQKHDDDKYYPVGYYSAKMSKAQLNYSVSDKKMLAIIKSLKHWRHYLESTIEPFKILTDHRNLIGRITNESEPENKRLARWQLFLQDFNFEINYRPGSANHIADALSRIVDETEPIPKDSEDNSINFVNQISITDDFKNQVVTEYTNDTKLLNLLNNEDKRVEENIQLKDGLLINSKDQILLPNDTQLTRTIIKKYHEEGKLIHPGIELLTNIILRRFTWKGIRKQIQEYVQNCHTCQINKSRNHKPYGPLQPIPPSERPWESLSMDFITALPESSGYNALFVVVDRFSKMAILVPCTKSITAEQTARMFDQRVIAYFGNPKEIIADNDHIFTSQTWKDFAHKYNFVMKFSLPYRPQTDGQTERTNQTVEKLLRCVCSTHPNTWVDHISLVQQSYNNAIHSATQMTPFEIVHRYSPALSPLELPSFSDKTDENSQETIQVFQTVKEHLNTNNIKMKKYFDMKIQEIEEFQPGDLVMVKRTKTGFLHKSNKLAPSFAGPFYVLQKSGPNNYELDLPDSIKHMFSSTFHVSHLEKYRHNSELNYATIDESDIGTILHILEHKNREQVLYLNVKYISNLNPSTIMSGWTTLATALQADKAIVNDYIKNNNLNI

SEQ ID NO: 22796 - protein, 464 aa, Schizosaccharomyces pombe
  unsure (1)..(464): unsure at all Xaa locations
MKETFQVGIIGFGDMGRLYAEYISKAGWRXVNNFCSTIYNXLSFSKCLXGLFLLAPSNIINRVNVCDRPENYESIQATYGNGGYTVLKDGFQVSRTSDYILYSVEAEHIDKVVALYGPATKVGAIVGGQTSCKAPEMNAFEKYLPEDVDIISCHSMHGPKVNPKSQPLVIIRHRASDEHFEIVNEILSCFKSSVVYLSAKEHDRITADTQAVTHAAFLTMGLAWHANNQYPWEINRWCGGIENIKMNLSMRIYSSKWHVYAGLAILNPEAQRQIQQYASSVTELFKLAISGKAKEYEDRIRNAGKFVFGENMDRNSSGLLLSDELLDQYSISNIPKDESKRNSHLSILAIVDSWSKLGIHPQNHMICSTPLFRLWVGVSEYVFRHPGLLDSCIYTATKHNDFSPDDLEFVVAVRSWSECVAAKDFTTYKKRFLETQEYFRPRFEEATRVGNAMISKLLENLQKM

SEQ ID NO: 22797 - protein, 979 aa, Schizosaccharomyces pombe
MDSLSESSTSSYHGKRPRSLSEESQSSSNMDDISQKSISLGDASEISKNLPSIAEQKQLIGELVNNQPELELGQVDNYILSYSWYERLCSYLAEDGPFPGPVDQEDIADLETGTLKPDLQEEIDFTIISRDVWDLLVRWYGLKGPEFPRETVNLGSESHPHLVVEVYPPIFSLTLLSTNAVDANESHKPKKISLSSKSTLEDLLEGVKYTLSLPSDQFRLWRVDTDQPLHRTIDPSSFIKINSKEIIDFLEKSKTLVELGMDSSCSLVAECMINETWPVDRALRLQFLIQQRNNQSSNEEQKQEKRVPGTCGLSNLGNTCYMNSALQCLTHTRELRDFFTSDEWKNQVNESNPLGMGGQVASIFASLIKSLYSPEHSSFAPRQFKATIGKFNHSFLGYGQQDSQEFLAFLLDGLHEDLNRIYQKPYTSKPDLYEVDEEKIKNTAEECWRLHKLRNDSLIVDLFQGMYRSTLVCPVCNTVSITFDPFMDLTLPLPVKQVWSHTVTFIPADTNLTPLAIEVVLESKAATIEDLVKYVAEKSGCSDYRKILVTETYKGRFYRFLTQLSKSLLMEISEEDEIYLYELERPYEDGSDDILVPVYHISDDSTNSANSYMSSRDFGHPFVLQLSDNEVTDASFISEKLKLKYQQFTTLKNLKNIDSLESLELGHEDEQVQKGPLDVDMDHSQTPLFEMRVFHDRFEKIPTGWNMSVSNLPLLTERDKKDLESTVDPLDAHSIEEEDDSEFKDVAPGSYPEPSKSNENTKLTAKENDRLLIQGDLLVCEWPEKSYQFVFSVAPSSPQMGRSLWLESKTILSDKKDDSEDSRTITLNDCLDEFEKTEQLGEEDPWYCPTCKEFRQASKQMEIWRCPEILIFHLKRFSSERRFRDKIDDLVEFPIDNLDMSMRTGSYKLSEKENPKLIYELYAVDNHYGGLGGGHYTAFAKNPDNGQFYCFDDSRVTPVCPEETVTSAAYLLFYRRKTS

SEQ ID NO: 22798 - protein, 595 aa, Schizosaccharomyces pombe
MEKSGGIREESSEKTFSDFNLDPRLQRAIHKCEFEKPTSVQSETIPLALEGKDLVAQARTGSGKTAAYLIPILELLLKQKQIDENQRGIFALLLVPTRELAQQVYNVLEKLTAFCSKHIRFINVATNSSDTVQRPLLLDLPDIVIATPSRCVVHVASGVLPLDKLKFLVIDEADLMLSFGYNEDMKTLSRSLPRGTQSFLMSATLSKNIASLQKLVCRNPFILAVKDKEASGKLTQYVVKCSEQDKFLLAYILLKLRLIKGKILIFVNEINRCYRLKLFLEQFGLKSLVLNSELPVNSRLHILEQYNKGLYQIIIATDESGMMGEIEELENNVDFVEEEVISTDQPTLDKMKDQENADVNDESILAAAKDKSKKKKRVKQDKEYGVARGLDFENVACVLNFDMPSNTKSYIHRIGRTARAGKPGTAMSFVVPKSEVGKHKPTSLESCKKDESVLRRLEKKQISLQPYSFDKNQIDAFRYRMEDALRAVTTVAVSAARAAELKQELLISEKLKSYFAENPDELLSLTHDTVSSVRLGHTQRHLRHVPEYLLPKGMQAVNKDIGFVPFKKNNRRKVFKSRKNPKHRHDPLRSMKRKS

SEQ ID NO: 22799 - protein, 492 aa, Schizosaccharomyces pombe
MRAFRLASGVLRNRKVILGIGAGSLITAGNIKIRNDSKFDAFFAKGFPDELQHRSLFSVLRSAFVYEICSRAWLVKLSLGAMSLCDVFHLSFLYNPFCRYTFYKHFCGGETPQAVMATMDTLQAAGITSCLNYSREVDLDGDMDVNKIASQGVVPPQVPVPSEKNQKVLRQIADKAFESNMHIIDMATYKPGTVCAVKLTPFINPLVLQRYNSILNQYPVESACNYLEHLKSPELSTYEVSELKKFWEYADKLCQFAKEKQIPLFIDAEQTYFQDCMHAVTVDLMRKYNKEVAIVHNTYQLYLKKSRKIMDDHIKKCVAEGWLMGAKLVRGAYLNSEPRFLIHDTKAETDKDFDSAVEAIIAAAAKFAPGDPASASDPIASRKGKWGIMVASHNKKTMFESVNLAETKKVDFTKTSFYLAQLLGMADDITYALAYSQRNQQPNFCIVKYVSCGPISEVLPYLVRRARENIDALDRCKEERAYYRQALRRRIF

SEQ ID NO: 22800 - protein, 259 aa, Schizosaccharomyces pombe
  unsure (1)..(259): unsure at all Xaa locations
MSKQNRGRLIVIEGLDRSGKSTQCQLLVDKLISQHEKAELFKFPGKSYFCFLADXLVTFTRXDRTTAIGKKIDDYLKESVQLNDQVIHLLFSANRWETIQYIYEQINKGVTCILDRYAFSGIAFSAAKVILSPLGXFVNYRRLRIXTLXTIYEVTNIKXGLDWEWCKSPDRGLPRPDLVIFLNVDPRIAATRGQYGEERYEKIEMQEKVLKNFQRLQKEFREEGLEFITLDASSSLEDVHSQIVDLVSNVNIHETLDVL

SEQ ID NO: 22801 - protein, 348 aa, Schizosaccharomyces pombe
RIDEVEPSEKEDNVERQTKKYNFEIDEPEEQEKKDEKEDDKEESPSKSLEEISQSVSPVEEEPRDVRFKELSTPFSYPINDPPEGRPVRVYADGVFDLFHIGHMRQLEQAKKVFPNVHLIVGLPNDQLTHRLKGLTVMNDKERAEALRHCKWVDEVLENAPWVITPEFLEEHKIDFVAHDDIPYASDDSGDIYLPVKKVGKFIPTKRTEGVSTSDLITRIIRDYDQYVMRNLARGVNRKELNVSLFKKNELDLRHHIKVLRDTLRNHWVSTTRDLKADIKSFLSMATTDYQLQKNPLHGSSEPSSPGPTGFLGGINRWMQRRSSSHYDLPRVGNEIAASSSSATEENH

SEQ ID NO: 22802 - protein, 512 aa, Schizosaccharomyces pombe
MSFTTLYSAIQGDASARALVAPSLNAELSFSELRIAIMDLQRQIASLGIKVGDPVNIAIPNGLEFVVAFYAVSWQRAICGPLNSNYKQSEFEFYIDDLKSKLVIVPEGSVAANTPAVRAAKKLSVAVAELAWCPKSRLVRIVHFEGAKINAPQPLGLPQPDDVMLVLHTSGTTGRPKVVPLTHKNLCRSIHNITTSYRLDPRDTSYVVMPLFHVHGLLCGLLSTLASGGCAVVPPKFSAHSFWKEFIQYGATWYTAVPTIHQILLRTPPPKPLPRIRFIRSCSSPLAPPVLSKLEATFRAPVLEAYAMTEASHQMTTNPLPPLVHKPHSVGKPFGVELKILDQKGNEMPQGKEGEICVRGINVTKGYLNNPAANKSSFTKDRFFRTGDEGKLDKDGYVFITGRIKELVNRGGEKISPAEIDAVLMQHPDVSEAVCFAVPDEKYGQDIQAAINPVAGKTVTPKQLHDYLEQKVAAFKIPKKFYFTDRIPKTATGKVQRRLVCDAFFNHSKAKL

SEQ ID NO: 22803 - protein, 345 aa, Schizosaccharomyces pombe
GTVGQRFITLLSDHPEFKIAVLGASARSAGKPYAVATKWKQSIAMPKEISQMSVKACDPKEFSECDIVFSGLDADFAGEIEKSFRDANLVIVSNAKNYRREPTVPLVVPTVNTDHLDVIKYQRQENKLDRGCIITNSNCSTAAVVVPLKALQDAFGPIAQTNVVSMQAISGAGYPGVSSLDILDNIVPFIGGEEEKIEWETRKILGSVNSTISGYELTDNVVSAQCNRVPVIDGHLMCISVKFAKTSPTPDQVREVLANYVSEPQKLGCYSAPKQAIYVFDDSTPDRPQPRLDRNNENGYAVSVGRIRSDSIFDIKFVSLVHNTVLGAAGAGILNAEVAVKKGLM

SEQ ID NO: 22804 - protein, 472 aa, Schizosaccharomyces pombe
MIAATPAKSKPSDVNLEQTFKGVSETSKIDLRRSRAAYRPLELSPTPSIFARNYQRNAVDFTGFFVLFWVAVSIMIFMSFLENFELTGRPVVGTIFKYFQSNLLDLAKADLAMSSMFLLAFPFQKIFALGYLRWYGLGVYLYSILILLFLSHCVLRCCLSNWSWTHRAMFILHSMVILMKLHSYNVVNGWYSYCYHSLNKLQSKKTDLDDDERSSVEFYEHCLNHHGNTYPENLTIPNALDFLFMPSLCYQLYYPRTAHVRIHYLIECALGTFGCIFLLVIISDHFMVPVLAKAIRTIIEAPEDASATYFAIRLGHTVAFLMFPFMLSFLLVFWVIFEGVCNFSAEITRFADRNFYDDWWNCWTWDQFARTWNKPVHYFLLRHVYVPLNSFMSKSLSTFFTFFVSSVLHELVMGCITLKIRGYGLFFQMTQIPYIIIQRQKFVRRHRLLGNIAFWFSIIIGIALIAALYILF

SEQ ID NO: 22805 - protein, 931 aa, Schizosaccharomyces pombe
  unsure (1)..(931): unsure at all Xaa locations
VTGETLVDSQKSLINNDTLLNEKLKEDFEENVSIGTCRCDHLVXKLLMTGLFTFMLLTGHDVKIHEELRRALPDYEESGFQRFTWHIKSWHELDRRAVSPQFAVGSRQFKITYFPQGTLQSAGFTSIFLEYIPSEEEKLSNKYGCCCQFAFVISNPRKPSLSVANSAHCRFSPEIVDWGFTQFAELKKLLCRQAPDVPPIVEDGALLLTAYVRILKDPTGVLWHSFNDYDSKIATGYVGLKNQGATCYMNSLLQSLYIIHAFRRIVYQIPTDSPQGKDSIAYALQRCFYNLQFMNEPVSTTELTKSFGWDSLDSFMQHDVQEFNRVLQDNLERSMRDTKVENALTNLFVGKMKSYIACVNVNFESARSEDYWDIQLNVKGMKNLEDSFRSYIQVETLEGDNCYFADTYGFQEAKKGVIFESFPPILHLQLKRFEYDFERDMMIKINDRYEFPLEFDAKAFLSPEADQSQNCEYVLYGVLVHSGDLHNGHYYALLKTEKDGPWYKYDDTRVTRATLREVLEENYGGDYIMHPPFRSPVKLKRFMSAYMLLYLRKDKLDELMNPVSADEIPEHLKEALNPSIQLAELRRKERLESHLYTKVQLITPEFYSEHHEFDIADFGNAYKEETIPQFRIKKEAKFSEFIPIVAEKLGYPQECMRFWYVVKRHNCTVRVESPVNELNSTMEEVKNVWNSQGEILRLYLEITPENELSSSLTHQNTGEWNAFIFVKYFDRKSQEISGCGTLHVNKSDEIRSICPLLCERANLPKNTPLNIYEEIKPGMVDFLRLEKTFTQSELSTGDIICFEPCRPSALEDDIVNSGFDSALKLYDFLSNKVLVLFRPRFIDQDSIIEFEMLLDRRIKYDDLCIELGQKLGIGADHIRLTTCNPLTYSAGMVVPNDSNITLYEILYSSEEEMPSNVIFYETMDVSFQTWI

SEQ ID NO: 22806 - protein, 609 aa, Schizosaccharomyces pombe; identical to SEQ ID NO: 22725

SEQ ID NO: 22807 - protein, 520 aa, Schizosaccharomyces pombe; identical to SEQ ID NO: 22726

SEQ ID NO: 22808 - protein, 401 aa, Schizosaccharomyces pombe; identical to SEQ ID NO: 22727
  unsure (1)..(401): unsure at all Xaa locations

SEQ ID NO: 22809 - protein, 461 aa, Schizosaccharomyces pombe
  unsure (1)..(461): unsure at all Xaa locations
STMATQDADIIIIGAGITGCALGAALGRQGRKVLVLERDMSEPDRIVGELLQPGGIEALEKIGIADAVEGIDGQWTSGYQIFYGDSNVSVPYPSKPNGGAYQGIGFHYGRFVMNLRKALTSTPNVTVTEATVNELLRDETGEVITGVVTSSKKSESPVEYKAPLTIVCDGCFSKFRKAFIDHPIQVTDHFLGLILTNPDYIAPGRGHVILSKVAPMVLYPISSTEARILINYPGKNLPPMETLKKYVLESCVPNMPEKLRPSLKAAVYNDRLRSMPNQFLPPTVNRTKGMILVGDSNNMRHPLTGGGMTVCFHDAYLLSRFISPSAVPDLLDYERILNQMNKFHWKRKGYSFVINVLSIALYKLFTPKNRYMKALESGCIDYFKRGGNCVEGPIRLLGGLDHSPSHLIGHFYAVCLYGIYQYVLSGPALLMPVRIIESLLIFLQASLVIIPYILSEMSSXV

SEQ ID NO: 22810 - protein, 1462 aa, Schizosaccharomyces pombe
MEVPRASPNQEPLCSISPSSLVINEIITVVTAIRKTTRWRNSGVASILGVSTLKDEFLADGLESRWKTNGEKSSSIRYPLVMEFSQLKEDLTNRASLNGYDSLKLLSPFLRTIKSPRMTGYITSLCLSAILKFFSFRIISEESPNLALSMRNLSFAITQCRFESFDASQDEAVLLRVSRLMEELLRGPGKAVLSDDSICEIVETGLSMCCQSRLSQVLRYSAELSMTSILEKIFERLKYIDVKTDSEDFWDASEEHSIKGEEFHYKKITEGDEISNEIDPFGIGSIREVFRVLVSFIDFGKQKFSDNIKAMALRFINTALEVSGSHISDFPSLRVLITDTLCKSLLQLIRSDHTALLTNSLLVMTTLLQAMPGSLKLQQELFISYLISCLHIPSTTPRERNVETSLHKVVSSLDLSEEISPDRATPTSFTERKRFAFDTRNRPPEVRELIVECLGSLSRIPYFLIDLYVNYDCDPQMSDLAIDLLKVLTRNCLVDSARYSTANVPPLCLDALLNFIYYFHEHLQPCYNDPNNTFKDDVAKTLIESKKRKAIIIEGAELFNESPSDGIAFLTQHSIIKQSDNPTCIVEFFHSTNRLSKRVLGEFLTKGSNSHILNAFISAFDFKGKRIDEALRLLLQSFRLPGESQLIERVLETFSHYYMSANPDSMSSKDAAFVLSYSIIMLNTDQHNPNIKSQRRMTLDDFCRNVRGVNDGQDFDRNFLSEIYKAIKENEIIVAEEHDTELSFLYIWSKLQQSVKITEPFKRSSSNVHDKIVFLEVWKSIMAALIYVFSTATEDTVFYRVVNGIQQATEVAAAYELNEPVDYAIERFCQFTALDPSSVPGTQLNTAIKVEDRIITVSELSVRFGRDFRAQLALLVLFWISSKFGNIIDASWPLLVQLTICLARNNLIDNSFLPGFKLFGYQWFPFPEPPLNSGKPALSKEGGLLSALSSYLSSYANDEPPCPTDEEIQHTLCTIDCISSAKIDNFLTKLVDLKQPGLNKLLDSLLSLSNPSTSLLTDENTVDDNKVSSVEALSNIQSAIVADLLTSLFLGTRESLNKLERRTQILSYLLFQIEQSGDEKVINQLSLYIFEMFMDDDLKLSENSEDWGLFSKLCNLLNDKNIVVRNQSLSLFHQLVNKYPFLLESWIGLQLVQSAVNTNTADIDDLYRLLSKIPTNLLDLPMFQVYLGCVDTLIQTIVKQIAQILSKQKKGASKGLPFDKSILDNHSAELNDAFNLFLKAAVEYKVDSNESSEHFQDTRWKIIYDHVCKLCLSRSRSLRAASLSCLQRIVVEQLDQPHEVSYTMALFHLVLLPTMENMITVLTEKPEHKIFGLAQAQMFNIICKTVLIDMNVLSAQKEMLHTLWLKLMDVAIKLSSIHGSESMAEVMESIKNVFMILHGAGALAGPTIEVDPEIPDHLIKTWNTTWNNLFIYYPELSNDLNINNEAEMKKENLKNPSQTTTV

SEQ ID NO: 22811 - protein, 892 aa, Schizosaccharomyces pombe
MSSLASQGNNASTPAYRYGFQTSEVGDRPTVSMPSQPESSAMLEDDGMVKRKPFAAIGEAIPKVIDTTGESVREAFEEFLLSFSDDRVAGGDALPSASQEKYYVQQIHGLAMYEIHTVYVDYKHLTSYNDVLALAIVEQYYRFSPFLLRALQKLIEKFEPEYYRSSLSRENASLSPNFKASDKTFALAFYNLPFRSTIRDLRTDRIGRLTTITGTVTRTSEVRPELAQGTFICEECHTVVSNVEQAFRYTEPTQCPNELCANKRSWRLNISQSSFQDWQKVRIQENSNEIPTGSMPRTLDVILRGDIVERAKAGDKCAFTGILIAVPDVSQLGIPGVKPEAYRDSRNFGGRDADGVTGLKSLGVRDLTYKLSFLACMVQPDDANDKSGADVRGDGSQGIEEQDEFLQSLSQEEIDDLRAMVHSDHIYSRLTNSLAPSVYGHEIIKKGILLQLMGGVHKLTPEGINLRGDLNICIVGDPSTSKSQFLKYVCNFLPRAIYTSGKASSAAGLTAAVVKDEETGDFTIEAGALMLADNGICAIDEFDKMDLSDQVAIHEAMEQQTISIAKAGIQATLNARTSILAAANPIGGRYNRKTTLRNNINMSAPIMSRFDLFFVVLDECNESVDRHLAKHIVDIHRLRDDAMQPEFSTEQLQRYIRYARTFKPKLNTESCAEIVKKYKQLRMDDAQGAGKNSYRITVRQLESMIRLSEAIARANCVDDITPAFVNEAYSLLRQSIIHVERDDIEVEEDDAEAQELENDNTNTTNGNDNVSSEEALQKPKVKITYDKYVSIMNGILQVLRQRSTEGVDGVPAGDLVQSYLELREDQFHTEEDIIYEVGLVRKVLTRLVHESIIMEIQNLTDSAVRLPFEERVFSIHPNCDIDALLSNGDVPN

SEQ ID NO: 22812 - protein, 184 aa, Schizosaccharomyces pombe
MSSPRRRIETDVMKLLMSDYEVTLVNDNMQEFYVRFHGPSETPYSGGIWKVHVELPSEYPWKSPSIGFVNRIFHPNIDELSGSVCLDVINQTWSPMFDMINIFEVFLPQLLRYPNASDPLNGEAAALLLREPNTYYAKVRDYIARYANKEDADITLNDSSDDDTMSSIDTESGDEIAGPMDSDF

SEQ ID NO: 22813 - protein, 383 aa, Schizosaccharomyces pombe
MASSSNIKHRLWLDGCMDFFHYGRTFLSIISSISNHLTLYRHSNAILQAKQLGETLVIGIHSDEEITLNKGPPVMTLEERCLSANTCKWVDEVVPSAPYVFDLEWMRRYGCQYVVHGDDISTDANGDDCYRFAKAADQYLEVKRTEGVSTTELLDRLLSSVPLEIYSTPVSVLSSQIDLLRRFATDSDGLTPFTDVFIYNTEKPETLISGTTLLRLNPEKNIIYIDGDWDLFTEKHISALELCTRMFPGIPIMAGIFADEKCFEKPMLNLLERILNLLQCKYISSILVGPPPASLFASSKYIKLCFDEQISKVYYPIFSTDVSIPALDISLSNTPNNSFYKFDKLGSDLIKQRVMLRRQHYEERQRRKMGKNATEQTTIKTYA

SEQ ID NO: 22814 - protein, 395 aa, Schizosaccharomyces pombe
  unsure (1)..(395): unsure at all Xaa locations
MDIRPARISDLTGMQNCNLHNLPENYQLKYLXVQFIVILAARQXTSSIKTMILIFXFNVDLYHAISWPMLSYVATDPKGRVVGYVLAKMEEEPKDGIPHGHITSVSVMRSYRHLGLAKRLMVQSRKCXLRAKXITDISKEELEGNLKLFCSCYRXLFQYVYILFCARLGLLILXIVHLVSWFFPCNNSFFLPNLFSTMFPSCXFLDIFGPFLKQNFFKKSKRYXLLKXTERAMVEVYGAKYMSLHVRKSNRAAIHLYRDTLQFEYCFYSPSLKRFXHYFSVQGIESKYYADGEDAYAMQXVLCCKNXVGDGCMDRLMSILSKNYIQSLXQSFFLXFGQLLYNYLRCFRQYMTVQRHHNYLGYXQFLAKIFSTLKFDTPETNDELAKTVQSLALNN

SEQ ID NO: 22815 - protein, 662 aa, Schizosaccharomyces pombe; identical to SEQ ID NO: 22680

SEQ ID NO: 22816 - protein, 204 aa, Schizosaccharomyces pombe; identical to SEQ ID NO: 22681

SEQ ID NO: 22817 - protein, 421 aa, Schizosaccharomyces pombe
  unsure (1)..(421): unsure at all Xaa locations
MKNDLILRAAKGIILSLXQFVSAYSHYEIIGEEVERPPVWIMVCKKKDDYKFANVLLEASWKISSWYVHDLNLIVCTNETIEYHKLRAKQSFFEMCQTPETACELTLQPVTRFKGLLDAAIIFSDILVIPQALGMQVVMLEQKGPHFPKPLVVPEDIDLLEKTPNISAKLGYVMDAISLTREKLDGQVPLMGFSGAPWTIMAYMIEGGGSKTFAKAKSWLFRYPEASHKLLKIITDATVSYLIQQVYAGAQVXVNSDYFLYXFKXYILLQIFDSWAGELSPEDFTEYAYPYLVRICQEVKQHLKKKKRDEVPMIVFAKGAWYAIDQLCDSGYDVIGLDWTVSPKEAVRIRGNRRVTFQGNLDPNILYGTREIIEARTKEMIQDFGGGKQGYIINLGHGITPGVNPDDVRFFLEKCHQYGSA

SEQ ID NO: 22818 - protein, 116 aa, Schizosaccharomyces pombe
MKLAIGRLLSPLFLKNPQKPLIITKRFYSTPGERRIKDILTEKLSPSSLRVIDVSGGCGSMYQVAIKSKAFQGKNTLAQHRLVNSILKEEIRNMHGLNLSTEVEDDISAGGSTTSS

SEQ ID NO: 22819 - protein, 1167 aa, Schizosaccharomyces pombe
FSKLQDRSSLLGEKFTKVLVANRSEIAIRVFRTAHELSMHTVAIYSYEDRLSMHRQKADESYPIGKVGQYSPVGAYLAIDEIVSIAKRTGANLVHPGYGFLSENAEFARKVNEAGMQFVGPSPEVIDSLGDKTKARAIAIRCGVPVVPGTPGPVEHYEEAEAFVKEYGLPVIIKAAMGGGGRGMRVVRSADTLKESFERARSEALASFGDGTVFIERFLDKPKHIEIQLMADKAGNVIHLHERDCSVQRRHQKVVEIAPAKDLDPKIRQALYDDAIKIAKEVKYCNAGTAEFLLDQKGRHYFIEINPRIQVEHTITEEITGVDIVSAQLHVAAGFTLPEIGLTQDKISTRGFAIQCRVTTEDPNNGFAPDIGKIEVYRSAGGNGVRLDGANGFAGSVITPHYDSMLVKCTCHDATYEYTRRKMIRSLIEFRVRGVKTNIPFVLRLLMHDTFIQGNCWTTFIDDTPELFQLYRSRNRAQKLLAYLGDLAVNGSSIKGQNGEPALKSEIVMPVLLDSTGNQIDVSHPSEKGWRKLLLDNGPAAFAKAVRNHKRGLIMDTTWRDAHQSLLATRVRTIDLVNIAPYTSHALASAYSLEMWGGATFDVSMRFLHECPWDRLRRLRKLVPNIPFQMLLRGANGLCYSSLPDNVIYFFCEQAKKNGIDIFRVFDALNDVNNLSLGIDAAKRAGGVVEATMCYSGDMLNPKKKYNLDYYVNLVDKMVEMGIHILGIKDMAGVMKPKAARLLISAIREKHPELPIHVHTHDSAGTAVASMAAALEAGADVVDVATDSMSGLTSQPSFGAVLASVDGTDKQLEFDNNQLREIDSYWAQMRLLYSPFESEIKGTDSDVYNHEIPGGQLTNLKFQATSLGLGTQWAETKKAYIEANKLLGDIIKVTPTSKVVGDLAQFMVQNKLSAEDVENRATTLDFPASVLDFFQGLMGQPYGGFPEPLRTNVLKGRRQPLTDRPGKFLPAADFDAIRKLLSEKFGVSSDCDIAAYTQFPGVFEEYRQFVDRYGDLTTVPTKFFLSRPEMNEEMHVEIDQGKTLIVKFVALGPLNPRTGQREVYFELNGENRHVTVEDKKAAIETVTRPRADPGNPGHVAAPMSGTIVEIRVKEGAKVKKGDIIAVLSAMKMEIVISAPHSGVLKSLAVVQGDSVNGGDLCAVLEHE

SEQ ID NO: 22820 - protein, 446 aa, Schizosaccharomyces pombe [sequence omitted]

SEQ ID NO: 22821 - protein, 734 aa, Schizosaccharomyces pombe; identical to SEQ ID NO: 2486

SEQ ID NO: 22822 - protein, 310 aa, Aeropyrum pernix
MLEHLVQAVAVGHALVDLRLYVERIPGVDEEAVIKDETRSVGGSAANVAVVLRRLGVQSGIIGKIGLDDFGRIAVDNLMREGVDISGLRVSLRDRTGFSVVVRDKEGSITIYSFKGAAEKLEPGEIDADAIGRSKHVHVASLRPDTTLKTVEIAKKRSITVSWDPGRVLSKMGAERLANIISKVDIIFVNRNEAKNLTGYHDYRQAARHLKKLGPKIVVIKLGASGSYILYSDGEVFVPAIKPERVVDTTGAGDSYAAGFIAGLLRGYTIEKASLYATIVASIKVSRLGSNAAPSHEEVVEKARELGVEI

SEQ ID NO: 22823 - protein, 513 aa, Aeropyrum pernix
MRTGGLLVGGCDSILSIDIGTTRIKAGLVDCNTLEITGRGSVSTPVSYPRKGWSEQDPEELWQAIVRASSAALEGFEASRVSGVIFSTYLAGVVLLDRDNYELTPIITWLDERAHGLPRELFSGVLKVSGYNLLHLVDLLRLTGGAPSKTGKDPLSKMVWLRENKPDLFTKAHTIGTLKTWVLAKTAEARLVSPDDAHLTWLADTRGGRAVWSPRLARRYGIPLEKLPGIAGPTDVAGGLVSSAARDLGLPQGIPVIVGAGDIASSAVGSGALAAGEYHIYVGTSSWIGVHSTRRLLDVRHYIGSLLSAKPGEYLVIGEQEIAGGMIDWILDVTGMDYRAVEDIHSIPPGSEGLIATPWLYGERTPIDDPHAKGVLVGLTLRHTKKHLVRAAVEGVALNIAWAMEHMTRLAGKPKLVRGVGGGFRLRTLAKVIASALNATIETVSQPEMAGVRGAGALAAAALKGSSIESEAGKIPVSWRAEADSNASKAYKDLLQIYQEIYSRLKSVFRRLS

SEQ ID NO: 22824 - protein, 253 aa, Aeropyrum pernix
MLPLGQAPVIYEERNGVAIIRLNRPEKLNALNLEAWMQLGEYLRKACRSGIKAVVITGSGRAFSSGDDIRSMYSLESLEDSLSFFKTLHGALEAMARCRRPIVAAVNGLAVGGGAEILLLADVVLASREAWFAFPESHIGLIPPLLSTLGRSVFGERKARMLGITGAKLDVEEAKAMGLVDDVVEPGELEAKALEVAESLGLIPDQSVAEIRRATVEPYRVELENMVNRLAELVLTKEAKERMRLFLERRKKE

SEQ ID NO: 22825 - protein, 919 aa, Aeropyrum pernix
MYVLKRLELRNIMSHFNTSIDFREGFTAIVGRNGAGKSTILEAILFSITPHQAPRRSSMISENSSRGEIYLALQSSEGRLLELRNKLIRRGGGTNTEAAIITLEGRRIASKPTGYKEEIHKILGLRGLPNPASYIEKAIIISQGGLQTLAEILSEPKELRDLLDAALGYALLKQAISNIGDVVLGVSPDGSPVKLGSKSITRLQSGYMTLRNEVLGVDREIREASKRLEELEREREELERRARDLESEAKALQSEIGKLETMEEMLVNVTSMIRSERSKLDTINTRLRYAESKISSIDDLEKRRAELRAKASLAHEVAELARLQSRLDKLGRDLEMIRDAVEKLEVSRRLKEIESARREAENRLLEARSSIKEEQRRYTLLDYRVTRGRSIVTNIRRVLSECRSKDLCGSEKPESVLERLDAVINDLESKARALDQEASALEAEARRLVQALSMLEESGGSARCPVCGAELPPGRAEAIARHYRHEAERLRKAAKEKAAEAEKARAEASRLQDKRRRIELLLSRLNQLEEGLRELGFQTPEDLAKAEQKLRMLRERLEELRKLENSLEEKVRNLSREEVALREAKTRALEVLQRLGIKEEEAREKLKTLSSESKKLERMLVSKAEDLATRLGITAYRSLDDLLEKAREALEGVDKELSAIERRLEEARRLKEEAAKLKWEAEQVMKRLEELEAEEKKLRKEVSRKSEIEARLKEVQNTLAELDDRISRIDREMGELQTRIREMKSRKASGEEALKLYLPAAASRRIMEEIGEIAYRRLLAVLEDEMNDILSRFNLDVAGVEIREKAAREIEVKAIGGNGAYRPLEAVSGGERTVLALSFVLALNKAVGGKLGFLALDEPTANLDEDRRRSLVEVLRGISVEGLVRQLVVVTHHEDVRDYADTICLVTRTQQGSRVECTY

SEQ ID NO: 22826 - protein, 401 aa, Aeropyrum pernix
MICLPRYWTLRRFSPLLIVTSPSETGLELALQDIILINQEPFTLYKNGGLVLGVNLRELIPPEARREVELRALSGYVLALDAYNMLYQFLTAIRQPDGTPLLDREGRVTSHLSGLFYRTINLVEEGIKPVYVFDGKPPEMKSREVEERLRRKAEAEARYRRAVEAGEVEEARKYAMMAARLTSDMVEESKELLDAMGMPWVQAPAEGEAQAAYMARKGDAWATGSQDYDSLLFGSPRLVRNLAITGRRKLPGRDQYVEIKPEIIELEPLLSKLGITREQLIAVGILLGTDYNPGGVRGYGPKTALRLVKSLGDPMKVLASVPRGEYDPDYLRKVYEYFLNPPVTDDYKIEFRKPDQDKVREILVERHDFNPERVERALERLGKAYREKLRGRQSRLDMWFG

SEQ ID NO: 22827 - protein, 319 aa, Aeropyrum pernix
MGEDKREIKDITDLPGVGPTTAQKLMEAGYTTLEAIAAATPQEVSQATGIPILTAQKIVDAAREALNIDFKTAYDLKIESMNIKKITTGSRNLDELLGGGIETKTITELFGEFGSGKTQICHQLSVNVQLPEDKGGLEGKAVYVDTEGTFRWERIEQMARGVGLDPDEVMKNIYWIRAINSHHQIAIVDKLFTMVKNDNIKLVVVDSVTSHFRAEFPGRENLAMRQQLLNRHLHQLMRLADIFNVAVVITNQVMARPDVFYGDPTQAVGGHVLGHAPGVRVYLKKSRGNKRIARVVDAPHLPEGETVFAITEWGIRDPE

SEQ ID NO: 22828 - protein, 266 aa, Aeropyrum pernix
MLGVGKIGGAIVKSLLSCGAVVTGTGRRRETLERISRLGAEATVDNRLAAKVSDVVILSVKPYQLPRLLEEIRDVMEGKIVVSVVAGVRLSTLSRALEGSHVYRAMPNINALIGRSTTAVAEYTGDKRASFVESILSCMGSVYWIPEEWMDVWTALVGSMPAYVAVMIDSLTLGGVSAGLPREVAFKAVIDTLGATAEHLGKRDIHPSVLRDEVTTPAGTTIEGLKVIEGEGVDAALIRTVEAAARRAAAIGEAIDNEVRRSLNLR

SEQ ID NO: 22829 - protein, 263 aa, Aeropyrum pernix
MSSEATLDSEFTDYKAMFRYEAKVFKELVDSVSKILDEGLFIITGEGLRLRGMDPARVALVDIEIPSSSFFDFYMAGDVERVELGVNMETLKGVVARAKKGDQLEVRVREDKVLFIVESVVLRRYLLPNLEVIVDVPEDISLEFDATATVIADVVKKTLRDVELVGDIVEFDAGEDYLSIRSVGPERRRVETRLTRESPALIDLEVKEPATSRYDVGYLKRMLGVAKIAESIELSFSTDKPLKMVFKSPDGSRVTYLLAPSTG

SEQ ID NO: 22830 - protein, 346 aa, Aeropyrum pernix
MSLMSVVKVGVNGFGTIGRRVALAITLQKDMKLVGVVKRTPDYAALYAASRGIPIYTPTAKEAEEFEKRGIKVGGTLRELLARVDVVVDATPEGQGAKNKPLYREAGVKQVYQGGEKPEVAEASFSTLCNYEESKGRGSLRVVSCNTTGLLRLICTLNREFGVESVRAVLVRRGADPKEVKKGPIDSIVLNPPTLPSHHAVDVRTVLPWLDIKTAAVAVPTTFMHMHHVTLKLAKPVEKREVLETLASAPRIMLVSSGDTGIKSTSQLVDAARLSRMGYDIPELVVFEESVAVDGREVMLFQAVHQESIVVPENIDAIRAVASSPLTLDETLKATDGSLGLRKTLW

SEQ ID NO: 22831 - protein, 410 aa, Aeropyrum pernix
MGGRLATLDDVDVRGKKVIVRFDLNSPVGNGGEILDDSRIAEAAGTLRELCDRGAAVVALSHQGRPLESDFVSLERHASLLSRYSGVEVRFVMDVIGPEALRTVASLRPGEAVLLDNTRIISEDFIEAEGTVHARGIMVTRLSKLANMYVNEAFSASHRSQASIVGFPYVLPSAGGRVLEKEIRSLNRAVSSGERPKVVVLGGAKLKDAVRIVDYLSSSGVADEVLTTGLVGLLFLYARGYRLPRDVTKLLEKKGGEEAIAKARRIVEEGRRVRTPIDFVVEVGDKIYIKPADELTEGVPKDIGPSTVEYFRAKMRGARVIVMRGPAGVIEDPRFRRGTVELVKAALSSGAYTVFGGGHFRAILRDLPEHLSSKVGHLSTGGGALLYYLSGRPLPGVKALVDSARIFNLV

SEQ ID NO: 22832 - protein, 699 aa, Aeropyrum pernix
MNVAEEMLSGEETLAVGERFKTFLENFRTEEGKLKYVEAIRRMINYEETSLEVEFKDLYRYDPLLSEILLEKPREFLKEASEALKEIVAQESPEYAQGRVFTPRFTGLFDTERIRDIGSDHVGKLVQINGIVTRMHPRATRMVRARFRHDRCGAEFWWPANEDEVLGERIERPSICPVCGEGGGKFTLVRDKSLYIDWQKIMVQERPEDVPGGQIPRSIEVHLSRDLVEKVRPGDRVKIVGVVGLQSFSSSSTLYSLYMEANSILLEEKILEEVSITREDEEKILQLSRDPWIKEKIIASIAPTIYGHWDLKEAIALLLFGGVPKQRPDGTRTRGDIHVLFVGDPGVAKSQLLQSTAQVAPRVVYTTGKGSTAAGLTAAVLRDPRTGEYFLEAGALVLADGGIAVIDEFDKMSKEDRGVIHEAMEQQTVSIAKAGIKATLSARASLLAAGNPKFGYYDPSRSFVDNVDLPAPIISRFDLIFVVRDVIERSRDEMLASYVLETHTNVELFKPEIDPDLLRKYIAFARKHVKPRLTPQAKKLLKDFYVEMRSSALHHSSQEGAKPVPITTRQLEALIRLTEAHARMSLKQEATEEDAIAAIRIMTSVLQSIGLDLETGEIDIGIIMTGASFRSRKIMSEVLDLIKSIVEEERGGQGCVRASEIVRRLGEKNIPEEKVRDAIDKLYRQGLIIEIRTECYKAV

SEQ ID NO: 22833 - protein, 255 aa, Aeropyrum pernix
MVYTLLSTPRTALILAGGKGRRFRPYTDLIPKPMIPLGRSEKPLLEYVVKMLALQGVENIVLLVGYKWRYIYNYFGRGEKLGVKIDYSIDDERYSGTGGSVLKALEEGRVSDEDFLVWYGDIIAEVGLASMYSLHRQHDASATLAVAERYQVPVGVVKAGREGVIEDVEEKPWIGVNVFIGVAIFRKEAFREAAEGLGTSFDIMGDMMPILVRKSKAVAYIYDGPWFDVGSLERYEKLREDVISRLERKLFPESI

SEQ ID NO: 22834 - protein, 309 aa, Aeropyrum pernix
MPPVYSQPELSISIAGLRLQRPVGNASGILGWEPREARLVEEGGGGFFVAKSVTYQPRKGYPQPHLYPVAGGIVNAVGLANPGFREASKMLAQTVEEASIPVIASIAGGAPGEWVEMASTLEEAGVSAVELNLSCPHFAGGGLELGQDPAAVASVVSAVASTLRIPVIAKLGYSDRLVDAASKALEAGARGLTLINSMRAMKIDVYAKKPVLGNRVGGLSGKPIHPIAVRAVYEVYGETRADIFAAGGVESWEDAVEFYLAGAKAVQVGAAFITIGPHVLRSIVEGVRRYLWVEGFRSLQDIVGYAHRA

SEQ ID NO: 22835 - protein, 215 aa, Aeropyrum pernix
MTARSYREVVSAVEEKVASLRGGRLFIFLGGDHSITYATLRALRSFYRGRLGLVYLDAHPDLYDEYEGDRYSHACTLRRIVEEGFVDPRDVILAGVRAATPSQLDFAEKAGITVLGVEEAEDLAAYLKEGMPYYISYDLDVLDPAYAPGVGNPEPGGLSTREMVRIIKSLPEDVLAFDVVEASPPHDPSGLTLFTAAKIIRETLARARPPGWGEV

SEQ ID NO: 22836 - protein, 469 aa, Aeropyrum pernix
MGGAGLSRRRLFGTDGVRGVIGSELTPEFVLRLARAIGAYFGRGSRILVGRDTRSGGELFEGLVAAGLAFEGVEVHLAGTLPTPALQLYVRDHGYDAGVMVTASHNPPEYNGIKVVGGDGVEVPRDVEEGIEALFWEGKFSTVEWRSVAGQPKRVHDAVDYYVNRVVENVSAFTQRGGGERVVVDCGGGATSFTTVEILKRLGARPIPLSCKPDPLFSSRDPEPTPDTLGPAASLVRSSGAVFGVGHDADGDRAIVIDDRGRVVWGDRSGALLAGFVAEVGLAKGPLKVYTGVSSSIVVEDYLRPRGIEVVWTPVGAPIIARAILTQGGIAAFEENGGYMHPPHQYVRDGGMKAALLLAMLRATGESLSSLLDRLPSYHPIKTKIPASREEALCAVEAVKQEFQGERMVTIDGVKVIGEGYWVLVRPSGTEPVVRIMLEARSEEEARALFERVLRAVKEKCGIPSGGRT

SEQ ID NO: 22837 - protein, 446 aa, Aeropyrum pernix
MAGDSSSDDIGGARIIEIYRRYGGKIEVMPKVPVSGVEDFAIWYTPGVAEASIRINKDPDESFELTSRWNMVAIVTDATRVLGLGKLLPEAAYPVMEGKALIFKLFGGVDAVPIVHRRREPGAFASLVKDLEPSFGGVNLEDIESPKCFYLLDFLRMELEIPVWHDDQQGTAAASLAGLINAFKIVGKNLRESRIVLLGAGAANIALYRFLKAYGVNPRNIVVVDSKGVLHPEREDMDRLLFSNRYKYEIALETEGGGLAPGSSLEEALRGADALVAASRPGPGVVKKEWIRGMSRDPIVFALANPTPEIWPWEARDAGARVVATGRSDLPNQVNNALVFPGVFRGALDVRSRAITDGMAIAAAEEIARYTEEEIGIEEDRILPPITDWQVHYRVAAAVAWAASREKVARKPRTYAEELENARAIIETTRRKYGALLSAGLIERLV

SEQ ID NO: 22838 - protein, 559 aa, Aeropyrum pernix
MKEFLALPEKTPWRPGYSLTIHKIYQYALYMWSDLEIVSRTTKGLERYTFSDAARRIESLANALRALGVSGLDRVATMDWNTHWHYETYFAAPMMGAVLHPLNVRLAPNEIAYIMNHAEDKVLIVHSDFLKLAEAILPHAPSVEHVVIVDAESHPDRIAGRRLHNYEDLIKEHGGRFEWPELDENRPAAMGYTSGTTGLPKGVYHSHRMIVVHALSGALALATRGRRRVTGDDTLLHIVPMFHVLAWGLPYMATLTGMKQVFPGRLDPKVLLDLIVGEKVTVTAGVPTILYMLLSHPESGKYDLSGLLFVNGGQALPKGLADAARKRGIEVIVGYGMTETAPILTLANVPQKYMDRSEELSLTTGWPVPLVELMVADPETLEPVPKDGKTMGEIVVRTPWVTPEYYKDPEKTEKAWRGGWFHTGDIAVWTPEGYIQIVDRDKDIIKSGGEWISSLRLESLISQHPGVAQVAVIGARHPKWGERPVAIIVPKPGWQDKLTTEEVREWLAKNFVEKGEIPKWWLPDKIVLVDDLPKTSVGKINKRSLREKFANILEQEPQQ

SEQ ID NO: 22839 - protein, 466 aa, Aeropyrum pernix
MVRVALGVREYRNISEIKGPLLVVEGVSRVAYDEIVEVETAAGEKRRGRVLEVGMGYAVVQVFEGTTGISPTGTVVRFMGRPLEIPVTEDMLGRIMNGLGEPIDGGPKIDADERRDVNGAPLNPAERAYPEDFIQTGVSAIDGMNTLVRGQKLPIFSGAGLPHNRLAAQIARQATVRGEEEEFAVVFSAIGIKYDDFLFFKKFFEETGALGRVAMFVNLADEPAMIRLITPRAALTLAEYLAYERDMHVLVIITDMTNYAEALREISAAREEVPGRQGYPGYLYSDLASIYERAGRVKGKKGSITQMPILTMPNDDITHPIPDLTGYITEGQIVLSRELHNRGIYPPINVLMSLSRLMKEGIGPGKTREDHAEVSNQLYASYSRGVELRSLTAVVGEESLSERDRRYLKFADLFEQRFLKQGERENRSIEETLDIAWEILSVLPEEELVNIKEETIKKYHPKYRAG

SEQ ID NO: 22840 - protein, 598 aa, Aeropyrum pernix
MLAVKGSIVRISGPLVVAEGMSGAQMYEMVYVGEDRLIGEITRIRGDRAFIQVYESTSGLKPGEPVVGTGAPLSVELGPGLLGTIYDGVQRPLPIIAEKVAEVDPRRRMFVERGIQAPPLPRDRKFHFKPEPLKEGDKVEGGDALGRVPETSLIEHVVMVPPGIRGRLKWLASEGDYSVEDTIAVVERDGRDVEIRMHQRWPVRIPRPFKEKLEPQLPLITGVRIIDTFFPMAKGGTGAVPGGFGTGKTVTLHSLAQWSEARVVIYIGCGERGNEMTEVLERFPQYKDPWTGKPLMDRTVLIANTSNMPVAAREASIYVGITIAEYYRDMGYDVLLVADSTSRWAEALREIAGRLEEMPAEEGYPSYLASRLAEFYERAGRVKALGSPERSGSVTVVGAVSPPGGDFSEPVTSHTTRFIRVFWALDTKLAYSRHYPAINWLMSYSAYVDLVTQWWHENVDKRWREYRDEAMDILLRESELQEIVRLVGTEGLDEKDKMVLETARLIKDGFLKQNAFDPIDAFATPQKQFRLLKMIMDIHRKSLELIEKGVTTQQILQALGRLYIDIVKAKFTIPNDQLEKIDEIRDRALKALDELVSG

SEQ ID NO: 22841 - protein, 249 aa, Aeropyrum pernix
MQEVHDYGAYLILDEYGGVRAFLPWSEIASRAVRNIHAVLKPRQKVVVKVIRVYKKRGQVDVSLKRVMDSEKKRKMMFYKRYLKAATLVELIAEKLGKSVDEAYREVLWKLEDAYGDPMKGLEAAVLQGREALEKAGVPEEWIEPLLETAKTHVRVKTVKITFYLTLRSMAGDGVERVRKVLEAAKSQIESFKDSKVVARIYTVGAPKYRVELQGYNYKTLEKALEKMVEAARKTASKLGVEFSFERED

SEQ ID NO: 22842 - protein, 233 aa, Aeropyrum pernix
MVASIEKIIEEGVFVATGEGLSLRALDTSHVAMVDLYYPNTAFIEYDIGGESVEFGVSFDLLSKVLRRARKEDELVLEVEGSRLAVKLKSRGERTFRIPQVVMTYEKLPEPKVSFTVRARMLGSTFREAVRDLEPHSETLTLRALEDALLLVGSSEMATVEIELSQSRGSLLDYEAESQDRASYSIEYFSEMLSAAQAADAVVVSFSEDAPVRVDMEYLGGGRLTFYVSPKIE

SEQ ID NO: 22843 - protein, 104 aa, Aeropyrum pernix
MYPKRDGARYLLVCKSCGYSEEASREDHQAYRMRVTVEKGPRDKIVVIDDETPVGAQVLKGSVTCPKCGHDEVYFWMMQTRSADEPMTRFYRCKRCRYTWREYA

SEQ ID NO: 22844 - protein, 452 aa, Aeropyrum pernix
MAVDAPRIVVEPPGPRAREVLERDERVIMQSFTRWYPLVVKRGYGAVVEDVDGNRYIDFNAGIAVLNVGHNHPRVVEAVKRQLERFLHYSLTDFYYEEAVSAAERLARSVPISGGAKTFFTNSGAESIEASIKVVRAFFRGTRPYIISFLGGFHGRTYGAMSASASKPVHRARFYPLVPGFIHAPYPDPYRCPFPGLEGEACGEAAVSYIEDYIFSKLVDPGEVAAFLFEPIQGEGGYVVPPDSFLPSLQKLARKHGILLIADEVQTGFARTGRMFAVEHWGVEPDVMALAKAMGGGLPLGAAVGRSEVMSLPRGSHANTFGGNPVALAAFNAVMDVIEGERLWERSQRLGEKALKILGEAAEELSIVGHVRGKGLMIGVELVRDENTREPHKEALAWVLDRSFKRGLLVIGAGVSAVRIAPPLTIEEELFDRGLEILVEVLREADRRFSQV

SEQ ID NO: 22845 - protein, 473 aa, Aeropyrum pernix
MARIAEELEKIFGPEKVVSDPHIVRLYSREPSGLEGRAEAVVFPESAQDVSRLVRYAYSREVYIYPQGSSTDLAGGAFPERPGVVVSMERMRRVREVSVLDSVAVVEPGVRLWDLNVELSKYRYMFPIDPGSVKVATVGGAINTGAGGMRGARYGTMRDWVLGLEIVLPDEEGTILRVGCRTLKCRQGYDLARLIVGSEGTLAIVTEAILKITPMPENVVVVLAFFPTLRQLVDAVIEVKSRAIDTLLMEFMDVDSARLAAETLGAAIRPDGHMLLVGVPVNREASTRVLEEMVSIAKAAGAASVYTAKSMEEAEEKKLLEIRRSLFATQALLTQKQFKGRKVMMLMEDIAVPPSKLLDAVERLKELEAKYGFKTVLGGHIGDGNLHPTISYPVDDEKAKEAALKWYYDVMRMAIELGGTVSAEHGIGVLKKEALRLELERMGSVKALEIMAGIKRVFDPKGILNPGKVVAAE

SEQ ID NO: 22846 - protein, 458 aa, Aeropyrum pernix
MRGPVKIVATVGPSSSSASILAQMLSLGVDVARINASHGGVEQWNSMLESLRRAEEAVGKRVGVAVDLEGPRVRTGNSEPVKLEKGDLVTLGFMEGDVPVDARQFFETIDEGDIVLLDDGKIILQVESVEGFRVKARVLEGGVLGPRKGVVVRGKEPDLPPLSAKDRRALEFFADKGVSHVYVSFARSAEHVEKVRTVVRRLGLRQARIFAKIEGPSGVSRIGEIAEASDGVIIARGDLGMHYSLEELPEIQELIVWEARKRYKTVVLATEFLSSMIEKPVPTRSEVVDIYQAVLQTADALMLTGETAIGKYPVKSVQWMAKISSRAYKKLATSPPERPRPTSTPYKLALGLVELAESLDSPLVVYSKTGRFAERLASFKPLKTFYVGVPSREVERVVRHLWGAEPIVVGDYPYEAGLAKTYEKLRRENIIHGDETVVEAAWSSERGIYIIRVRNLEF

SEQ ID NO: 22847 - protein, 227 aa, Aeropyrum pernix
MALGIVVGVDEAGRGSLVGDLVVAGFAVEEARLGELQSLGVRDSKQLSPAARVELYREISGVGFFTVEAIRPWEIDGENINILVTKAVEEIVSRIVSYLGVHPSLVVVDKYGDVQGLRLALTRLGIEPRSILVEEKADSRYPVVSAASIVAKVVRDARLQVLRRMYGVRGSGYPSDPETREWVREVFARGEAPRVIRYTWSTVRKLGGPWRSKKAGRNRSLDEFLGG

SEQ ID NO: 22848 - protein, 225 aa, Aeropyrum pernix
MGAGCKVAEWIAGGLEGPAGRGLDERVVRSGTTTVGLIASDHVILAADKRATAGFLIASRRVKKIVMLSNYVAMTVSGLVADAQILSDVLREEIRLYEMTNKVKPSVRFVASLLSNILFSSKFFPYIVQLIVGGYDTQPRLYTLDLFGSITEDKYTATGSGSPIAYGVLEERYREDLSVEEAIKVATTAIRSAVLRDAASGDGADVVVIGPQGYEEKFIPYNSLV

SEQ ID NO: 22849 - protein, 380 aa, Aeropyrum pernix
MASRDSLGEVFRVSIFGESHGPGVGALVTGVPPGLEVDEAYINRELERRRPGGPYASPRREADRVEILSGVFRGRTTGAPILLFIRNVDVKPGFYEEFRYKPRPGHADYVAYERYLGHQDYRGGGIFSGRRTAALVAAGAIAKLVLARYGVRVYAYVKSIGGVEARVEPRDSEEFRRAIDRDPLKCPDPEASERMRRLVEEARREGDSLGSVVEAVAFNVPPGLGDPPLGGVDALLARAVMAIPAAKAVEFGEGFALAFMRGSEAHDSPRAVGGRIVHETNRSGGIVGGLTNGMPIVFRVAFKPPSSIPKPRRTVDLRSLGEAWVSGKGRHDPVIGPRAAPVVEAVTAIVLADLLLLREALLPEWVEDLRPWTRGEAGGD

SEQ ID NO: 22850 - protein, 427 aa, Aeropyrum pernix
MVWLRAPDRVVVHPSTVEGRVEAPPSKSYTHRMLFLALLARGRSVVRRPLVSNDTLATLNAVALLGGKPRLGRGVAEVEGGEVRGGAVVYAAGSGTTIRIAMGVAAHSAEATLLYGDESLNRRPVHPLSEALRSMGARVCDTGGNPPVKVSGPLRRASVEVDAAISSQFATSLLIAGSRLGEFELSAARLSSRGYVDITLESLSMFGVRVEREGYRLFRLRGTPKPVDAAVPGDYSSASFMLAAGAIAGRVEVEGLRPVDPQPDRRIVELLRSMGARVRVEGGVVAVESTGPLEPVDVDLDGSPDLAPVAAVLAAYARGVSRLRGLERLKYKESDRLSAIAWNLARLGVEARVRGGILEIRGGGVEGGVARSWGDHRIAMAMAVAGLGARRPVAVEGFSRVPDSYPGFLEDLARLGARVEAVKGGGV

SEQ ID NO: 22851 - protein, 225 aa, Aeropyrum pernix
MAGELHGFNVTKPLKREALSLASTLDSHARAIGAVNTMVAGEEGWEGFNTDWKGFLDSLKLYTASPPDTALVIGAGGAGRAAAYALATWGAGRVLIASRTGLTARRAAQDLAGLGAEVEPVPPGGLEDAAAASDVVVNATPLGWDGVSTPVERGFREGCIAVDMVYRPLATPFLRRAAASGCTPVDGLWMLAIQAAENIAVWLGLEASPVELRTYALEAMRGGRG

SEQ ID NO: 22852 - protein, 358 aa, Aeropyrum pernix
MAQAAVERRVFRLSVDEETVVAAGVGALSEAPRAAGGTAYIVHEEALSAEAARLARILEARGVEVLGAVAGGGERVKSLDWVTRLWDLMLQAGVERSTTVYIIGGGALLDAAGFAASTLMRGLSTVNIPSTTLAAFDAAAGGKTGVNLRGKNMVGTFHNPRMVLVEPGIVAGQPDEGYRDGFAELVKHVALSGDREPAASLLPQALARRPAPLARLAFWSLGYKMQVVAGDPRERGLRRILNLGHTIGHALEAASSYTLSHGRSVSIGLAGELELSRRLAGLPRGEAEDVLDMLSTAGLPLEPPPGLAGEAAGLVGLDKKREGGSIVMPLLERLGRPRLSRVPVETVSRLMVELWGGG

SEQ ID NO: 22853 - protein, 276 aa, Aeropyrum pernix
MWRWLPVAGFKGVKLALKSEERRETVVEVEGVRIGGGSKAVIAGPCSVESWEQVREAALAVKEAGAHMLRGGAFKPRTSPYSFQGLGLEGLKLLRRAGDEAGLPVVTEVLDPRHVETVSRYADMLQIGARNMQNFPLLREVGRSGKPVLLKRGFGNTVEELLAAAEYILLEGNWQVVLVERGIRTFEPSTRFTLDVAAVAVLKEATHLPVIVDPSHPAGRRSLVPALAKAGLAAGADGLIVEVHPNPEEALSDAKQQLTPGEFARLMGELRWHRLL

SEQ ID NO: 22854 - protein, 399 aa, Aeropyrum pernix
MQIEWAERHMPVLMRLRSSMGGDKPLSGVRVAACLHVTKETAVLVETLRKWGAEVYLAPSNPLSTQDEVAAALAEAGIGVFAWRGMTPEEYKWALSTVAGREPDIVIDDGADLHVLLHEEMRSVGEKVWGGTEETTTGVIRLRALEREGRLLYPVIAVNDALTKFMFDNRYGTGQSTVDGVLRATNILIAGKTVVVAGYGWVGRGIAARFRGMGAKVVVTEVDPVRALEAAMDGFTVTTMDEAASLGDVFITATGNINVIDARHMEKMKDGAILANAGHFNVEINVAALEEMSVSKRRVRRYLDEYRLPDGRRLYLIGEGRLVNLVAAEGHPSEVMDMSFSNQALAVLKIAGERGRLEKRVHRVERIQDEMVARLKLETMGVRIDSLTEEQKLYLQKWK

SEQ ID NO: 22855 - protein, 845 aa, Aeropyrum pernix
MRISVLFKYFIHLPPGLTPFIWCLCVERRLILWLDEISKDLLPLVGGKAAGLGEMIKAGIPVPPGFVVTSEAYRRFVFETGIAGFIKHILEETIVSGRPEEYEKASELIRSKFVRTPMPPYLRRAIVDAYRKLGTLVGVEEPRVAVRSSATVEDLPEASFAGQQETYLNVKGEEEVVEKVKTAWASLWTARALSYRDSLNIDHETALMAVVVQKMVSSRSSGVMFTIHPVTGEEDKIVIESIWGLGEYIVGGKVTPDRFVVSKSDLEILEVRISRKDKALFYDPDLNENVEIKIPESGEELEDLRRKHPAVAEVVEKYGIRPDAPSLSEKEVKELARLAIKVENHFARPMDIEWAIDFELSPPENILLLQARPETVWSRKKEEAEAKPPEEEAVPEGEVLVRGVPASPGVASGRVKVALTVEEAAKKMEKGDVLVTKMTDPDWVPYMKMASAIVTDEGGMTAHAAIVARELGIPAVVGTGDATKKLKDGMLVTVDGSRGVVYAGAVKTEEAREEEARPELGAAVAEVLSEVYPVTATKIYMNLGHPEEIDRYKHLPFEGIGLMRIEFIISSWIGYHPMYLIEQGRGVYFIDKLAEGVAKVASAIYPRPVVVRFSDFKTNEYRRLKGGEKYETLDERNPMIGWRGVSRYIHPNYEPAFRLEVRAIKKVREEWGLKNVWVMFPFVRTTWELERALKIMEEEGLSRGRDFKVWIMVEVPSTVFLADEFAKMVDGFSIGSNDLTQLVLGVDRDSGFLAKMGYFDERDPAVLRSIEILIEKAHSQGATVSICGQGPSVYPELVEFLVRRGIDSISVNPDAVVRVRRQVASIERRIMLERLEELGSRLSRL

SEQ ID NO: 22856 - protein, 313 aa, Aeropyrum pernix
MVGQPLITILGAGKVGMATAVMLMMRGYDDLLLIARTPGKPQGEALDLAHAAAELGVDIRISGSNSYEDMRGSDIVLVTAGIGRKPGMTREQLLEANANTMADLAEKIKAYAKDAIVVITTNPVDAMTYVMYKKTGFPRERVIGFSGILDSARMAYYISQKLGVSFKSVNAIVLGMHGQKMFPVPRLSSVGGVPLEHLMSKEEIEEVVSETVNAGAKITELRGYSSNYGPAAGLVLTVEAIKRDSKRIYPYSLYLQGEYGYNDIVAEVPAVIGKSGIERIIELPLTEDEKRKFDEAVQAVKKLVETLPPQLRE

SEQ ID NO: 22857 - protein, 405 aa, Aeropyrum pernix
MLTPLAGGYNRRVDLITGSPTRKIDAVRERLAREGRDVILLSTGQPGFLPPTFLRERLAQALLDEGFKRLYSYTPTPGYADVREAIAEDLAALGGPRMEPDDILVTAGGQEAMFATLSTILEPGDKVILMDPTYFGYRPIVEYLGGRVEWVRAPPSLGFQPDEERLKEAFTRDVKAVVLVSPDNPTGRLLSTESAKLVADLAVDTGAWIVYDEAYKTLVFEGEHVYLYKLAPDNTISINTFSKDPGFPGWRLGYLYGPGWIVGKIRLVSEELVYCPPSIAQVAAKIYLEDREGRLRHLEYAREFLKTRMEAMAGALEEMLPEAVFARPGGSMFITVDLSSYLSKASITSEDLSVKLLDEESVATVPGRYFGPSGDTMLRLSFATETPERIREGIGRLARLLERLA

SEQ ID NO: 22858 - protein, 435 aa, Aeropyrum pernix
MQVMASPPCTTEELSPPPGGSLVEYSGGSLRVPDNPVVAFIRGDGVGPEVVESALKVVDAAVKKVYGGSRRIVWWELLAGHLAREKCGELLPKATLEGIRLARVALKGPLETPVGTGYRSLNVAIRQALDLYANIRPVRYYGQPAPHKYADRVDMVIFRENTEDVYAGIEWPHDSPEAARIRRFLAEEFGISIREDAGIGVKPISRFATRRLMERALEWALRNGNTVVTIMHKGNIMKYTEGAFMRWAYEVALEKFREHVVTEQEVQEKYGGVRPEGKILVNDRIADNMLQQIITRPWDYQVIVAPNLNGDYISDAASALVGGIGMAAGMNMGDGIAVAEPVHGTAPKYAGKDLINPSAEILSASLLIGEFMGWREVKSIVEYAIRKAVQSKKVTQDLARHMPGVQPLRTSEYTETLIAYIDEADLNEVLAGKRG

SEQ ID NO: 22859 - protein, 553 aa, Aeropyrum pernix
MTIVWTPVKGWFLVALWRIEKPKNEPFLEFRPGTKERELLKKKLEEVKSKTVEIPLIIGGKEVKTGETVEIRAPHDKDAVLAVAHLAGEEEIRDAIEKALDAWTKWSEMEWYHRASVFLKAADLLAGPYRLEADAVIMLNHSKTPWEAEIDLAELVDFWRFGAYYARFIFEQQPEQAPGELNRVEWRPLEGFVFAVPPFNFFSIGGNLPTAPALVGNVSIWKPSRWVIYSNYIIMRILMEAGLPPGVVNFVPFNTKYSSIVLSHPDFAGLHFTGSYSTFVRLWKMIAQNLDKYRNFPRIVGETGGKDFIVVHPSADITEAVVATIRGAFEYQGQKCSAASRLFVPKSMWPRFWEAMKAELDKVKVGPVDDFTVFMGAIISEEQFRKIVSYIEYAKQHPEEYQIIYGGKYDDSKGYFIWPTVVLTNNPKGKLMTEEIFGPVLTVYVYDDDKYDEILWVVDKAAPYGLTGSVFAKDREAILKAEKALRYAAGNFYINDKPTGSIVARQPFGGARWSGTNDKAGWFTNLLRWLNPRSIKETLVPPKEWRRPYMGED

SEQ ID NO: 22860 - protein, 557 aa, Aeropyrum pernix
MVEMAATGYPVLILKEGTQRTYGREALRANILAARVLAEMLKSSLGPRGLDKMLVDAFGDITVTNDGATIVKEMEIQHPAAKLLVEVAKAQDAEVGDGTTSVVVLAGALLEKAEKLLDENLHPTIIIEGYTKAMEEALRLVDEAAVPVEVEDDSVLRRIAETTLASKFVGTGPERDKIISMVIDAIRTVAEKRPDGGYEVDLDYVKIEKKKGGSLLDSKLVRGIVLDKEVVHPAMPKRVENAKILVLDAPLEVQKPELTTKIRVTDIEKLESFLEEETRMLRDMVEKIAATGANVVITQKGIDEVAQHFLAKKGILAVRRVKRSDIEKVAKATGAKIVTSLRDLKPEYLGYAELVEERKVGEDKMVFIEGAKNPKSVTILLRGANDMLLDEAERNIKDALHGLRNILREPKIVGGGGAVEVELALKLKEFARTVGGKQQLAIEAYAEALETIPTVLAESAGMDALEALLKLRSLHSQGYKFAGVNVLEGKIEEDMTKINVYEPVLVKKQVIKSASEAAISILKIDDVIAAAPPKKKEKKGKTGEEEEEEGGGSKFEF

SEQ ID NO: 22861 - protein, 260 aa, Aeropyrum pernix
MDLGIQGKLAVVTAGSSGLGFASALELARNGARLLLFSRNREKLEAAASRIASLVSGAQVDIVAGDIREPGDIDRLFEKARDLGGADILVYSTGGPRPGRFMELGVEDWDESYRLLARSAVWVGRRAAEQMVEKGWGRMVYIGSVTLLRPWQDLALSNIMRLPVIGVVRTLALELAPHGVTVNAVLPSLILTDRVRSLAEERARRSGITVEEALKSMASRIPMGRVGKPEELASVVAFLASEKASFITGAVIPVDGGAHI

SEQ ID NO: 22862 - protein, 400 aa, Aeropyrum pernix
MHSLGRAVAIVGTGHSKFGVRNDVNIAELAWEAMREAASEAGIELRDVDQVVVGNAGGWSSEYLSSIVLLEYAGISGKPVYRVEAACATGSAAIKAAHDAIAAGEADLVLVVGVEKMNESPTPIVVEMIGRAGNYFWEFENFGLTFPGYYALYATAYMSEFGATEEDLCRVAVKNHHHASMNPKAHFPRAITLEQCLQSRYVAWPLKLYDSSPITDGAAAVVMASEDLARKLTDSPVWIHSIGMASDTSNLSKRPDFLVHRASRLAAERAFKKLGIEIEGSYKHFDFANVHDAFTIAEILAYEAMGFAKLGEGYKLVREEQTYVGGLIPVNLDGGLKAKGHPIGATGVSMAVEHVRQLQGRVEKGRQAEIKRGRSLAHNVGGTGHYAFVTVYGLDKPRSR

SEQ ID NO: 22863 - protein, 325 aa, Aeropyrum pernix
MEALRGVSFSFPESSITAVLGPSGCGKTTMLKVIAGLLKPRRGRVFFGGVDYTGLPPERRSVGFVFQDLALFPHMTVYDNVAFGLRARGFSGGEVRRQVEWALETVGLTPPREFMGRRVTGLSGGQQQRVALARAIAYEPPVLLLDEPLSHLDFKIRQRLLAELKRLQRKLGSTMIYVTHDQWEAMELADTLVIMRDGRIVQHGTPSEVYTRPANVYVATFFGDANIIPKELLTPGSGGEWAIMVRPEDLEIVRNGSPVPQGWPRLEAVVEDLVFQGPLIRVELRWRGGRLRAVVPRRTASSLPRPGEAVSVTWSPDRGVDVALE

SEQ ID NO: 22864 - protein, 305 aa, Aeropyrum pernix
MALFDPKVATLAPPKRVRFVIRKYDPESGRSWWQEHEVETYRGMTVLDALLKIKEEQDHSLTLRYSCRMAVCGSCGMTINGTPRLACQTQVAQVAREDAPVVRVEPLYNFKVVKDLLTDFTEFFEKHRRVKPYLIRRDVDEQENPTLEYKLLPEEYEQFYQYSLCIACGLCVAACPIFASDTKFLGPQALSQAYRFVVDPRDEGYVERLEIVDSIDGVFGCHFAASCSAVCPKEVDPAGAIQRLRSLLLKYRLGLYKKRINGVVPPMEAKKERVPLPPEAQPLDGVDVEKLEETPPEIPVEKLVA

SEQ ID NO: 22865 - protein, 573 aa, Aeropyrum pernix
MVVVGTGIAGLRAAVEIKRRYGDKLDVGLVSKIHLMRSHSISAEGGTAAVIYKEEGDSYALHAWDTIKGSDFLADQDAVWIFVKLMPEEVRLLEHWGMPWSRRPDGRLAVRAFGGHSVKRTLFAGDKTGFYEMHTLYNKLLQYDGWERYDEWYATNIVVEDGEFRGVFAINPRDGDIYLFKAKAGIIATGGAGRLYNFATYAHTVTGDGWGMALRAGLPLKDPEFFQFHPTGLIPSGILITEGARGEGGYLLNNRGERFMLRKECAPKMAEIAPRDIVSRCIIREILEGRGFKDDVSGLEYVLLDLRHLGEEKINERLPAVREIAIRYAGIDPVEEPLPVRPVAHYTMGGIRTDSYYRVLDAEGRWVRGLFAAGEVAAASIHGANRLGSNSTAECLTSGRIAGMLAAEYALKAEARGVEPERFEKEEAWVYGLVKRESGTPSYAIKRELRDTMGKYFYVIRDEEGMRRGLLTILKLRKMFREDVYVEDKGRIYNTDLIAALETANMLDAALAVAKAALNRAESRGAHYRVDYPKRDDENWLKHTLVTASGEDDVRIDYEPVRITTWKPVERKY

SEQ ID NO: 22866 - protein, 147 aa, Aeropyrum pernix
MPPGVGGQVIEVEVAGVRFLLRKDLRYTESDEWARLEDGVATVGITDFAQKELKDIVGVELPEKGRKVKKGEAVATVESIKATADIYAPLSGEIVDVNEKLLDQPELINDDPYGEGWIFKIKVEDPGEFESLLTPEQYVESVRKRKE

SEQ ID NO: 22867 - protein, 175 aa, Aeropyrum pernix
MARPGHSGRVTPGLISNPEVKPAALEAPVGSERPCRGLQAGAGPLQRPVPTMSPATSSLIVYTLLHLIPPGKVTTYSSLARASGLSPRAVGRILARNPSPIAVPCHRVVRSDGSIGGYSMGGPRVKAALLKLEGVRLYRSGGSWRVHPEDIVDLSSILLDPPEGSAEALSTVKAD

SEQ ID NO: 22868 - protein, 384 aa, Aeropyrum pernix
MRAVPYLEGSAKKYALAAVDAEKRGDYEAAIVNLNKAIEYLTEIVRNYPDYPLAHIYRRLIAQYRRKVKDLEKKARMIPASGDEVYVDTQEKDGGGEDEAPEFVLKEKPSVTFDDIAGLEEAKKAIREAIVFPVKRPDLFPLGWPRGILLYGPPGTGKTMLASAVANEIDGEFLYVDAANIMSKWLGEGEKNVKKLFNYARNKAKEGKPVVIFIDEVDALLGVHGSEVGGEVRVRNQFLKEMDGIQDKGSRLHVYVIAATNKPWKLDEPFIRRFQKRIYVPLPSRETRKRMLEMYTRKLRLAGDVDLDRLAEMLEGYTGSDIADIVREAYMATVRELFEKGKVDGEPRPITMSDFQEILRRRRPSVDHRLLKTYEEWTERFAAV

SEQ ID NO: 22869 - protein, 186 aa, Aeropyrum pernix
MPGGDDFRGDSRVVVISGPPGSGKSTYAKRLAEDLGLSYYSTGTIFRSIARERGLSLAEMSRLAEEDPRIDLEIDRRTLDVASRGGVVIDSHLAAWLLRDKAQYLVLVKAPVWVRVRRIARRDGVPLRRALAETVEREWSQRLRFKRYYGIDVSDTTIFHLTVDTSMYSVEDTYRLILEGARRRGL

SEQ ID NO: 22870 - protein, 256 aa, Aeropyrum pernix
MAGAVLDPSTPPPTTGTSWRWPGLRDADPYREARLRMVEQLRRSGLVTSRRVLEAMARVPRHLFVPPEYRGMAYEDRPLPIGHGQTISAPGVVGRMLQLLDPQPGEKVLDVGAGSGYQSALLAELVTPGGRVYAVERIPELAEYARENLEKTGYRGVVEVVVGDGSKGLPQHAPYHRIKVAAAAPKPPKPLVEQLAPGGRMVIPIGTPDLQILTIIEKTPDGRVRERRDIEVLFVPLIGEHGYREDWRKQYWQWWR

SEQ ID NO: 22871 - protein, 294 aa, Aeropyrum pernix
MVTPLRGGSVDKNAASWLASRLSESGVDGVFVPGTTGEWYLLDPHERAEAFFAVASSAIAGLRLVAGVSGYRPEESYRLAEEAAGHGAHAVMAVPPIYFRPSTDFLREFYGEIKRRAGGLPTYIYIFPERMGYTLAVEQVESLVEAGVVDGIKATVTDAAYIAGLAAVKERNPEFEVLAGGLEMLVHTSLSGGDGVVDAYSNVAPKLAVELAESLEKGSVERVAGLQGRVLKLSRILGKRSLPAVLKAVLHVLGAPITGEVRKPLKPLTQPEANATANALCTSYRDYLLPGLEC

SEQ ID NO: 22872 - protein, 405 aa, Aeropyrum pernix
MSMLGLTLISLTPQQLRLEFPSCGCGALKLYEFEAKEILRMYGVETPPSVLVMPGDDVAAKIREAGLEPPLVVKSQVLVAGRGKAGGIKLVESVEDAVRVAGELWRKPIKGILPGALLVEKAVPHDAELYTSIIIDRSERRPVILASRFGGMDIEEIAREKPESIVRHYVDPFLGLRGYEARMVGKAIGLSGRLLNSYASFLQVLYRVFTALEAELVESNPLAIVGDKVVPLDARIIVDDNSLFRHRELVERRRVEQRGEYTEWEVKARQQGLPFVELEGDIGIIGNGAGLTMATMDLVYHFGGRPANFLDIGGGARAELVKKAVSFLLEFPKAEKIFINVFGGITRGDEVARGIVAAVRESGSSKPLVVRLSGTREEEGRRILEEAGIYAYTDPVEAVKKVVSL

SEQ ID NO: 22873 - protein, 297 aa, Aeropyrum pernix
MGWCVMAVLVDSETRVLVQGITGREGSFHAKAMLEYGTKVVAGVTPGKGGSEVHGVPVYDSVKEALAEHPEINTSIVFVPAPFAPDAVYEAVDAGIRLVVVITEGIPVHDTMRFVNYARQKGATIIGPNCPGAITPGQAKVGIMPGHIFKEGGVAVVSRSGTLTYEISYMLTRQGIGQSTVIGIGGDPIVGLSFTEALKLFQEDPQTEALVLIGEIGGDMEERAAEMIKKGEFTKPVIAYIAGRTAPPEKRMGHAGAIIMMGTGTYEGKVKALREAGVEVAETPFEVPELVRKALRR

SEQ ID NO: 22874 - protein, 619 aa, Aeropyrum pernix
MGCLVLASSSGGVGGGDMPFKPVAEAFASMERITSRTQLTLLLTRLFKSTPPGAIGIVVYLIQGKLGPDWKGLPELGVGEKLLVKAIALAYKATEERVERLYKSVGDLGSVAERLSREYRSRAARAVTLEAFMAGGGEALTVRRVYNTLYRIAMAQGEGSRDIKLRLLAGLLADAEPVEAKYIVRFVEGRLRVGVGDATVLDALAMAFGGGAHARPVIERAYNLRADLGYIAEVVAREGVDALRGVKPQVGVPIRPMLAERGRDPAEILRKVGGRAVVEYKYDGERAQIHKKDGEVYIYSRRLENITRMFPDVVEMARKGLKAGEAIVEGEIVAVDPDNYEIQPFQVLMQRKRKHDIHRVMREVPVAVFLFDALYVDGEDLTSKPLPERRRRLKEIVVETPLWRLAESIETSDPEELWTFFLKAIEEGAEGVMVKAVHRDSVYTAGVRGWLWVKLKRDYKSEMMDTVDLVVVGAFYGRGKRGGKLSSLLMAAYDPDRDVFPTVCKVATGFTDEELDRMNEMLKKHIIPRKHPRVESRIEPDVWVEPALVAEILGAELTLSPMHTCCLNTVRPGVGISIRFPRFIRWRDDKSPEDATTTHELLEMYKRQLRRVEEPAEQV

SEQ ID NO: 22875 - protein, 604 aa, Aeropyrum pernix
MIDYDSCKPKKCSYECIAVCPVNKSGRGVAIDADMASRGKPVIYEDACIGCALCVKACPFDAIYIVNLPMELEEEAVHRYGVNGFKLFRLPIPREGQVVGLLGRNGTGKTTALRILAGELKPNLGRVEGGEPEWDEILKRFRGSELQTYFRKLVDGKLRVAHKIQYVELVPRRLKGRVRDLLKRADERGVALELAEQVGLDKVFDRDVRQLSGGELQKMLIVAVLSRDANVYIFDEPSSYLDIRERMRMARLIAGAARPGAYVMVVEHDLAVLDYVSDLVHILYGEPGAYGIVSKPYSTREGINVFLQGYLPAENIRLRKEPILFRKPAPEAQPAAPGGGRQASRRRIVGWTGLRVALDGFTLTSGEGALYGGEVIGVAGPNGIGKTTFVRTLAGALKPVEGAVYPYVEDLRVSYKPQYISPESLPDATVEQVLKAANPAILAPGSWLNLELVKRMRLDKLLERRVRTLSGGELQKVAVAAALAREADVYLLDEPSAYLDVEERVGVARAIRRIVETREAAALVVEHDLMILDYVSDRIMLVTGEPGVRGHVDDPRPVKEGMNLLLQNLGVTVRKDEQTGRPRLNKEGSYLDRMQRARKLYYAV

SEQ ID NO: 22876 - protein, 473 aa, Aeropyrum pernix
MERLNKPSAPRYSRLREWVVGCAPNDLVVVKFGGSVLNGSPGFLAAGRLVLGLLESGLEPVVVVSAVKGVTDALLSSFERRDPGVGGAVGKTYLSIARELGLPPESVRDVSLASAEVSKLLWAAEVLGQWTPRVRDLVVSYGERLSAALMAGLLRRLGVEARWLGGGEAGIVTDGEFGDATPLYGYTEGVIRERLEPMLEEGVVPVVAGFTGATREGDTTLLGRGGSDLTATLLASALGAGRVVLYTDVPGILSGDPRVVGEPRRVGYMSYEEAWEVARLGLRKFHPRTFEPLIAGGLGVEVVVSDLRGRSTRIGPGRGGPPLKVVSLSRGVARLVVRGPSMAGKRGFLSRLAGLLAGRGVNILAIRQPPSETAIELVVDERDLPAAVEELGARSGAAGVRLEVERGFDVVSIVGWGAVEALPEALSAAEKTGGRLLSTGELSPSISILARGRTSPELARLLHRRVVESWVTG

SEQ ID NO: 22877 - protein, 349 aa, Aeropyrum pernix
MRAAVLGASGLVGQVFLRLLEGHPYFEVAAVASSPGKAGLDAAEAIDWILPGGPPGYLEGMRMSRPEPGALRAEGVELVFSALPSQAAAELEPALAREGFEVFSNSSNMRLDPDIPLVNGEVNPGHLALAKAQRERGWRGVVVKNPNCTTAILTLALKPIVDAAGLREVHVATMQAISGAGRRGVPGYGIVDNIIPHIPGEEGKVEAESRKILGSLRGGRLEPAAFSVAATTTRVPVLEGHLEVVYLKTARPMEPGEAVEALESYRGIPQELGLPTAPPKPLRVLRGEDRPQPRLDRAAGGGMTVSVGRVEAKEGGWLRMVVLGHNLVRGAAGAALLAAELWLRRGEWL

SEQ ID NO: 22878 - protein, 410 aa, Aeropyrum pernix
MEAGSIVLGLVGKTNVGKSTFFAAATEVPVKIENRPFVTIEPNVGVGYARKRCAHVELGLPRCDPVNSLCIEGWRFIPVKLLDVAGLVPGAHRGRGLGNRFLDDVRKADALLLVVDASGSTDPEGVPVKPGSYDPVEEVGLMLGEIYEWMLQNLARDWERFARRVDTAGNVDLVTALSQRLSGFEIPRGVVAGVLEETGLGEKRLSSWSREDLRLFVKLVLERGKPAVILANKVDVPGAEENVERLGSSYPGIPVVPASALAELMLRRLAREGRVRYIPGDPDFTVKDPGGLGGKALKALELVRERVMKRWGGTGVVQAINTAVFDVLDMIAVYPVEDPNRYTDREGRILPDVILVKRGSTPRDLAYRIHTDLGKTFLYAVNAKTKQRVGEGYRLQDGDVVKIVAAAGKR

SEQ ID NO: 22879 - protein, 363 aa, Aeropyrum pernix
MRILWINHRDPKHPQAGGAEVRLYEIARRLVKMGHEVMVLCEKVSRLPGEEVLEGIRIKRSGGRASIHLLAPLYVRKHGHEYDVIVDDIAHAVPWYSPLVTKTPVVAQIHHVHQDVVYIELPKPLAWIVSRAEKTIAKIYRRFIAVSQSTKKELAKRLGIDPDRIAVVPNGVDLEKYRPGSKDPRPTILWAGRIKMYKNLDHLLKAYRIVKQEIPDAQLIIIGTGDQEQKMRELAKKLEPRDVHFLGKMSEQEKIMWMQRAWIIVSTSMIEGWGITITEAAACKIPAIAYNVPGLRDSVKHMETGILVEPGNIEQLAKAIAWLLTDNSLRNKLSENAYNYAQSFSWDNTAITFLNILEDITRI

SEQ ID NO: 22880 - protein, 186 aa, Aeropyrum pernix
MQALTTYKCIEKGIVVWLTGLPGSGKTTIATRLADLLQKEGYRVEVLDGDWARTTVSEGAGFTREERLRHLKRIAWIARLLARNGVIVICSFVSPYKQARNMVRRIVEEEGIPFLEIYVKASLEEVIRRDPKGLYKKALKGELENFTGITDPYEPPENPQLVLDTESNTIEHNVSYLYSLVKAVIE

SEQ ID NO: 22881 - protein, 389 aa, Aeropyrum pernix
MGCSVGLVSRPHGGRLVRRVLSGRRREIFESQYREMPRLEVPLERAIDAEDLARGVFSPLEGFMVEDDYLSVLSRMRLSNDLPWTIPIVLDANREWVLNEGVSAGDDIILTYHGLPIAVLTLEDIYSWDKGLHAEKVFKTRDPNHPGVEATYKRGDILLGGRLELIQGPPNPLERYTLWPVETRVLFKEKGWRTVAAFQTRNVPHLGHEYVQKAALTFVDGLLVHPLAGWKKRGDYRDEVIIRAYEALITHYYPRGVVVLSVLRMNMNYAGPREAVHHAIVRKNFGATHFIVGRDHAGVGSYYGPYEAWEIFREFPDLGITPLFVREAYYCRRCGGMVNEKVCPHGDEYRVRISGTRLREMLGRGERPPEYMMRPEVADAIISHPDPFI

SEQ ID NO: 22882 - protein, 625 aa, Aeropyrum pernix
MGRLVAGVLCGIIGLAFAEGNSVAGALVRGLKRLEYRGYDSMGVAVIEPPGRLVVRKAAGKIGEVVRRTGVLSLRGRVGIGHTRWATHGPPNDVNAHPHTDCGGRVAVVHNGVIRNYASLRRELEARGHRLVSETDTELVAHLIEEYLGRGYSFLEALSLLGRVLRGSYALALLHLGEPDKVYFLRYKSPLVVGLGEGVNAVASDITAVLDVARDVIVLEDGEFGWISPEGVAIYRPRGDGGFEPLPPGALEERVKRVEWTPESASKAGYPHFMLKEIYEQPRALAETFEGIIEDPALLRAAGLVAGAGRLLIVGAGTSFHAGLVGHYYLSRLAGILGHPVVASEHKVYTPGVDGETVVVAVSQSGETYDTLEAVREWRGRGARVIGVTNVVGSALDREADVTLYLRAGPEIGVAATKTFLAQTILLQTLSIAAAGEAGRLTSGETRELTGVLEGAPDAARRAILASEGAAREAASLLKGAGSMYIIGRGLGGRLAMEAALKVKEVSYIHAEAYPAGESKHGPIALVEPGFKVYVVATSDSPEVMGNAIEMKARGASVTVVAPSDLQLDTPEGIEVLKMPPTGGETLLDPYSLTPYFQLLAYHLAVARGYDPDKPRNLAKTVTVE

SEQ ID NO: 22883 - protein, 384 aa, Aeropyrum pernix
MRGFTTKAVHAGEDPRETLHGDVVHPIHLSVTYWKRSVAEAEEGYVYSRTSNPTRDALEKKLAALENARYALAFSSGLAAEATVILALLREGDHIVAFDDLYGGTKRLFQRVMARFGIKVTYVDARDPGNIEKALTPATRMIWLETPTNPLLKLTDIRAAAEIASRAGAYLVVDNTFATPYFQRPLELGADIVVHSATKYLSGHSDLLAGAVMVNSSEVYEKLKYHQNAVGAVPPPLDSYLLMRSLKTLALRMEWHQHNAMKIAEHLESHPKVDRVIYPGLSTHPQHSLAKRQMTGYSGMLSFELKGGAGAAVRFVESLRIIALAESLGGVESLVEIPSLMTHASIPREERLKKGITDGLVRLSVGIEDLEDLIEDIEQALKKT

SEQ ID NO: 22884 - protein, 332 aa, Aeropyrum pernix
MAGEDALRAAVLYGPGDVRVEDLPPPEQPEGWALVRSRAVGICGTDKAFYRGTYPLFKKPLVPGHEVSGEVVEGPEDLVGSRVVSEINFACLRCEVCREGLYTHCPRKKTLGIDFDGGMAEYFTAPPWALHPHNMPHEKAFAAEPLAAVLNALQQAPPRPGWAVAVLGTGFMAHLTAQTLTAYGFKPAIVARPDSPKAVFFRRLGLEVLTPEEAVKAASETPGGLGFHMVFETTGSNQGLSIATALARPRGVVHVKSTPGGEAVFSQTLAVVKEIRLIGTRCGSHREFKEALRLLESGEVEPQVTKFRSLEEAPEAFEASLDRESMKIVVTI

SEQ ID NO: 22885 - protein, 306 aa, Aeropyrum pernix
MAGIGGEDLAVVVEGVVKIYESRGERIVALREVSLSVARGEVLAIMGPSGSGKTTLLNIIAGVDRPNAGRVIVDGFEVSSAGGEELRRFRLERVGYVFQQHNLIPTLTALENILLPMALAGKANRLRGQELLRRVGLGGKERRYPEELSGGEQQRLAVAVALANDPPIIVADEPTGELDIATGERIVRILLEEAHSRGKTVVLTTHDPRVARMADRVAVIEDGRLRGVYSPSRIAGATGFGEVEAEKAVEAVMRRILDDAERRLREAEDRFRRGEVGIDALVETYTRVKALREAVREELSRLGITG

SEQ ID NO: 22886 - protein, 253 aa, Aeropyrum pernix
MECGLGGAGQPAVEAEGVWKRLGGRWVLKDVSLTVPRGSVYGVVGPNGAGKTTLFRTLLGLYRADRGRVALLGEPVERAGGSLFRRVAYLPEDGEPYRNMTGHEFLRLYASIYGVEDLEGYLEEASRLSGLGGRLGERVRSYSKGMRRRLLVAAMLALKPSLAVLDEPTAGLDPVYSVGIRRLLKEYSERHGVTVLLSSHNMYEVESVCSEITMISSGRIVYSGSPGEAVRRTGASSLEEAYVALVTGGGGES

SEQ ID NO: 22887 - protein, 1260 aa, Aeropyrum pernix
MLAAAGLLSSLGPLASALSSNRYLTTIETPRLGYPEDLRGWEKFYRDMWAYDKVARSTHGVNCTGSCSWMVYVKDGIVAYELQAGDYPDIGPSYPNYEPRGCPRGASTSWYLYSPLRVKYPYVRKPLLELWREARSSYSDPVEAWAGIVEDPDKRSRYVRARGLGGWVRADWDTVLEIIASALVYTIKKYGPDRIFGFTPIPAMSPVSYASGARFIELIGGSMGSFYDWYADLPPASPQVWGEQTDVPESADWFNAAYIINFGTNIPMTRTPDAQFFTEVRYKGTKIVVVSPDFSEHTRFADVWVPIKEGTDGAFAISMAHVILREYYVERQVDFFIDYVKRFTDLPFLIVLEPYEGGYRPGKFLRLSDLHPEEYYSEGYSGEPNKEWKLLVYDSNTGRPRLVNGSIGYRWDGSGKWNLKLEDPITGEPVDPKLSLIDDSDEVVMVKFPVFGASFGEKGIVERGVPAKRVKLADGSEALVATVFDLLAAYLGVDRGLPGDYPAGYDDKKPFTPAWQEDITGVSRELAIRLAREWADTAVKTRGRVMVMLGPGVNHWFHSDLHYRAILTLVKLTGAEGRNGGGWAHYVGQEKIRTIAGWAKLAFALDWVLPPRHQNSPSFYYVHTDQWRYDRLTTDYYEGPWSDVREKMKCSHPMDCNIKAARLGWLPFYPQFNRSTLDLAAEARRLGKDPVQHVVDLLKSGQLKLAIEDPDAPENWIRVMFVWRANLLGSSGKGHEYFLKHLLGSPMAQPMSEEVDRSLIKEVVWRAAPEGKLDLLVAIDFRMATTPIYADIVLPAATWYEKYDLSMTDLHTFLHPFTPAVDPLWESKSDWDIFKELARKFSEIAANHFPDEVEDIVARPLWHDTPMEIAQPYGVEKDWRYGETEPVPGKTMWDLKVVKRDYRNVYKMFISLGPKARKAGVKGVSYDTSDIYEMLKEDLGVVYWEKCPDGCPSVESDKNAAEAILALSPEANGLVGERSFASLEAKAGVPLKDLAKSREWYKFDDLVGQPRRSHTSPMWSGIEDFNRAYAPFTINTEKLVPWRTLTGRQHFYLDHDWFIALGEMLPTYKPPVDPVRLGYLKNAAARLGITRMNGYRIEEGGRRYLLLRYLTPHGKWNIHSEFWDNLKMLTLFRGGQVVWLNDEDARWAGIEDNDWVEIVNDNGVIVARVATSPRIPKGVAIMYHAQERHIYVRPSKLTGKKGGIHNSVTRADLKVNLMVGGYAQLSYFFNYYGPTGVDRDTMVIVYLHDKLGAKAPQPGA

SEQ ID NO: 22888 - protein, 466 aa, Aeropyrum pernix
MEMVRAQLSMVMVLDKCIGCHTCSLTCKNVWTNREGQEYAWWNNVETRPGVGYPKTWENQEKYGGGWVLRNGKLRLRLETGRFKTPGREDYYEPFTYNYENLFSEELSDQQPHADPISMYSGEKIDVQWGPNFDDDLAGGDLTIPADPNWSGIDKAIYKEFKNVFMFYLPRICNHCLNPSCLAACPRKSVYKRPEDGIVLIDQTRCRGYRQCVQACPYKKVYYNWKTGKSEKCIFCFPRIETGQPPVCALTCVGKIRYVGVVLYDEERVLEAAKAPEDQLVALQRDIILDPFDPQVVKAARESGVPDNFIEAARKSPIYYMFKKWEIALPLHPEFRTLPMVFYVPPLNPVVTVLDRNGKYSADYDSILPTIDKLRIPIRYLANMFAAGNEEEVRKALKRLLAIREFFRQIEVEGKSRSEAAWVLEENGLTVEDADMMFRWLALSRDRYVIPTAKKELRIRLPSKGR

SEQ ID NO: 22889 - protein, 182 aa, Aeropyrum pernix
MGVEMRLTLKTLSIIFSYPSEDLEELVRNREVVKPLLIGEDGEAAALIMEFLEKLDLERADEEYVAVFEMPPKCSIYAHTYLLKGKEDMVGQLLLEVKSHYKAKQLDMPVDREIPTYLPAMLEYLALVYDEDPKAARRFAKKYLQPWVGELASCLEKNRSLWSLPAKALKRVVDKIAEGRGP

SEQ ID NO: 22890 - protein, 651 aa, Aeropyrum pernix
MEARSVERRREKPWEGEVYESTFPWLLEWRARTQPGRVAFRWKRYGIWRRYTWRDYYLRVAYAALALENLGLGPGDTGAFITFNRPSWVIYEVGVQLLGGRAMGIYRDSLSDEVGYLLDSGDAKFVLVEGQEQLDRVLDSGVDVDKIIVDEAKGLHQYRGMVGSKLVTFGDVMRLGRKLYSDGGDQQVKKLMGELEPDMVCGLFTTSGTTGLPKLAMISFKNMLAMAHQLNTVDPVREDWEYVSFLPTAWIGEQMMSIPYHMIGGFKVNFPETPHTLWRDFREIAPHFMFSPPRVWERIAKDIMARVDDADPIKRAAFRLAYKIGYEAARRRLVKGRSRPPTLWRALYYLAYWLALRAVLDKAGLKRIVRAYTGGAMIGEDYVIFYHSLGVNLKQIYGQTEVAGIAVVHPDDDVRPDTVGKPLPLTEVKIAEDGEILMRSPAMMKGYYKNEEATAKTIVDGWLRTGDVGVLTEDGHLKVLDRAKEIIILSDGTKVAPQVIQNKLKFSPYIGEAAIVGSGKPYLAALVNIDFEIVSRWAERRRIPFTSYSDLSQKPEVLQLLKREIEKVNRRLPEKERIRRFVSLFKEFHPDDEEMTRTRKLRRMVIESRYAGLIEAIYSGDEEYELTVTMKLEDGRRVQVTRRVKIIDVEG

SEQ ID NO: 22891 - protein, 529 aa, Aeropyrum pernix
MKYLTHAVATRVWCEASPAKPWEELWPPQAPRDVEALRERFTPIHEEIFKRSSREGCALIQGETGYCYTWKSLASFIERIGGWLQSKGVSHGAQVAVASENLIEAIAFSLAVLASGARLVLIDPLTVGEDLEWQLEGRRGLETLAASRGFLERNREAVSRIDNISTVIELSSNPQPLEVGGVEVLGLNEVLSSTAALEDDVEPDDDSFSIYYAGIAGRTMQAIHSHLGLWMGSKVFAATAGIDRETVSLLATPFTHVLGLQASLVAPLIQGGTVVALQRWNPRLAARLVSSLRINYLAGVPLMFQQLLDLGATSGLRLAISAGAPLPPELQRRFGRETGIPLLQAYGMSESLILTFQTPKIAEIEGTIGVPLPGVEVSLLGDDGLLSPPPGVGELVVQAPWVMKGYEFEEENSKAFIDGWLRTGDVIEITDRGVMFFRGVRKRIIKYKGYAILARDLEVILESHPDVLEARVWGEPAGDVGQIPVASVVLRAGSSVTPEDLMEYVNQRVSFYKKIRRVEVEGYRYSPAP

SEQ ID NO: 22892 - protein, 660 aa, Aeropyrum pernix
MQEGLEKKIWYPPRDIVDQSNVKLFMDKHGFKSYEELVRRSSEDLKWFWGNLPEWLGVEWFREPKAVVDLSRGVEWAQWYRGGLLNAAYNVVDRIVKMGYGHREAFTWVGEDGEVRRYTYLQLKDEVDRMAKLLSQDYGLGVGDVVAIYAPMMPESIAAMLAAMKVGAVASPIFSGFAPPAVAERLKLGEARVLVTVDGYLRRGRRIALKEQADQAVKLAGGAVEHVIVVRRLGIDVPWVEGRDEWYDRAIAGKAGSAEPEELDPEHPALLLFTSGTTGRPKGAVISHAGAILQPGKEHYFNLDIHPAWRGGEDRLWWITDIGWMMGPWQVLGSQLLGASHLMAEGAIDYPYKSRVWRLIQEHRVTHFGFAATVARMLRAVASDTVEDYDLSSIRAFGNTGEPIDHATWMWVMEKLGGWRRPLINLSGGTEVFGCILLPSPVVPLKPTTLWGPALGVDADVFDDEGRPVRGEPGYLVVKKPFPSMTRGLWKDPERYIKTYWSRFPGVWYHGDYALVDEDGFWYILGRADDVIKVAGKRIGSAELESVLTQLPEVAEAACIGVPHPIKGEVIACFLVPKGGYDAEELASKARKAVVDRFGKPFAPEHVVIVSELPKTRSGKITRRVLRDLARGVEPKELSVLENPEAVEKLRDIIKRIGGG

SEQ ID NO: 22893 - protein, 252 aa, Aeropyrum pernix
MLGGSRGLGFHAARALASLGCNLVIVARGREALEKSAKEISEGFGVDVEPLVGDLRKKGHVENAVIHAVQTFGRVDAVVAAYGNISREPLTLREAEWEDWIEAAALYLASTSSLFKALASYNTAKATVILLSSFTVAEPMDPLIVSDAVRAGLSRLVKSAARLYPDRIRPILLILGSFKTPGAMRTLERIARSRGESLENVWRREVEMLSPLARSGGLDEFEEVIRMLVRSPDYMHGATVVFDGASGRVSWP

SEQ ID NO: 22894 - protein, 726 aa, Aeropyrum pernix
MANSSVELRVSEAYPRDVGRKIVRIDRQTAARLGVEVGDFVKVSKGDRSVVAVVWPLRPDDEGRGIIRMDGYLRAALGVTVGDTVTVEKAEKVEPASKVVLAPTEPIRFGRDFVEYVKEFLLRKPISRGETIIVPVLEGLPLVVVSTQPAHFVYVTEATEVEIREKPVREEIERLRGVPKVTWEDIGDLEEAKERIREIVELPMKHPEIFKHLGIEPPKGILLYGPPGTGKTLLAKALANEIGAYFISINGPEIMSKYYGESEQRLREIFKEAEENAPSIIFIDEIDAIAPKREEVTGEVEKRVVAQLLTLMDGLKERGRVIVIGATNRPDAIDPALRRPGRFDREIEIRPPDKRARAEILKVHTRNMPLAEDVDLDKLAEMTHGYTGADLAALAKEAAMAALRRFIREGKINFEAKEIPATVLKELKVTMKDFMEAMKMIRPTLIREIYVEVPEVRWSDIGGLEEAKQALREAVEWPLKHPEIFEKMGIRPPRGVLLFGPPGTGKTLLAKAVATESGANFIAVRGPEILSKWVGESERAIRKIFERARQAAPAVVFFDEIDAIAPARGARFDTSGVTDRIVNQMLAEMDGIQPLSNVVVIGATNRPDILDPALLRPGRFDRLIYVPPPDKEARKEIFKIHTKKVPLGEDVDLEKLAEMTEGYTGADIEAVVREAVMAKLREKLEVGKVEMRHFLEALKKVPPSLTKEDILRYERLAKELKKLTLG

SEQ ID NO: 22895 - protein, 423 aa, Aeropyrum pernix
MEVLALQPTDPLEEARAQLRRAVDLLGYDDYVYEVLANPDRVLQVRVTIKMDDGTVKTFLGWRSQHNSALGPYKGGVRYHPNVTMNEVIALSMWMTWKNSLAGLPYGGGKGGVRVNPKILSPRELELLSRKYFESISDIVGVDQDIPAPDVYTDPQVMSWFLDEYNRVKRGQFFGVVTGKPVELGGLNARIVSTGYGVAVSTRVAAEKFLGGLEGRTVAVQGYGNVGYYAAKFLAEMGAKIVAVSDSRGGIYDPEGIDPEEALKVKRSTGTVANYQRGKKISTMEILELPVDILVPAAIEEVITDENADRIKAKIISEGANGPTTTAAEKILVKKGVLVLPDILANAGGVIMSHIEWVNNRMGGWITDEEALKKLEQKMVENTKTVITYWEKNLKPEENSLRDAAYMIAVERVFRAMKLRGWI

SEQ ID NO: 22896 - protein, 427 aa, Aeropyrum pernix
MDEGGVAVLNLVVKPSQIGGEIIAPSSKGHTIAALFASLLAGGRSKISEPLYSRDVDTAIYAVRRFGGLVQKGERDLIVDSPPRPWWPRVVNCRRSSTVLRHSIVTAALAPGISLVYGDSHTNSTPVSELAGALKKIGAEVVTTNGRPPVAVKGPLARGCCEGETVGASDGESLAALLLASPLLGFAIKRAGTHSWHHVAVALHVLRGFGAKISFDGGIYYPDKPYGPGAYAVPGDYVNAAPLLLAGAIAGRITVRRLDPEDPQGEKVFLNILAQAGAKLKAGESSVEVVGTGSLEGFEADVSETPSLAPVLAVLAAYAKGRSVIKGISHLRLKEGGNLKPLMSNLRRLKVKAKPRCGGDCLEVYGEGYVEGGTAKGYGDPRMTMAFAVAGLASRKGVRVTGASRYRDYYPGFVEDLRSVGAVIEAD

SEQ ID NO: 22897 - protein, 258 aa, Aeropyrum pernix
MAFPMPPHQTAYDRAATIFSPEGDLYQVRYAFEAVKKGWTSLGIKTNEGVVIAAEKRFIGPLVDIDDIDKIYKIDDHIGVAFAGMGGDGRILIDYARVFTVRHRLLYGEPPPVELVAKVVADVKQAYTQHGGVRPFGVALIFAGVNPDGTTKVYRTDPGGQYFSFKAIAIGSGEQVANEMFEKHYRSDMSLEEATKLALKILYAIIRKTVEDKEKAIATLPDQVELAYITVKERMFTKMTKEQVKEIVDSMREELLQL

SEQ ID NO: 22898 - protein, 835 aa, Aeropyrum pernix
MTLVKEKLSIKGMHCATCGLTVEKALRSLPGVVEASADPVTGEAVIAYEPGSVRLSDVVKAIRSVGYDVVLAEAVIRVPSMSSIDDERVVEETLLKMKGVAEVYASHTNKTVVVRYNPHATKPEEVLEALRKAGYKAEMAEGKSLVEAEAEEERRLLLDGLISITASIVYYILLALERLAGVEAAGAVLPYYGAVVFAIVLLGPGRRFLVGAYRSLKNGTPGMDALVSLGTLSIYFYSLAATLNIIRGELYYEGIGLIIGFVLIGRYIESKVKKGTGKAVENLAKLKPQKARVLRGRREVEVDVSEVKPGDLVVVRQGERIPVDGYVVQGKAYVDESVFTGEPIPVEKKPGDLVLAGSMVSSGWLHISATRTSGDTAIDRIARLIAYSQAGKMDIQRLADRVSGMFFWAVLCIASLTFTAWLFLGGLETAIIRAASVFLISCPCALGLATPTASSAGVGVAARAGILVRNVVAFERLAKASIVVFDKTGTLTLGMPRVAAVEAVDGYSEKEILELAASAEKWSEHPLARAIIDAYMEVAGRGPEDPDNAEVFPGMGVYAEVGGRSVVVGNRKIMDGFEVDIKTLEKIAEEWQSRGATTVFVAIDGKPAGVIAIRDEPRPEARETVDWLEKLGLKVMMLTGDSEGTARAIARELDIEEYRAGVSPEGKAEVIRELQKKGHVVVMVGDGVNDAPSLARADVGIAVANATDVSVEAGDIVLIKGDLRRVPLAVVISRKTYNTIKFNLFWAFIYNVTLIPVAAGAFAWAGITLRPELAAAAMALSSITVTSISYRLSKWKPRLPGDYETYDNKEEKEESKEEFERITREEKALAAGRQQ

SEQ ID NO: 22899 - protein, 461 aa, Aeropyrum pernix
MLRSEYDIIVIGGGAAGFSAVVAAAEGGASVLLVSEGPLGGTCVNFGCVPSKHVLYNLSTARKAGLKISLSEALEGARKVSETLRKEKYESLLDSLGVDYLRGRARFKAPGIVEADGREVRYRKAAIIAVGARTWRPPIPGLKEAEKAGRILDNERLFGEGPPPDMESVAVIGGRAQGVEAAQIFARSGLKTVLLQRSGRLLPRDEPEAGVYMKRVLEGDGVEVRTSARPLRVESVRGAVRIDYETPQGPASVEASYIYLATGRKPVLDGLGLENVGVRVSSDGFIVVNEKLMASPGVYAAGDCIGGIQLEPVAAREGYVAALNALGGNVEMDYTVIPRAVFTDPEFASVGLTERELARKLGVCACRTVDITQIPRARIMGYETGFVKMVVDPRTKKVAGVHMMAPQAAEAIHEAAFILKAGMTVDDVIDTIHIFPSISEGIKYAALAFYRDVSKMPCCLL

SEQ ID NO: 22900 - protein, 289 aa, Aeropyrum pernix
MGGAEESSPETLAYGGRRALARYGVAVVKIGGSIASRLERVADEIAVLAREGLRLVVVHGGGKVVDEYSRRMGVEPRYVLHPSGVRSRYTSWEELEVYVMVMAGLLATSISSELASRGLKVLSLTGLDGLSVEARRRERIVIVNERGRPQAIPGGYTGKIERVDSMFVGSMLQQVDVILYSPVAYGREGDRVVALNVDGDQMAASLSAALKAPLALVTDVPGVILDGRVVDRIRVSEAREIAAKAGVGMNRKILMAAKAVSEGSPYAAIGDPPIQSLINGEKGTLVTRS

SEQ ID NO: 22901 - protein, 355 aa, Aeropyrum pernix
MARAVRAGILGASGMTGGELLRILASHPGVEVEWATSREYAGKPVHTAHPHLRGFYTGLKYTSIDKIDIGEVDVVFNALPHGVGASIVAEAYENGVRVVDLSADYRLRDQSLYPKLYGFKHPRPDLLEEAIYALPEIYGEKLRGARLAAVPGCNATAAILAAAPLVASKIIDMDVGIIVDVKAASSEAGSKPSRHSIHPLREGSARPYTPWGHRHAAEAVQVLRDLVGRGIRLSLVPHAVSMTRGVLASAHALLRDNIGFSEAVRAYASFYKDSQIVRVKPMAPGLPVDPPDVKNVIGSMFAEVGFAVEEESGRITGFAAIDNLVRGAAGQAVYAMNAMLGFDEWEGLRSPPLRP

SEQ ID NO: 22902 - protein, 286 aa, Aeropyrum pernix
MSLTASILFLYDIARLDEKMLLEELRKRARVRVIHTAARALPLGEPPREAEEADLAVARGVSGRRLLYSALAAESWGLETVNSSHAIMASQDKVWSHMLLSRRGVPTPRSYTILDPQAVPYAAEAIGFPAVFKPARGSWGKLVSLLRDKSEASLLSEALEYVQGDLKLGLVQEYVDKPGRDIRSFCIGDTVPAAIYRYGSGFATNLAAGGRAAPAPVTGDVEDLTLRACEALGVEVGGVDIVESTRDGGLLVLEVNPSTEFKNTVRVTGVNVAALIADYVVSRVRR

SEQ ID NO: 22903 - protein, 388 aa, Aeropyrum pernix
MNVVLKFVRFYGYRGLRIVKGSMQYVWDDSGRKYLDCHAGHGAAFLGHSNPAIVEAVVRQARELVAASSSFSTPSLEEALTEFSRIAPPWAEEIVFLNTGTEAVEAALKAAWLATGKRGIVALKNSFHGRTLASLSVTWNPRYRRGVPVLDTRFLSPSTDPGEVEKLVPEDTAAIIVEPIQGEGGLTKIYAELAKALREAADRVGALLIFDEIQTGFGRTGRVWAHESLGVEPDIMTAGKSIAGGLPASAVLSREGVLATLASGRHGSTHAANPLSMAAVAAASRFLREEGVPDKARAAGALLEGLLRDRIEGLRLVRGVRGEGLMLGVELRLDPGPVLRCLQESERVLALRSGATVVRLLPPYSISREDAEMVVYGLERCICGGSGC

SEQ ID NO: 22904 - protein, 659 aa, Aeropyrum pernix
MGAGTMGHGIAELAAIAGFKVYLADINIDILNNALQRIRWSLEKLAEKGRIRESVETVMSRITPIVSVRDGEYSEDLAKALSESDFMIEAIPEKLELKQQLFAFADKHAKETAILASNTSSLPITEIAAATSRPEKVVGMHFFNPPVLMPLVEVVKGEKTSEETVAATVDLAKKMGKQTVVVKKDVPGFIVNRILGRLMESACLLVERGGYTVVQVDATAKYLLGLPMGVFELADYSGIDVFYYVFEAMSRRGFRSAKCSIFEEKFKAGEYGVKAGKGIYSYPAPNKYVKPNIPREEAKVDPLLLMALPINEAAWLLREDVATREDIDKAVKLGLGWPKGVFEYADEFGLDRVVEALERIKRDFGVDHAEPDPLLKKMVEEGRIGRKAGKGFYEYGEVEEKKMETLLVRVEKPIAWIVLNRPDKLNAISPKMIMELSQALDELEERSDVRAVILTGAGRAFSAGADVTAFAQVTPIDILRFSRKFQELTLKIQFYTKPVIVAIKGYALGGGLELAMSGDIRIASEDAMLGQPEINLGFIPGAGGTQRLARLAGPARAKELIMTGDMIPASDAEKMGIVNRVVPPELLEQEASSLALKLAEKPPIALAAAKYAIDFGLESNIWAGLQLEASLFSVLFSTEDVIEGVTAFLEKRKPKFKGR

SEQ ID NO: 22905 - protein, 444 aa, Aeropyrum pernix
MPGVPYRVDSVLAGNSGHTIDTLLLTFDDVAILPGLSTVEPHDVELSSRVSRSIFVSTPLVSSPMDTVTEWRMAAALARLGAVGVIHRNMPREEQARHVSMVKSVSPSPWSEVPRIRLPDGLENYSLILEELDAGAAVVFGDDGIKGYLVLERPDAQLWLEKARYLSLYLTRIRPFPTIDGEGRLVVGAAVSPFDLDRARLLEKSGADFLVIDVAHLHNRNALSSLSRLVKEVSIDVVAGNLGTREGVLDTLARAEEVAGLRMGISSGSICSTGEVAGAAVPTLTAVMNAVLALEELGLAGRIPIIADGGVRNAGDAAKAIIAGASAVMGGRLFAGADESPGPRIRVGDKLYKPYRGMASRGAMERRFAVDRYSRQAKAVEEGVEGLVPYTGPVVKTLYELAEGLKAALGYAGAQDVTSAWKAKLARVTPTGSREIRPHDILLG

SEQ ID NO: 22906 - protein, 346 aa, Aeropyrum pernix
MGGIPDITPYPLTYSLGGVIPLSSVLEMLWVEKYRPRSLDDIVDQKHVVERLKQFVKQRNMPHLLFAGPPGTGKTTAAHALAHDLFGENYRQYMLELNASDERGINVIREKVKEFARSRTPPEIPFKIVLLDEADNMTSDAQQALRRLMELYSSVTRFILIANYPSKIIDPIQSRCAFFRFQPLSKQDVIERLRYIAENEGVDYEEEALDAIYEISEGDMRKAINVLQAASYLGKVTVDAVYRVVGMAKPREVREMLATALKGDFTAARSLLRKIMIEYGMSGEDVARQIHRELFSTELKMPEELRVLAADYLGEVHYRLVEGSDDDIQLSAFLAWLTMMSRKLEV

SEQ ID NO: 22907 - protein, 338 aa, Aeropyrum pernix
MLGSLAAEKRSVFQTSCCVRYKGCMLGVGPTVWGVVWGLGCTVEARGLRKRFGGRTAVAGVSFSVGDGERACIMGPNGSGKTTLLRMVSGVLRPSGGSVRVCGYDVWGDGWREARGLIGFAPQDPPMARRMTGAEYITVVGGLLGLSPGVARREARRVLEMLGFEDVLGRVVARLSGGQRRALGIALALASNPEVVVLDEPGSGLDVRARESLWASLRKAFKGRTVLFSSHDPQEAEAESDRVLIMHRGRLAAWGKPRELIQRYAPKPRVRVWADRAPDGLEPVHTGPGFSDYLIEAPGDVARIASAYSGAGILVERIEVLKPSLREVFFAVTGEEMD

SEQ ID NO: 22908 - protein, 289 aa, Aeropyrum pernix
MEPPEGWVPVEVRSVGMCGRDLVVWKGGFPNLKPPLVLGHEVFGLHDGRPVSVYPAIAVPGCPDCPPSILGENLPGGYAERVYVPRENLIPLPDTDFNKYAAATCGVATMMHAASVASVRPGERVLVTGASGGVALHGIQYLQLLGAEVVAYTRSREKARVLEEELGVEAVTSLDFYRERGRVDVVMETVGAPTINESMRALRPRGRLVLIGNITGEPVTIKRPALLVMREITISGTAAFTRKEWEAAIKTIAKGGVKPFYKAYRLDQINNALKEALQGARIGRIVINP

SEQ ID NO: 22909 - protein, 870 aa, Aeropyrum pernix
MIPSDFNSLPYSIRVLLENVVRHYDGFVVRDEDVEAVARWSEYAGRKDVPFHPVRVVMQDFTGVPAVVDLAAMRDAMKQFGGDPSKVNPLIPVDLIIDHSIQVDYYGTAEAFRLNLKREYERNRERYQLLKWAQKAFSNFRVVPPGKGIIHQVNLEYLARVVWLSRRNGTLYAHPDSLLGTDSHTTMINGLGVFGWGVGGIEAEAVILGQPYYMLLPEVVGVRLVGELREGVTTTDLVLYITEKLRKKNVVGKFVEYFGEGVKKLSVPDRATIANMAPEYGATMGFFPVDEATLEYLRGTGRPEWLVQLVERYTKETGLWYSLEDPEPRYSDVVEIDLSDVEPSISGPSHPEDRIPLREAKERVRKIIMEYLEKKGRGPAIVELKLGDEEVHLTDGSVVYAALTSCTNTSNPSVMIAAALLARNAVKKGLRTRPWVKTSNAPGSRVVPEYWNRLGLMPYLEALGFHITGYGCTVCIGNSGPLRPEIEEAIREHDLWVATVLSGNRNFSGRIHPLARGNFLASPPLVVAYALAGRVDIDFEKEPVGYDPNGNPVYLRDLWPSQREVREAIEKALDPQLFVEKYKDIDKGDKFWEELKAPEGELYSWDPKSTYIRKPPYFDNMPLEPQPPRDIRGARVLVWAPDRTSTDHISPAGRISPDSKAGQYLIEQGVPPSQLNTCGSRRGNHEVMMRCTFDNPRFRNKLVPDREGGWTIFWPTGEVMHVFDAAMKYREMGVPLIVLAGKQYGVGSSRDWAAKGPALLGVKAVIAESYERIHRSNLVGMGVLPLEFMPGENAEKLGLDGSEEYDIIGIEEGLSPGKILTVRARKSDGRVIEFKVKARLDTPIEVEYYKHGGILQYVLRKLIREHGRGN

SEQ ID NO: 22910 - protein, 338 aa, Aeropyrum pernix
MGAIIVDGASRITALNPLTIYLSGGRVETGSRARDLYLLRPPEPVFGIQRSREESLFSVIGVPYDSTSSFRPGQRFAPREIRRASIELESNGYYVEGDIDRVPIADEGDVAAVPGSTLLTLERVARVVEDLAREGKVPVVLGGEHLVTLGALRGLAAAGVKPCVVVLDAHFDLRNDYLGERFSHATVFRRVLEELGVKLLYIGVRAYEAGEERLAVESGLIDYVPMRRMDIVGVDGAVLAARRFTGDCEKIYISIDMDFYDPAYAPGVGNPEPGGASSREGLALASQLGDRRVCGIDVVEVSPPYDPGGATSLLAAKTLQELLISVWQRWGVGRSASS

SEQ ID NO: 22911 - protein, 335 aa, Aeropyrum pernix
MAGEPRLGRTGPRVSRVGLGLWQFGSPMWGGKALSADVLARGLSIAVEEGINLLDTAEVYGMGSSERMLGEALKRLNAREDFVIVSKVAGFRSTAGDIVKGARGIAGRLSSAPDVILHHWPPPVYSRLCSVVRGLEQAVNEGLASYYGFSNYGEDLLGDALSCTRRLEPVADQILYNLAYRTPEQRLIPLLHQHGMTPIAWSPLAKGALAGFKGEPTRAQAGDPVFRTALEDTGLQEVLESVARRLGASKASVALAWVAYKGAVPIVGWRRPERVREAAAAARLKLSEEDVALLDEASKRYVTLWGSSYSPPGLRRIRLIPGALQRLAIRLWGGI

SEQ ID NO: 22912 - protein, 162 aa, Aeropyrum pernix
MIVVEGEGLLVRKIRSGVVIDHIPPGRAFTMLKALGLLPPRGYRWRIAVVINAESSKLGRKDILKIEGYKPRQRDLEVLGIIAPGATFNVIEDYKVVEKVKLKLPEESQGVLRCPNPTCITRKEREKAVSKMVLVSQDPPAYRCVYCGTTVMGDEIHDLISP

SEQ ID NO: 22913 - protein, 312 aa, Aeropyrum pernix
MASRVAGNPFKGRDVISITDFTRGDLELLFRQADVIESKAGSKPLDGKVVALAFFEPSTRTRLSFETAVKRLGGSTLLISGEEAISVAKGENLADTITMLDSYADAIVIRHRYEGAALYAAEVAEKPVINGGDGRQHHPTQAMLDLYTVYSLFGTVDGLTYGVLGDLRYGRAASSFILGLSLFNPRHVYLISPPQLRARREVLEALEKRGVPYTEVERLQDVLGELDVLYVTRIQKERIPDPREYESLRGSYRVTLDLLESFAKESLKVLHPLPRVDEIDFSVDSSRYQAYFTQARLGVRVRMALMNLVMRG

SEQ ID NO: 22914 - protein, 467 aa, Aeropyrum pernix
MAGLERFDLVVVGGGPGGYPAAVRAAQEGLNVALVEMDSLGGECTNYGCIPTKALLHPAGLVASLARLKFVKGSVDVDFKGLMEWVDSVVKGVSNGVSTLLKGYGVEVVKGRAKIRPGVVEVDGSGSIGYSKLVLALGTSPASIPGLEPDGEVVHNNRTILGLRRKPGRMLIVGGGYIGVEYATAMARLGVEVTIVELLDRLLPNMQRDFSRVVERRLRAEGVKIHTKSKVEAVERRERYAVVEVSGVGKMEYDAILVAVGRRPNTGDVGLEKLGVKLDKAGYIQVDGATLETGVPGVYASGDVTGPPLLAHRAFLQAVVAAERAAGDSSAAFDAKAVPAVVYTDPELATVGLTLEEARAAGVDAAETRLPLASLPRVGAIEGCRECFAKVVYDRSSRAILGFHVAAPHASEIIAEAALAIEMGATLEDLALTIHPHPSVSEALKEVAELALERPIHYILRRGGARR

SEQ ID NO: 22915 - protein, 412 aa, Aeropyrum pernix
MGRIVQVKLPDIGEGIAEGEIVEWLVEEGAVVKQFSPLVRVLTAKATVEIPSPYTGRVVRLLAKPGDVVRVGDPIIEIEVEEGEAPKAPEAAEKPSATVEPPKAEEAAAPPPQAAPAILVRAPPRVRRLARQLGVDLARVRGTGPRGAITEDDVRRAAAMLATAPKPEAPPPVAEEAEERIPVRGIKRSMAQSMSLSKSKIPHAYIAEEVDFTELSKLREALKRDAEEKGVRLTYLPFVFKAVAKAIRKYPLVNSEFDEEKMEIVVKKAVNIGFAVDTPHGLVVPVVKNVEKKGLFAIAREIADLTAKAREMRLSLEEVSGATFTITNVGSIGSVIGFPVIYPPNVAILGVHRLVERPVYVDGELKPRKIGFVSLSFDHRALEGAYATRFLMEVKRLLENPALLFAEDYEFR

SEQ ID NO: 22916 - protein, 325 aa, Aeropyrum pernix
MPVMNMVQALNTALREEMRRDKSVVVLGEDVGRRGGVFLVTEGLIDEFGEERVIDTPLTEMGIVAFAIGMAMYGLRPVAEIQFIDFIYEAFDQIVNNAAWYRFRSGGMYNVPLVIRGPCCGGIRGGMHHSQSNEPYFIHTPGLYVVMPSTPYDAKGLLKSSIRSDDAVIFLEPKSIYRTIREEVPDNDYTIPLGQARLVQEGSDVTLVTWGAMVHLAKEAAELLREKRGWSIEIIDLRTLQPWDKDMVVKSLEKTGRLVIVHEARKILGPGAEIAAYISENYIDLLRGPVKRVASYDTPYPLAHEKLYLPNLAKIYRAVTEVMQW

SEQ ID NO: 22917 - protein, 431 aa, Aeropyrum pernix
METSGIGWPKCVAVFIRLYLGWINRLLAITIKAGLNMSKTGLIDTPFKPVEKNVVEEYKTLLEDALGFKRAVDEEGRVVDEELLPKVSEGEIVEIYTYMVRARVIDSWLLKLQRMGKVALHAPNKGQEAVAVGAAKPLRRDDWVFPSYRELGAYLVRGMSEEEILDRALANADDPLKGSDFAIFGNRKYNLVPAPVPVGNQIPISVGAAYAMKYLGRDTVTLTFFGDGATSRGDFHAGLNFAGVFKVPAVLVIQNNQWAISVPRARQTAAPSLAVKGLAYGVPGVRIDGNDVMVVYKIVSDAAEKARRGGGPTLIEAVTYRLGPHTTADDPSRYRTSEEERIMERYEPLRRMRKFMESMGILTEKEALSIEEEWNSKVEEIVRKVLAKPPLPENVFFQNVYGEKPWFIQEEERDLEETLKTMEELGLSYKE

SEQ ID NO: 22918 - protein, 393 aa, Aeropyrum pernix
MRLCMSTSQAIFPWEGDNVRAVRESVREFAEKKVAPKAREIDATNTVPESLLREGAEMGFFALRVPEEYGGPGLSLLESVVAIEELSRASSGYGLIAVVSGSMVVHPILKFASEEVKEKYLSRLAKGAIGAFALTEPCCGTDVASLHMTTAKREGGEYVVSGQKIFITNSAYADFFIVAARTGKLEERHRGISLLIVDRSDCVEVSKLEMMGYRGSGTSIVYFNDCRVPSENLIGQEGGGFKLVMHTLNEGRISTSASGLGVMQAAFDAALKHAGERESMGRPIIEHQMVSSMIAEMLVRLETSRLLVYTAAHKLDTNSPDYIKYASLAKLHTATAGVDLVRMAMQVLGGIGYSRESDVERYYRDIKMIEIGDGTNEVQRMVLTKFLQGRIRP

SEQ ID NO: 22919 - protein, 394 aa, Aeropyrum pernix
MSQQPECRVEGNYIIVPKGLVNVIVDETRISGVDPKGEATIYRGYTIEDIGEHASFYEAAHLILFGRLPCDEELKEIKSKIDKYRGQIPEKLFDAMKHVPVTHPMYYGIYGTALLGQYYAPEWRFDEDFLYDHALRLTAQLPVIFTTGWNLAHHGTFLRPDPSKDHAWDVLRMIVMREPSDIEARAFESTLVLYMDHGFNASTFTTRVIGSTLSDLYSAVAGGIAALKGPLHGGANEKAMEMFLDAMKKAEEKGVPLYDYIEEYIKEKLARKEKIMGFGHRIYKLHDPRTDVAAKFVAKLKDGEFWMKVLKKAEEVMWREKKIPANIDLYTAVLYYQLGIPIPMYTPIFAMGRVVGWSAHYIEQVLNNKLIRPTEKYVGPTGLKYQPIEERCRK

SEQ ID NO: 22920 - protein, 337 aa, Aeropyrum pernix
MGVSVLKWDRLFEASSRYSMLIDHYIMDFMSITPDRLSGASLHLIKAGGKRLRPLITLLTARMLGGLEAEARAIPLAASIETAHTFSLIHDDIMDRDEVRRGVPTTHVVYGDDWAILAGDTLHAAAFKMIADSREWGMSHEQAYRAFKVLSEAAIQISRGQAYDMLFEETWDVDVADYLNMVRLKTGALIEAAARIGAVAAGAGSEIEKMMGEVGMNAGIAFQIRDDILGVIGDPKVTGKPVYNDLRRGKKTLLVIYAVKKAGRREIVDLIGPKASEDDLKRAASIIVDSGALDYAESRARFYVERARDILSRVPAVDAESKELLNLLLDYIVEREK

SEQ ID NO: 22921 - protein, 252 aa, Aeropyrum pernix
MVAVASPGSRAPCGSAVVKLGGGLITFKDKPYTIDRAMLERTASQLAAYSKGTGRLAALVHGGGSFGHAAVAEARAQGGLTPRAAPRVQLAMLKLAMEVAASLLKYGVEVSIHPPHTFCSGGECVLETLKRDYRLGLTPMTFGDAVPADGGVEIVSGDDLALWLAVELGVECLIYATRVPGVVKGGRVVPVIRGLGEFEDLGSGDATGGMARKVKAALEASRRGVSRVVIVGGDMLLEALRGVNVGTRVDAR

SEQ ID NO: 22922 - protein, 485 aa, Aeropyrum pernix
MFKTFVAGNWVLTSNLAVVRSPIDGSIIAKVSRLDAAAIEEGVDVVYRLGRRRIRDVPGEKRLNILSRIADLLEKNAGDFEEVLTVNAGKTRKQAAGEVEASIDRLRKAALDLRKLQGEYVPGDWDRHTLESEGIVRREPYGVVLAIIPFNYPLFDTVNKFVYSTIPGNAFIVKPPSADPLPVIMFARLAIEAGFPPESLMIATLRGSEAEKLVADRRISVISLTGSSETGVKVMRSAGIKQLIMELGGGDPAIVLADADLKSAASKIATGITSYSGQRCDAIKLVLVEEPVYNEMKKLLVEELSKIKVGDPRNDSTTMGPLIDKEAVDAMVEAIEEAVSRGAKLLYGGERIGDTYITPALVEVEDKNVLRELKLYKDEVFAPVAVITSFSTLDEAIELANGRRYGLDAAIFGESMARIRKLIRFLEVGAIYINEYPRHGIGYYPFGGRKDSGIGREGIGYSIEYVTALKTIVYNYRGRGIWEYL

SEQ ID NO: 22923 - protein, 673 aa, Aeropyrum pernix
MVAEKPKAAAKIAYALSDGRGVLRCSEYGVPYWIVRRDGAAIVVAPSAGHLFGPHTDSRGFPVFDFEWRPIFEFDRGAGYLSKFYRMLSRILPGASLYVNACDYDIEGSVIGFKIIEAFGDVNRARRMKFSTLAPQDIRRAYARMERLDVEMIEAGMARSEMDWLWGINVSRALMEAARRAAGRRVILSAGRVQSPTLVEAYRRWREINLHVPKASVAVKITAEKGGGVFDARPHGWKPQSLETARSIKSELRKNPWLAVEEVRSERSILRPPPAFNLGDLQKEANRILGLPPLRTQSIAEELYLEALISYPRTNSQKLPPSINYRAILDKLAHGPLGREARELLKETGGVLRPVQGSKDDPAHPAIHPTGEKPSQRLSKEHMAVYELIVRRFLAAFSREAIVSKSSVLLRDFQGRVWRAEGLRVEDLGWLKYYHYSTPGEKPMPPLDRGDKARVVRVDVRVEWSQTPVRLDKASLLRWMESVNIGTEGTRARIIETLYKRGYLEGSRKSEVTPLGEAVAVIIQTLFPELSKPDLTRRFESMIEDIRSGRRTRQEVIDMSKKTISKLLESFLDRLDTAVREIGVSLGSVEVEAACHLCGRKAVSAVSGYRLCSHHMEAFDRLRKALPNLASTISSTPREALEAIARGRSRAGAWVRDVAALALRDDGLYKALL

SEQ ID NO: 22924 - protein, 451 aa, Aeropyrum pernix
MLCGCRFMGKYVERAVRVFLNTGTRFPERIVWAIGMVKYSAAKANMELGLLDEKRASAIMQAALEVAEGKHSDKIVVDVFQTGSGTGLNMNVNEVIAERASEIAGVDVHPNDHVNMSQSSNDVIPTAIRLAAASAVLSELVPSLETIINSLGSAEAKYARVVKPGRTHLRDALPVTFGQEMGAFKDAFSKDLAMVREALEAVLEVPLGGTAVGTGINAHPEYPRRAVSILAEKTGIPVKPAASRFRAMRLVTDLAMLTAAVRSVAIDLWRLSQDLRLMYSGPFTGIAEVEIPQEVPGSSMMPGKVNPVTLEAAMQAASYAIALDSSLVQASLLGEFELSMGLPLAGYAAVRQAEIVAEALRKTAGLVIGRVEPRVERMRELAERSQALITLVAPIIGYEKAAEVSRMLYEGRSIREALKAVGLGDEAIEKLLDLEKLVKPGIPSLEVGRKD

SEQ ID NO: 22925 - protein, 345 aa, Aeropyrum pernix
MAGAMIEARGLVKRFVSGRIRRRVVEALKGVSFSVYEGEIYSFLGPNGAGKTTTVRILSTLLDPDGGEARVAGFDVVKERWEVRKRIGVMLSVERGFYWKLTGRENLYYFGRIYGIPQGELKSRIKEVLDLVGLTDLGGADKPFEEMSLGMKARLGLARVLLKDPEVLILDEPTLGLDPASARTIRGVIRSLASEGRTIFITTHNMVEAEMISDRVGIIIGGRIAMEGTPDELKRRVFSSINLEFRVKASGHAAKKFFYDVKGEYGNRIVGGVTFSDGILTFRVSVNRDEPAEPIIDRITRLAYQYRFKILEIKALEPSLEDVFVAVSESGEARSGRVKGSIAQR

SEQ ID NO: 22926 - protein, 322 aa, Aeropyrum pernix
MLDLEWTALGWLLLEGPEQWVIVGGWGSASAEFSEGLSRNMGLKLVKPVFKLFPDEEEYVRIEGDISGFTGAIVVQSFERPASRSLVYSLLIADALKEAGVGRIVLMAPYMGYTRQDRVFLPGEPVSVRAVMRALASSGYNALASIEVHKEYVLDYFDGSTLNIFPFTYMLKETGISCGDNTIIVAPDKGSLPRVERLARETGCRSYGYLVKERDRITGEVRLAKSTVDPRGKNAIVVDDIISTGGTIALASQWLLENGANSVFVLAAHYLGIGNAEEKMMKAGVSRVVTGNTLPRKPSKIVTYVDLTGLAAGQLTKLVSNL

SEQ ID NO: 22927 - protein, 437 aa, Aeropyrum pernix
MAEKPHMNLVVIGHVDHGKSTLVGHLLYRLGYIEEKKLKELEEQAKSRGKESFKFAWILDKMKEERERGITIDLTFMKFETKKYVFTIIDAPGHRDFVKNMITGASQADAAILVVSARKGEFEAGMSTEGQTREHLLLARTMGIEQIIVAVNKMDAPDVNYDQKRYEFVVSVLKKFMKGLGYQVDKIPFIPVSAWKGDNLIERSPNMPWYNGPTLVEALDQLQPPAKPVDKPLRIPVQNVYSIPGAGTVPVGRVETGVLRVGDKVVFMPPGVVGEVRSIEMHYQQLQQAEPGDNIGFAVRGVSKSDIKRGDVAGHLDKPPTVAEEFEARIFVIWHPSAITVGYTPVIHVHTASVSSRIIEIKAKLDPKTGQVVEQNPQFLKAGDAAIVRFKPVKPLVVEKFSEIPQLGRFAMRDMNRTVGIGIVTDVKPAKVDIKAK

SEQ ID NO: 22928 - protein, 1169 aa, Aeropyrum pernix
MSNKGGGQRSGEIGVDELWTVYKSFIRETGLARQHLDSFNRLVTQEIQKIIDSIREVRPQWRIYAGRRRYRRGRFEEHEIHLPDVKIVFGKARFKEPMAREVIESFDRRVTPFECRVRGITYSAPLMVEMTIVQDNMIEKTREVKIADFPVMVKSVLDPLSKYDEETVIEMGEDPGDPGGYFIINGSEKVIVAQEDLAVNRIIVNKSTAATARITHTAKAVSTVLGLRRQAIVDRMSDGTLEASLSRLRYRIPLVVLLRALGLEKDMEIMLAVSADPDVQREMLPSLEKGRALAPTKEDALKYLGNRIAPGQPLDVRIRRAEEFLDTQLLPHLGNRPEDRIKKAYFLAEMANRVLQLYLGKRGEDDKDFLGNKRLRLAGDLIAELFRESLEALANTMAQKLEEQLAERRQIRLDFLVRPTIISDRLKGAIATGNWGQDRTGISQQLDRTNWISLLSHLRRVISPLSRGQAHFEARDLHGSHWGRYCPFETPEGINCGLVKNLALSAYISVGVDESVVEEILVKDLGVAPLERILEEAKQAGEPPEIMLKGTKVFINGRPLGYHPNGAELARKIRELRRSDKLEVERPWEVSVYHLREGEIDELYVNTDSGRLMRPVVVVENGEPKLTREHVEKLSRGEITFWDLVKQGVVEMLDPEEEQNALIAELPWEVTKEHTHMELWVPAIVGVAAATIGYLEHNQSPRNTYQAAMAKQALGVYALNYRIRLDSHSYLLQYPQVPIVQTRMLDIMGYNERPAGQNMVVAIMSYTGYNIEDALIFNKGSIDMGLARAYFFRVYTGIENEYPGGERDRITLPKPDEVYDYRGAAAYAKLEADGIVAPETEVEGGEILIGRVSPPRFLGEGRVISMATVRRRDTSIPMRLGEKGVVDMVVISTTVERNKLVKVRVRNLRIPEIGDKFASRHGQKGVIGMIFPRYDMPYTEEGIEPDVILNPHAIPSRMTVGQLLEEIAGKLGAIKGRFVDATPFFKEDIDGLRIELLKEGYDPNAREVMYDGRTGQIIEAPITIGVAYYQRLYHMVADKIHARATGRVHLLTRQPTEGKARQGGLRFGEMERDCLVGHGASMLLRDRMLDNSDAYVMYVCNTCGNIAWFNRRKKVLECPIHGEEGDIRPVKVPYAFKLLLQEITSMMIKPELKVADKISVIRKVVGDYT

SEQ ID NO: 22929 - protein, 222 aa, Aeropyrum pernix
MLITLLKGFKGCQVGGVAVVSEEISFVKEIDTGVEGLPKPEVKIENIVATVILENQLDLNLIETKIQDVDYNPDQFPGLVYRLESPRVTVLIFKSGKMVITGAKSINQLIHVVKKLLKAFADQGIPISGKPQIQIQNIVASANLKVYIDLEKAALEFENSLYEPEQFPGLIYRMDEPRVVMLIFSSGKMVITGAKMENEVYDAVKKVARKLKEADAIIGIAE

SEQ ID NO: 22930 - protein, 421 aa, Aeropyrum pernix
MGSSSGQKPRRLEDLVDKLASGSLSHSRLEKELGNANEAALVRRLYLERLTGASLSSVASTILDFQELYGRNIENPIGAVQVPVGVAGPLRINGDYARGDFYIPLATTEGALVASVNRGAKAITLSGGARAKVIKDGMTRAPLLWTPSVYEAHRLAMWVEDRIEDLRSVVAGVTRHGRLQHIYPYIIGNLVWLRLSFSTGDAMGMNMVTISSDRICRYIEENYDGDAKCIALSGNMCTDKKPAAINKILGRGKYVVAEAVIKGEVVKNVLKTTPQNINLVNVTKNLLGSAAAGSHSFNAHFANIIAAIFIATGQDAAQVVESSMGYTWTEVRGEDLYISVTLPSLEVGTVGGGTRLPTQRELLALLGVAGGGNPPGSNALKLAEIIASAVLAGELNLLSAIAAGQLARAHELLGRGGLKIS

SEQ ID NO: 22931 - protein, 365 aa, Aeropyrum pernix
MVFRMPVDSLVGKTPESSAGIHGWGAYVPVYRIPTREIARVWGWPDHQWKALDVYEKAVGGVDEDSTTMGVEAARNAIARARVDPASIGAVFFGSESKPYAVKPSATIIAEALGITPVTMASDLEFACRAASEGMRASIGLVASGVVGYTLVVGSDTAQASPGDVLEFSASSGAAAFVIGPSKGAAAVFESSFTYVTDTPDFWRRGLKPYPSHGEGFTGEPAYFHHIESAVKGLFEKTGLSPGDFDYAIFHQPNGKFPVKVAKKLGFTMEQVKPGLVTPFIGNTYNASALLGLVKVLDVAKPGDRILVAPFGSGAGSDAYSLIVTDAIEEAKPLAQPLEYYLKRRIEIDYGVYAKIRGKLVVRKL

SEQ ID NO: 22932 - protein, 191 aa, Aeropyrum pernix
MNREAQGSQEGVRIRKARAQDIPIVMEINLESLPENYWYGFYKYILDNWGEAFLVAEVGGEIVGYAMSRVEQTSDPVLLGMKDELEGDKSVIDKILDAIRNQLSEERPVGHLVSIAVRPGFRGRGIGSKLLSATVRVMKNVYRVDAIFLEVRVSNMPAIRLYEKFGFRKVRRIKGYYRDGEDAFVMVKRLL

SEQ ID NO: 22933 - protein, 272 aa, Aeropyrum pernix
MPLFPIDYNDFKPIGKTKERLSAVGLGTWAIRDYSSALESYVYAIERGINHIDTAEMYGAGEAERFVGKVLRSVGRDRVYVVTKLYPFRFRDPDEAVKAARASAERMGVSYVDIILIHWPDPQTPIKDQVKSLEAIAEAGLARYIGVSNFSKEQLEEALTATKKHEIVVNQVKYSVLDRRAEELIPLAVEKSILLEAYSPLERGHVAEVRLLAKIGRQYGKTPVQVALNFIVSRPNFIAIPKAERREHVDEILGSLGWRLKPEDIELIEEKL

SEQ ID NO: 22934 - protein, 399 aa, Aeropyrum pernix
MMFSLGGPRLVDFVFPRRIVYNESLPRALETLLGDKGVKHVLVVTDGKVAAMSWFKEAVEHVASLGVEVCIFDGVTPEPEFDVGDAIASEARRCRAEAIVAVGGGSVIDAAKAGFVKFVRPDADLEGLAPFNYLGLEDSGIVLVAVPTTSGTGSDASYGIVLTKRVNGGREKIAVGSYEVVPYASILDPSITLGMPERLTVGTAVDALAHSVEAIASTNANPLSDALAAKAAEIVFRRLPEVVNDPGNYDARAEMHIAATMAGMAFTNSGLGLAHAIAHPLGARLGTHHGATVGMVLPHVVRFNESRSDYARRKYWELKLLLESLLGLEERGSLADHIEELYARVGQPTRVRELAGIERERYLTLADEVAEAAFRDPELAFNPVMPTMEDVKTLLYNMY

SEQ ID NO: 22935 - protein, 402 aa, Aeropyrum pernix
MSACLTLSHLGATLIPNSSHSHSATAPGSTPRSSSLFTSLSFTTLSLGPNPSHPSTVEEALGPLIQSILCRGTNITSRRLQLQLWWEGLSLHRLRGRHLLWLADYTGEEIRHMVELTLEMKRRYYAGERVIPVLRGRSVGLLFEKPSTRTRISLEVAVAQLGGHTVYMTPSETQLGRGETVADTARVLSRYLDAIVARVRSHKTLEEMARHASIPVINGLSDLTHPLQAIADMATILEKKGRLEGVKLAFVGDGADNVLHSLLLAGSKLGLHITVATPPQIRPDERILSIALKAAEESGGSVEIVSDPYEAVRGADVVYTDVWVSMGQESMAEEKVQLLKPYQVNAKLMEATGGRAIFMHCLPAKRGQEVTDEVIDGPWSAVWDQAENRLHAHKAVLSLLVP

SEQ ID NO: 22936 - protein, 409 aa, Aeropyrum pernix
MTLSSAGGSRSHRHNGGHSERDVEIRILKDKVRSLTKEKISLQKELEYYKNEITKLLSPPYIEAVVLEVIDDNRVVVKSSTGPNLIVNVAAGVDARSLKPGAIVALNNRGSTIVDVLPGRYDPLVKAMEVEERPKVFFKDVGGLEEQIREIYEAVVLPIKNPHLFRELGIDPPKGVLLHGPPGTGKTLLAKAVAGETEATFIRVVGSELVNKFIGEGARLVREIFRLAREKAPSILFIDEIDAIASKRVDIGTSGDREVQRTMLQLLAELDGFDPLDNVKVIAATNRLDLIDPAVLRPGRFDRIIEVPLPSLRGRLEILGIHTRKAKMAPDVDLEAIAKLTEGFSGADLKAVVVEAGYNAIRRGSRVITMDDMIKAVEKVKAALDKRGGGDPFIRAQQKSGDDTIATVI

SEQ ID NO: 22937 - protein, 384 aa, Aeropyrum pernix
MERCGDEWVLGSGRRHLGGLQEGWRALRGRVHGGRPPPGALDLSSPSNPLGPPPRVDNIILEAVERGVHTRYPDYEYLGFREAVAGFYRIDLERVIPLNGAAEILPLAAAALRPRSIVVVEPNFGDHTILALSAGIPCHSVQLREAGDRFSLEPGAVCSLPRSVVEGSLIVLSNPNNPTGSAAARGDLRELAACATLRGALAVVVDESFADLSRVESVLGSVPEGVIVARSLTKTLALQGLRIGFAYTDDAALAARLDMARQPWNVNSIAALLVERLLGDMASEVKGHIARAIEAIEGLKPRLYSAVSALGAKPYSSQAPFILVRHRRRNPLFARCLLEAAGVYIRDASSFRHLTPYHSRISVAPGVERLERLQEAILDCLSGG

SEQ ID NO: 22938 - protein, 339 aa, Aeropyrum pernix
MFVMIIQGQVLGGYPRSRYVRRALRRLEQGEISAVELMGVLNQASSAVIGAQVSQGFPYVVDGMLDWHDIFRPFAEAWRNVTPTGLLRYFDNNFFYRIPLFTGEPEPTDPVLAPRVLSYSQVAEPAKLKVVVPGPVTFTLMSRNESGISDEELAEAIANLLADEVEKAVKAGAGFVQVDEPILSEPKATRDHALLAAELAGVIASRSGSAETMLSVYFYPPKPEVYEALLEARVDYLMVDLVAAGSKGLEVITGKGAGEGLALGVIDARSIYSESLEKVEAPVRRIVESVKPEKIILTTSTWLDLIPYRYALRKTALLGRYTYALAEKLGAQIAVAGGE

SEQ ID NO: 22939 - protein, 368 aa, Aeropyrum pernix
MEEKIQALEEFISAVPKHKGTENLLLWARRRLAELREELEEKRKRRVGGGPSFFVEKSGAGQAVLIGPPNSGKSSILAALTNAKPEVADYPFTTRMPRAGMLPYEDIQFQIVDTPPLLPGSGSSVNNRVLGLARNADAIILVFSLDDPNLVETIDAVVREVEDRGIVITRRRGLARIMKSREVTGVRIEGPGRLTDATEDDVRRLLSQYRIYNAIVYIEGDVSLDDVESAVYINLVRKPALAILNKADLPGAREAAEPAVKRLGEIGIDTIVASALRGDGLGEIAPRLFRMLDIVRVYTKQPNKEPDKDPLVLHRGSTVMDVAKHIHKDLVRRFKYARVWGKSVKYPGQRVGPEHVVEDGDIVEIHVR

SEQ ID NO: 22940 - protein, 392 aa, Aeropyrum pernix
MLGGLRRVEDLDSDPPPRGSRIVMVMDFHPSSVGGVQSHVRDLTRLLQDFGYDVVIVSRALGKGDVKDLEAEGHYIVKPLFPLEIIFVPPDPSDLRREIESLKPDVVHSHHIYTLTSLLALKAARDLGLPRIATNHSIFLAYDKVALWRIASIVLPTRYLLPNAQAVISVSTAADKMVEGIVGDSVDRYIIPNGVDVERFKPSTPKADYPLVLFLGRLVWRKGAHVLVRAFRHVVDEIRDAKLYIGGKGEFEPIIKLLIARYGLENNVKMLGVVPESEKPSLYSSAWVTAVPSIVNESFGIVALESLSSGTPVVASRQGGLKDVVKHGKTGLLVKPGSSKELAKALITLLQDSGLRKRMSEEARKIVLERYDWRKVVPQILKVYGHYMEARG

SEQ ID NO: 22941 - protein, 389 aa, Aeropyrum pernix
MGWVTRWVRGGWRPSKDPVREPVVPPVNVSAIYVHPPGSFEREYPRVGDLKYGRENNPTVLGLEEALTSLEEARWTLAFNSGMAALSTLVLHEVSRGAKKVLLERLTYGSTRSLLEMLSSITGIEVRLAGPPWEDLLDLVCWADLIIVESMANPTLRVPPLSGIYREAGSCGVRVVVDNTFATPIAYRPLERGAHYSLESLTKYIAGHNDVVGGSLSGRVEEDLEPLWNMRKILGTIMQPIDAYLAWRGMKTLKARFEAQSRAAVEVAEWLESHRKVKKVYYPGLSSHPDHELARRELNGLYGAVVSFEIEGGREEVFKLLSRLKLVTPSPSFGGVETIISYPAISSHSNLDPLERSELGVTDGLLRLSVGLEDVSDIIDDLSQALSAI

SEQ ID NO: 22942 - protein, 555 aa, Aeropyrum pernix
MVDRVIEMAIQQQPMTEPVGIPVIILKEGTQRSYGREALRANIMAVRAIAQILKTTYGPKGMDKMLVDSLGDITITNNGATILDKMDVAHPAAKMLVQISKGQEDEAGDGTKTTVIFAGELLKEAEKLLDINIHPTIIVEGYKEALRKASEVIESIAEPVSYDDVEKLKLIAKTSLNSKAVAEARDYFAELAVEAVRTVAERRGDRWYVDLNNIQIVKKHGGSLRDTRLVRGIVLDKEVVHPDMPRRVENARIALLDTPLEIEKPEIDLEISITSPEQIKALYEKQERILQEKIEKIAATGANVVITQKGIDDVAQHFLAKKGILAVRRVKRSDIEKIARATGARIVTDIEDLRPEDLGYAELVEERKVGEDKMVFIEGAKNPKSVTILLRGGFERLVDEAERSLHDALSVVADAIMDGKIVAGGGAVEAEVAKVLYEYASKLPGKTQLAVEAFARAVEALPQALAHNAGHDPIEVLVKLRSAHEKPENKWYGVDLDTGEIVDMWSRGVLEPMRVKLNALKAATEVASLILRIDDVIAARKEEEEKEEKRGGEEE

SEQ ID NO: 22943 - protein, 208 aa, Aeropyrum pernix
MRIVALEGIDGSGVSTHSRLLHARLAGAGVKSCLWKEPTEGPVGRLIRGFLRSTEGVDSDLMALLFAADRLWGLRLGVVERCGGSPEVLVVDRYKYSSLAYQGVGSGLEWVDAVNRKAPEAEILVYIDVPTEVALRRITARERREVFETPEFLERVKSMYEEVLRLARARGVKVIRVEGVRGGVERGIEDVQGEIAERVFEALGLARA

SEQ ID NO: 22944 - protein, 784 aa, Aeropyrum pernix
MRGSTPVIILWGRGADGSRVVVFYGEFRPYFYVLPDGSVGLDQLAAMIRRLSRPSSPILSVERVRRRFIGREVEALKVTTLVPASVREYREAVRRLGGVRDVLEADIPFALRFIIDFNLYPMRWYVAEVREVAVPHGYSVDRAYTLSGDIREDETRIQEDPLKGLRVMAFDIEVYSKMRTPDPKKDPVIMIGLQQAGGEIEILEAEDRSDKKVIAGFVERVKSIDPDVIVGYNQNRFDWPYLVERARVLGVKLAVGRRSVEPQPGLYGHYSVSGRLNVDLLDFAEELHEVKVKTLEEVADYLGVVKIGERVTLEWWQIGEYWDDPSKREILRKYLRDDVRSTMGLAEKFLPFGAELSQVSGLPLDQVMAASVGFRLEWRLIREAAKLGELVPNRVERSEGRYAGAIVLRPKPGVHEDIAVLDFASMYPNIMVKYNVGPDTLVRPGEEYGEEEVYTAPEVGHKFRKSPPGFFKKILERFLSWRRQIRSEMKKHPPDSPEYKLLDERQKAIKLLANASYGYMGWPHARWYCRECAEAVTAWGRSIIRTAIRKAGELGLEVIYGDTDSLFVKNDPEKVERLIRFVEEELGFDIKVDKVYRRVFFTEAKKRYVGLTVDGKIDVVGFEAVRGDWSELAKETQFKVAEIVLKTGSVDEAVDYVRNIIEKLRRGQVDMRKLVIWKTLTRPPSMYEARQPHVTAALLMERAGIKVEPGAKIGYVVTKGSGPLYTRAKPYFMASKEEVDVEYYVDKQVVPAALRILQYFGVTEKRLKGGGRQSTLLDFMRRGK

SEQ ID NO: 22945 - protein, 313 aa, Aeropyrum pernix
MVLPEPGVQTHIAVGNINLDISLSVDRLPGPEEVVFARDAWIGVGGAATNYAIAVAQLGQKPVLVAVAGREMERLGVVDTLRRRGVDVSRVKTVDRPSGVVVVMVVASDSHRSMVSMRGANEELLKYIEEEPLDGVSGECHVHMASVPPQALDFAPGGCTLSYDPGGEAFKRPKSLWSRLPRVDWMFINTPELKGMSGSGDLAAAYRLLESGLKRLVLKHGRGGATVVERGFCVTLDRTPVLEPVDVTGAGDAFDAAFNIAVKAGWSVEEALRLAVAAGSAKVLRRGSSNMPTASEVLAMLPRVAYPRDCSLT

SEQ ID NO: 22946 - protein, 402 aa, Aeropyrum pernix
MATARAGVLRSPVYIVDGVRTTIGKFGRSLKDFKAVDLAALTIRELLERAGVDPNYIELAVYGHVIRAGTHMNTAKQAALKAGLRSDLEGFNVDMVCASGMASVVKASLLIDAGMYSLALAGGMESMSNAPFIAPPSIRWGVRLLYQGALEMKDAMVSDGLYDPLNQLVMGQEADETAWEYGAQREELDWIAYESNMRAARAWERGHMQKYTIPVKAGGAVVLDYDEGIRPDTTVERLSKLPPVFTPKGPHTAGNSSQISDGAVSLLVAGEEAVREMGLKPKARIVGWGYAGVDPRRFPVAPVHAVRALLKKLGWRVEDVDYWENNEAFAVNSLIMNRELGVPYERLNVVGGSIAVGHPLGSTGARLILQLVYTLEENGARRGVASICHGLGGAAAVAIERV

SEQ ID NO: 22947 - protein, 164 aa, Aeropyrum pernix
MKGLVELGEKAPDFTLPNQDFEPVNLYEVLKRGRPAVLIFFPAAFSPVCTKELCTFRDKMAQLEKANAEVLAISVDSPWCLKKFKDENRLAFNLLSDYNREVIKLYNVYHEDLKGLKMVAKRAVFIVKPDGTVAYKWVTDNPLNEPDYDEVVREANKIAGELVA

SEQ ID NO: 22948 - protein, 394 aa, Aeropyrum pernix
MSWAKGSRIRDYRGREYIDFHMAFGAVALGHNDDDVAARVSEQLNRLVLHGAGVSDAEIEFAKMLIRKFPMYDKVLFTNSGSEAVMMAMRLARAYTGRDVVVKFDGNYHGWHDYSIYNIKNPASKGKTVESKGVPSATASTVEVLPYNDVDALEDYAERFGDRVAAYILEPVAHSMGVIPAEKGFVERLRKLCDTHGSLLIFDEIITFIRASDRGMQDYFGVRADLTTVGKAIANGMPVAAVLGGDNVMELLARGVVSSGTYSGHPLSMAAGVATLEKAEDVGLTRALRSRAEALAGILRDISEDLGVEAAVSQFGGSVSIYFGIDRRPKNLEEALRANGDAYRVFAREMRRRGILVTPNPLKRMHLAYSHSEEELEAFHRAAEEAVRVAKEYL

SEQ ID NO: 22949 - protein, 403 aa, Aeropyrum pernix
MREDMVFPFSSSEDFRIELTEEHELFRKSIREFVESKVMPRWREIEETNRIPEDILKEAADLGIFGVGIPEEYGGQGGGHLMTALLTEEIARAVPALGVTIGVNHLFAVPILLFGTEEQKRKYVTPIAQGKARGAHANTEPTGGSDVAGIRTTARKVNDHYVINGRKVFISGARDADYLVVSARTNPPREDKRWWGISVFIVEKDMPGLKIGQQFKVLGMRGEQPYEVILEDVKVPAENLVGKEDEGFKVIVSTYDYTRIGIAAQAVGIAQASFEKALNYALQREVFGQPLIQFQMIIDKLANMYMKLEAARLLTYWAATLADKGKREFIVAASLAKAFATEAAEWIARQAIQIHGGYGVDPETGVERYLRDAIITTIYEGTNEIQRLTIVRQLVRQAFGLKF

SEQ ID NO: 22950 - protein, 251 aa, Aeropyrum pernix [sequence omitted]

SEQ ID NO: 22951 - protein, 359 aa, Aeropyrum pernix
MRIEQDFSQSLGVERLKAARLHEYNKPLRIEDVDYPRLEGRFDVIVRIAGAGVCHTDLHLVQGMWHELLQPKLPYTLGHENVGYIEEVAEGVEGLEKGDPVILHPAVTDGTCLACRAGEDMHCENLEFPGLNIDGGFAEFMRTSHRSVIKLPKDISREKLVEMAPLADAGITAYRAVKKAARTLYPGAYVAIVGVGGLGHIAVQLLKVMTPATVIALDVKEEKLKLAERLGADHVVDARRDPVKQVMELTRGRGVNVAMDFVGSQATVDYTPYLLGRMGRLIIVGYGGELRFPTIRVISSEVSFEGSLVGNYVELHELVTLALQGKVRVEVDIHKLDEINDVLERLEKGEVLGRAVLIP

SEQ ID NO: 22952 - protein, 250 aa, Aeropyrum pernix
MPGSIPLIGERFPEMEVTTDHGVIKLPDHYVSQGKWFVLFSHPADFTPVCTTEFVSFARRYEDFQRLGVDLIGLSVDSVFSHIKWKEWIERHIGVRIPFPIIADPQGTVARRLGLLHAESATHTVRGVFIVDARGVIRTMLYYPMELGRLVDEILRIVKALKLGDSLKRAVPADWPNNEIIGEGLIVPPPTTEDQARARMESGQYRCLDWWFCWDTPASRDDVEEARRYLRRAAEKPAKLLYEEARTHLH

SEQ ID NO: 22953 - protein, 599 aa, Aeropyrum pernix
MVQVSQITISMRVHKNCCKKHKMIIRWVVWRKSDIMQPRLTSLALGLRSMTREFPPISRSRINPSTGSWRRAPRGSQAGLHFYSMGGGSLIGSCWSLLSKFAGYLRSRGVGKGDVVGLFLPNSPQFAIAFYGALIAGAIVSPMNVLYSPREIRHQLSDNKARVLVALDMFKDRVLAGLPSSVEEVLWTGIQDYLPGLKALLYKLFKKPPSPPKGGIHKKFTDALKHEPIDSKPEINPHEDVAALMYTGGTTGTPKGAMLTHRNLLANVLQIDAWFKRGVRGKDVFVGALPWFHIYGLTAVLNSGVQKAATIIVYARPNIEEIMRDIERYKATVFHGVPTLYRMIINHPKVEKFNLRSLEVCISGAEPLPKAVAERFMEITGAKLREGYGLTETSPVTHVNPIMGEARYGSIGIPVPSTVAAVADPESPAILEPGQVGELVVSGPQVMKGYYNRPEENEKVFFECCGLRWLRTGDMARMDEDGYFYIVDRKKDIIKYKGYSVFPREIEEVLYRHECVREAAVIGVPHPEYNEVPKAFVALRDECKGKVKPEDIIEFARKHLAPYKVPKEVEIREDLPKSGVGKILRRVLREEELKKRGQA

SEQ ID NO: 22954 - protein, 239 aa, Aeropyrum pernix
MLALILAGGYGKRLRPLTEHKPKPLLEVAGKPVLVHQIEWLRYYGVEEFVLLVGYLKERIIEEMGSGAKFGVKITYVVEDKPLGTAGALWNARHIIEKENLVLVVNGDIVTNIDPDPLVRLVREREAVAGIAAVPLRSPYGILELDDGNVTGFREKPFIYDYWINGGLYAVSKEIVKYLPQQGDIEKTTFPQLASDGKLVAARYEIPPFYWRSIDTFKDIEEASKEIEDMGGLVPPQKG

SEQ ID NO: 22955 - protein, 305 aa, Aeropyrum pernix
MRVAARGSRLSLLQVEQALEELSRYAGVSMHWEVVRVKSAGDVWSDRPLESIGVVGVFTREVDRAVASGAADIAVHSLKDMPTSGYGGPLKIVYIASRPSARDALISRQGPGRVEDLEPGSTLGTSSARRRALSLHYNPRIRVENLRGNLDTRLRKLREGLYDAIIASEAGLIRLGVDVEYTPLDPSYFPPAPGQGFVAVVARVGSNVEKMLRDLDKPPWWHVAWAERGVLEGARAGCRTPVAAYAEPLGRSMVRVTAAALSPDGSRAYWARAEGRIEEARRIGVSLGEELSRVVEGWHKTGGGS

SEQ ID NO: 22956 - protein, 432 aa, Aeropyrum pernix
MDVLASGEKSRMLFERTKELFPGGVNSPVRAAVKPYPFYVKRGEGAYLYTVDGARIVDLVLAYGPLILGHKHPRVLEAVEEALARGWLYGAPGEAEVLLAEKILGYVKRGGMIRFVNSGTEATMTAIRLARGYTGRDLILKFDGCYHGSHDAVLVAAGSAAAHYGVPTSAGVPEAVARLTLVTPYNDVEALERVFAEYGDRIAGVIVEPVIANAGVIPPRREFLAALQRLSRESGALLILDEVVTGFRLGLEGAQGYFNIEGDIIVLGKIIGGGFPVGAVAGSREVMSLLTPQGKVFNAGTFNAHPITMAAGLATLKALEEEPVYSVSREAAKALEEAASEVLDRTGLPYTINRVESMMQLFIGVEEVSNAAQARKADKKFYVKLHEEMLRRGVFIAPSNLEAVFTGLPHQGEALEIAVEGLRSSLKTVLGS

SEQ ID NO: 22957 - protein, 332 aa, Aeropyrum pernix
MRARRLRLHPGVRSLVAETRLDPSMFILPLFVEDGLKTPKPLRGLPGHFKYPPESRELVELVSRALYLGVRSFLVFGTPSMKSFEGAEAWSPRGPVQRAIKFVRAELGWRPVIMADVCLCGYTDHGHCGYPRETPRGVLIENDKSIEAYGKISVSLAEAGADFVAPSGMMDGQVAAIRSALDNAGYTEVGIMSYSAKYASGFYGPFRDVMDSAPRFGDRRSYQMDPRNRFEAVKEVLLDAAEGADIVMVKPALSYLDVISEVKRSVPWLPLAAYNVSGEYLMLKAAAEKGLVDYETVMLEILTSIARAGADAVITYHALEAAEALKSGKTPF

SEQ ID NO: 22958 - protein, 544 aa, Aeropyrum pernix
MSMLLGDHPELRSRAREIASLAARVVEQVNSMPAGEQKRLLSEQYPELARFEEQREKGDKGLPPLPGAVEGRVKLRFAPNPDFVIHMGNARPAIVNHEYARMYKGRMVLRFEDTDPRTKTPLREAYDLIRQDLKWLGVSWDEEYIQSLRMEVFYSVARRAIERGCAYVDNCGREGKELLSRGEYCPTRDLGPEDNLELFEKMLEGEFYEGEAVVRMKTDPRHPNPSLRDWVAMRIIDTEKHPHPLVGSRYLVWPTYNFAVSVDDHMMEITHVLRGKEHQLNTEKQLAVYRCMGWRPPYFIHFGRLKLEGFILSKSKIRKLLEERPGEFMGYDDPRFGTIAGLRRRGVLAEAIRQIILEVGVKPTDATISWANLAAANRKLLDERADRIMYVEDPVEMEVELAQVECRAAEIPFHPSRPQRKRRITLCTGDKVLLTREDAVEGRQLRLMGLSNFTVSQGILREVDPSLEYARRMKLPIVQWVKKGGEASVEVLEPVELELRRHQGYAEDAIRGYGVDSRLQFVRYGFVRVDSVEDGVYRVIYTHK

SEQ ID NO: 22959 - protein, 405 aa, Aeropyrum pernix
MDFSLGPDLELFRESLRRGLEKLLGGGRWAEIDEAGVLPAETIRGLGALGVLALVCPEELGGQGGGWLEAAIAAEEIGYHDPSMSTAVYTLLNNAWPFILSRHGSPEVAGGIVEKVAKGEMFFGIASTEPGGGSDVAGIKTRAERSGDYYRVYGEKILISGVREALETLDYGGWLLLARTGGEGHRGLSAFAFTGKWDGSLASGLEYSILDTIGRHGISTGILRLDGAEVHASRIVGGEGRGFYVAMEGFPLARILVAAANVGAARWALERAVEWSRERRLFGGRPIASFQGVSFSIAEAFAGLEAARLLVYRAAWTADRYVRGEAAREELNLYSASAKLKAVDTAFSIFQETMKIVGGISFTKEVDVHRGLLGTLSYLVGAEGAQNIMKYIIARDLIGREYVKL

SEQ ID NO: 22960 - protein, 420 aa, Aeropyrum pernix [sequence omitted]

SEQ ID NO: 22961 - protein, 617 aa, Aeropyrum pernix
MAGDKGGGDGERRLRQPIVVVLGHVDHGKTTLLDKIRRTAVAAKEAGGITQHIGASIVPADVIEKIAEPLKKVIPVKLVIPGLLFIDTPGHELFSNLRRRGGSVADFAILVVDIMEGFKPQTYEALELLKERRVPFLIAANKIDRIPGWKPNPDAPFIETIRRQDPKVREILEQRVYEIVGKMYEAGLPAELFTRIKDFRRKIAIVPVSARTGEGIPELLAVLAGLTQTYLKERLRYAEGPAKGVVLEVKEMQGFGTVVDAVIYDGVLKKEDIIVVGGREGPIVTRVRALLMPAPLQDIRSREARFVQVDRVYAAAGVRIAAPGLDDVIAGSPIYAAESEEEARKLMEAVQREIEELRFRTENIGVVVKADTLGTLEALVEALRRRGVPVRLADIGPVSRSDVLDAAVTRKIDPYLGVVLAFNVKVLPEAEEEASRAGVKIFRESMIYKLIEDYEEWVKKEKEAERLKALNSLIRPGKFRILPGYVFRRSDPAIVGVEVLGGVIRPGYPVMDSQGRELGRIMAIKDRDRSLEEARLGAAVAVSIQGRILIGRHANEGDILYTNVPAQHAYKILTEFKDLVSKDELDVLREIAEIKRRAADHEYNKVLLRLKIKRVSQ

SEQ ID NO: 22962 - protein, 141 aa, Aeropyrum pernix
MAVQRTLLVVKPDGVERGLIGEVVSRVERKGLKIVAMKMMRLTREKAEEFYSVHRDKPFFGELVEFITSGPVVAMVVEGDEAVSVVRLMIGSTDGRKAAPGTIRGDFSLDIMKNIVHASDSPESFEREFRVLFSESEIVEW

SEQ ID NO: 22963 - protein, 492 aa, Aeropyrum pernix
MSGLAGNVRLFGTAGIRGRYLRKVTPLLAYQVGLALAGYVGSGGSIVVAHDVRTTSPLLASMAASGVMAGGVDAILVGQVPLPAASYSVVRSGSKSGIMVTASHNPPWDNGIKIVDSRGMELTRSEEEELESIIEDGVEGFLADWNSVGILRIEKEMLNYYMEDIVARTAVDGETSLSMAVDCANGAASGVTPIVLRSIGVRRVYTFNCHPDGYFPGRHPEPRPDVLEPFIKSSSILGVQAFIAHDGDADRTALGVPGYGFVKQDLVIALLSWWKLRERKGSVVVSVDVGIEVEEVVEELGGRIVRSRLGKIHEKLLQEANAVLAAEPWKLIDPDWGLWVDGVYQAALLAHISLATGKTPRELLDMLPYYPSARVSYVLGGENERDRLYEDVVEKLSHSLTGNAVRILPIDGVRIDYEDRSWLLFRKSGTEPKLRVYAQAREKERLVELLSRIHSMVSGEASRTGIKLVSKEEHVSLPPGGARGFRGRSALL

SEQ ID NO: 22964 - protein, 324 aa, Aeropyrum pernix
MRRAARASAPGKVIIVGEHFVVRGSLAIVAAIGRRLRVTVRSGGKGIVLESSMLGRHSAPLPGQGAAAKVSPVLEPYIAVLRSLAARGYSVVPHTILVESGIPPRAGLGSSAASMVAYALSYSAMHGDPLSAEDLYSVAMEGEKIAHGKPSGVDVTIAVRGGVLAYRRGENPVDIRPGLTGVTLLVADTGVERRTRDVVEHVLSIADALGEASTYIYRAADLIAREALHAIEKGDAERLGLIMNAAQGLLSSLGASSLEIETLVYRMRSAGALGAKLTGAGWGGCVIGLFKEGEVERGLESVVESSSQAFTASIAEEGARLEEF

SEQ ID NO: 22965 - protein, 432 aa, Aeropyrum pernix [sequence omitted]

SEQ ID NO: 22966 - protein, 699 aa, Aeropyrum pernix
MKELGVEPGDVVEIEGKKKTVAIVMPAYPEDMGLDIIRMDGILRRNADVNIGEKVIVRKTSVRTATKVKLAPVSYTMTVDEGFKRYVKKKLQGVPITEGDVVVVPVIGQAVQLQVVDARPKGAVIVSEETIVDVLEKPVAQSRVPKVTYEDIGGLKEVIEKVREMVELPLRHPEIFKRLGIEPPKGILLYGPPGTGKTLLAKAVANEADAYFISINGPEIMSKYYGESEQRLREIFEEAKKNAPSIIFIDEIDAIAPKRDEVVGEVERRVVAQLLALMDGLEARGNVIVIAATNRPNAIDPALRRPGRFDREIEVPLPDKHGRLEILQIHTRHMPLAEDMDLEKLAEMTKGFTGADLAALAREAAMYALRRYLPEIDLDQESIPVEVLEKMVVTMEDFLKALREITPSGLREIQIEVPEVRWSDIGGLEDVKQELREVVEWPLKHPEAFTRMGIRPPRGVLLFGPPGTGKTLLAKAVATESGANFIAVRGPEILSKWVGESERAIREIFAKARQHAPAVVFFDEIDAIAPVRGTDVGTRVTERIVSQLLTEIDGVSDLHDVVVIAATNRPDMVDPALMRPGRLEKMIYVPPPDFSSRLEILRIHTRKVPLAEDVDLAEIARRTEGYTGADIEALVREASLAALREDINAAEVSMRHFEVALKKVKPSVTPQMVEYYKRWLETVKQRQEEVKREAPTITL

SEQ ID NO: 22967 - protein, 243 aa, Aeropyrum pernix
MTGGSRGIGRATVLRFAREGWSVVIAYKSRADLAEKTAEEARRLGSPEAYTVRVDVGDPDSVTEMSSRVGELIPHLNVLVNAAGVLQLGGIEETSISEWEETLRVNLTGVYLVTKLLLPLLRKAKWASIVNVASIAGETGNVVAGVAYSASKAGVIGLTKRLAVQLAGYGIRVNAVAPSFVETDMTRSFLDTPEKRERIASLHPLKIILKPEDVAEAILFLADPRRSRGITGHVLSINAGRRT

SEQ ID NO: 22968 - protein, 323 aa, Aeropyrum pernix
MGYAVEAEALVKEYRMGLLPWRARTIRALDGVDLKVGRGTLFSLLGPNGAGKTTLVKILSTLLLPDSGWARVAGFDVVREANNVRSRIGVVLGGERALYWRLSGWDNLWFFSQLYGIPPREAKRRVKELLEIVGLEEWAHVRVENYSKGMKQRLHIARGLINDPEVLLLDEPTIGLDPKAAREVRSIIRRIVREGRTVLLTTHYMVEAEELSDRVAIISKGRIVAEGPPEDLKSLVGGESVIELKVMGGDRVSMLLERLGGRVISVVERDGARVFRVLVSEPDSFIEALLAELTRINASIRGLDVRSPSLEDVFIKLAGGEGG

SEQ ID NO: 22969 - protein, 1007 aa, Aeropyrum pernix
MMVYPRMGRVPLPPKGAQHYTTMCQFCNVGCGYDVYVWPAGAEGSPEPGGHGIEYKIVDEAYGRNLVKQPDFTKEHTGLSAEEGEPWISEAMVVKTIRRTWERGRGTGGWREVYVAQVPSPECPINWGNHSVRGGTQAERIWSPWNIAGERRLTKPLVRFGGRLEPVSWEYAIDLVARVVKGVIDKWGIERPGWGKEGHAVFAHRMDHGGGGGGGMIFNTVVGLFFFYGVRTAFARIHNRPFFGPENPAAGDAGPGAMNTSYHDLRLADTIILWGNNPYSTATVMFVKHVLDNLRGATKAEKQRWFNPGEPVIDSRIIIVDPRRTETVEAAEAAAGKDRVLHLQVKPGTDIVLANAIARVIYERYGDVVEEFVNHYRSAAGWGFKWDEEGFQKYVSEALQVGEETLDEVLAEAESITGVPRDKIELAAKWIAERKEGGYPKRVWLMYEKGIIWNQNYRSIYSLFDLCMIAGATRGLPGCGCQRQGGHQEGFASPAPPPPPWTDERHHIAYPDKSLYDEYYNTKYPRADFYMPTTDFRLANGEGKVLWVIDMDNYRLAPNSQRLKAVVGDRAWRVTRYVFAEAYANVGGKESEPNYDPNALEPVITTPPSSREYAEKVLQALEETGGLFVIVEDIYPTFMVEDAHVVLPAAFNNGEWPDVRMGVHERRFRIADAWLDPPGEAKPDWWILANVAKRIVELYEEEGRGGDPVAERFRKAFKPIWDAMEANARDPTVEVENEIFKTYIANADEAYARLGVHWEVQYWTPEFKKLDLNILRKLRTIGTVLPITKLDVKPDGTIEVRGVVNIMEPALNDTYREEVVVVKPDGTIVRRIEVVPSNETVRSYVPGHLKPWPAVWDKYPPYVDELIRKGYKYWVVNGRYNAIWQTGYADPNVVEIMARHPMNIVQVNPEDAAKEGLENGDIVVIYNDYGSTTAMVWVTRVVAPGTIFLIMAHPKAVGANAVTTPSVDPAAQNPDYKLTLANLRKIGRADETIIKKVTFKDIRFAVR

SEQ ID NO: 22970 - protein, 397 aa, Aeropyrum pernix
MDNPANPLDREFLTEGEAAPGLPVFCLERWQSTLENSAKYLLSESGVEPPAAEMLTELGVDLDVRSAVLGYGWTLGEPGLRESVASVYYRGLVDSEQVIITTGSAEANLLSVISLVAPGDRVLFDMPNYMQIHGLLRMRGARILEAWRKREHRWKLDPGLYAELIKREKPRAVFITNPNNPTGSVAGPKALGEIAAEAARTGSILVFDELYRGLEHSTEPAPTVLEPALEQGAHAISVSGLSKVYGLPGLRIGWAAATSRRLRDRMWMVKDYTTISPPKPSEHIAEQILEKGVWKKLAERGRRIVLSNLEILEDLTTRFRTAKLWRPDAGAYALVETTVGDTLSFAYKLYQTHSILVNPGECFKLPGTIRLGLGHENRESFKKSVALTLNFLESFAG

SEQ ID NO: 22971 - protein, 333 aa, Aeropyrum pernix
MNALESEAMVVAEELVKDYGGFRAVDGVSFRIARGELFSLLGPNGAGKTTTIKMLSTLLRPTSGEAWIAGYSIVREPGNVRRVIGLVPQDLTADDEMSGWDNVYIQARLYGLPSSEARERTREVLDYLDLMEAAHRRVATYSGGMRRKLEIAMSLVHSPKVLFLDEPTLGLDVHSRRSLWRYIEDLKRSAVTILLTTHYMEEAEMLSDRVAIIDRGRIVAEGTPEELKARVKGETVYIELKDPEYTEPLVLALKEKLGLEPSVVEGKVAVRVDRADTLLPELARALNGFPVKAISITRATLEDVFIELTGRTLGGSEEPLDPFRYRRMIRGVR

SEQ ID NO: 22972 - protein, 421 aa, Aeropyrum pernix
MFRRYIEIPVLYKIAVGFVLGIIAGIVIGGVMVDLKPLGDLFIRLLKMLVAPIVFFSLAVGAASISASLLGRVGVKIFVYYLFTTAFAITIGLIVANIIQPGRGLELAGEAKEIQVKPPPPISEVLLNIVPTNPFKALAEGNVLQIIFFAIVLGVAVALLRSSRDDRLRSGGETVYRVFDGLAESMYKIVRGVLEYAPIGVFALIGYVVATAGPGVLGPLAVVVITLYIGLAIHVLGVYSLILRLFGFSPLKFFKGALEAMATAFVTRSSSGTLPVTMKVAEEELAIDRRIFSFTLPLGATINMDGTAMYQAVAALFIANTLGIDLSIGQQLSIILAATLASIGTAGVPGAGLIMLAIVLEALGLSLTDPTVALAYGLIAGIDVILDMGRTMVNVTGDLVGTTIVAKTENAVDTKKGVWSR

SEQ ID NO: 22973 - protein, 218 aa, Aeropyrum pernix
MSRLGVENGDHVILYGDYNNWFAAFAYWVFKMYGHQRVSLLDGGRSKWIALGKPMSRPATREPPRAERESRYRVVTVDSRYRVFFLDILRKLNDPNTVLVDVRSPEEYRGDITAPPEYPEEQAQRGGHIPGALNIPWKQAVRDDGSFKSPEELRSLYEDRGVTPDKEVIVYCRIGERASHTWFVLKELLGYPNVAVYDGSWSEWGNMVRAPVKKGDEP

SEQ ID NO: 22974 - protein, 513 aa, Aeropyrum pernix
MLAVTRIGAIHSVVFSGFSSWALADRIVDAKADVLITADGFYRRGRIVDLKKNADEAVKLAADNGVKVRKVIVVRRAGNEVRWSSELNVWYHDLLKEVPEKVYVKPEPRKSDDVLFILYTSGTTGKPKGIMHSVGGYMTYVYNVFRWNWDPRPEDVFWTAADIGWITGHTYIVYGPLMHGETQIMYEGAPDYPNPGRIWEMVERYGVTVFYTSPTLLRLLRKYGDEWVEGRDFSRLRLLGTVGEPINPEVWKWYYEKIGWKRAPIVDTWWQTETGAAMISPAPGIALVPLKPGSATLPLPGIVADVLTSDGRQAGPGEKGYLVVREPWPGMMLGIWGDPDRYVRTYWSRFSKPEEGVWIYYPADYAVRDRDGYFWILGRADEVLNVAGHRIGTIELEDALLTHPAVSEAAVVGAPDPVKGEVPVAFVVLRAGYEPSDKLERELRETVRRLIGPIAEPSKIYFVEKLPKTRSGKIMRRIMISLLRGQPVGDVTTLEDPSAVEAVRRALEREKAG

SEQ ID NO: 22975 - protein, 249 aa, Bacillus stearothermophilus
MSMEQKTAIVTGGANGIGKAIARAFAKQGANVVIIDRDIQNGEAFAAQLQSDGFKAIFVAADVRKVDDIERFVQEAAGRFGRIDYLINNAGVSRWKSPYELTVEEWDDVLSTNLRSAFFASREAAKYMRRNAKGGAIVNIASTRALMSEPNSEAYAASKGGLVALTHALAVSFADDRIRVNCISPGWIETGDYGQLRDIDHRQHPAGRVGKPDDIARACLYLCDEENDFITGVNLFIDGGMTRKMIYIE

SEQ ID NO: 22976 - protein, 279 aa, Bacillus stearothermophilus
TEKQEMMRQMVREFAAAEIAPFVERMEQGEFPRPILAKMAELGLMGITVPEQYGGAGMDFVSYIIAIHEISKVSPTVGVILSVHTSVGTNPILYFGTEEQKQKYVTKLARGEYLGAFCLTEPSAGSDAKSLKTKAVRRGDRYVLNGSKIFITNGGEADTYIVFARTNPEEAGSRGISAFIVEKGTPGMSIGKDEKKMGLHGSRTVTITFEDAEVPAENLLGQEGEGFKIAMANLDVGRIGIAAQALGIAEAAVEHAVAYAKERVQFGKPIIEQQGVAFQ

SEQ ID NO: 22977 - protein, 434 aa, Bacillus stearothermophilus
  unsure (1)..(434): unsure at all Xaa locations
PRVVRTMSIPKMKRXGTQIRWFLTDKLSKTAGHIGPNLGVVELTIALHREFDSPKDKLIWDVGHQSYVHKILTGCAAAFDTLRQYKGLSGFPKRSESEHHVWKTGHSSTSLSPAMGMAIARDLKGTDEYIVPIIGDGALTGGMALEALNHIGHEKTDMIVILNDNEMSIAPNVGALHNILGRLRTAGKYQWVKDELELLLKRIPAVGGKLAATPERLKDSLKYLLVSGVFFEELGFTYLGPVDGHDFEDLFENLRYAKKMKGPVLVHVITKKGKGYSPAENDKVGTWHGTGPYKIETGAFVKTKEAGPSWSALVSETVRRLASTDPRIVAITPAMPVGSKLEGFASEFPDRMFDVGIAEQHATTLAAGLATQGMKPFLAIYSTFLQRAYDQVVHDVCRQNLNVFFAIDRAGLVGADGETHQGVFDIAFLRHVPN

SEQ ID NO: 22978 - protein, 171 aa, Bacillus stearothermophilus
ARVKEEFGSIDILVNNAGTLDHVSQIIKQNDKFWERDLRVNLTGTYNCTKAVWPYMKEQGWGRIINMSSVAGTLGGFGQASYSATKGAVLSFTKSMALEGARYGITVNAIVPGIINTEAFRMGNPKMNERMIQRTAFRRPGEPEDVANAIVFLCSDKAKYITGIGLNVSGG

SEQ ID NO: 22979 - protein, 148 aa, Bacillus stearothermophilus
LGDIYIASDGDAIVKVELFPEEWSAFAGEHSVVKSWSPLLERALRQLDEYFHGRRQVFDLPLKWKGTAFQEEVWAALCRIPYRETATYADIAAQIGRPKAVRAVGHANRANELSILVPCHRVVGKNGALIGYAGSRTDVKAKLLELER

SEQ ID NO: 22980 - protein, 149 aa, Bacillus stearothermophilus
MAERTFIMVKPDGVQRNLIGEIVARFEKKGFQLVGAKLMQVSRELAEQHYAEHKERPFFGELVDFITSGPVFAMVWEGENVIAAARQMMGKTNPQEAAPGTIRGDFGLTVGKNVIHGSDSPQSAEREISLFFKEEELVSYSKQINAWLY

SEQ ID NO: 22981 - protein, 169 aa, Bacillus stearothermophilus
RAVRVRNVLIGGDEPCICAPVVGADAEQVLEETRQISAKKPHLIEWRADFFQAIQDEQQVAATAREMRAIAGDIPILFTVRSELEGGRPISLTEEEKLRLFETVCQSGAIDLLDYELAHEPYVPAVRQLTRRYGVRLVLSYHNFDCTPSKEELVAKMRQVEQHGADIAK

SEQ ID NO: 22982 - protein, 238 aa, Bacillus stearothermophilus
GIPIPVDLDSPFSIDQNLWGRSNECGILEDPWAAPPEEAYELTASLENAPDVPDVIEIGFEQGVPVTLNGKAYPLAQLILELNALAGKHGVGRIDHVENRLVGIKSREVYECPGAITLIKAHKELEDLTLVREVTHFKPIIEQKIAEVIYNGLWFSPLKDALVAFLKETQKNVTGVVRVKLFKGHAIVEGRKSPFSLYDEKLATYTSEDEFDHQAAVGFISLYGLPTKVHSIVNKQNK

SEQ ID NO: 22983 - protein, 378 aa, Bacillus stearothermophilus
PLPVKRVQENISTRPPHGQMDTLGAQSGLIWASQVHEPGVLPQHGVSLLGTPIEAIQRGEYREAFRALMHELGEPVPESEIVTSVEEAVAFAEQIGFPIIIRPAYTLGGTGGGIAENMEQFLALVEKGLAESPIRQCLIERSVAGFKEIEYEVMRDQSNTCITVCNMENVDPVGIHTGDSIVVAPSQTLTDEEYQMLRSLAVKIISALGIIGGCNIQFALDPNSKQYYLIEVNPRVSRSSALASKATGYPIARIAAKLAVGYTLAELVNPVTKTTYASFEPALDYVVVKFPRLPFDKFPHADRKLGTQMKATGEVMAIDRNMERAFQKAVQSLEGKNNGLFLPELSAKTDDELTQLLVDKGDRRFFAILELLRRGVPV

SEQ ID NO: 22984 - protein, 320 aa, Bacillus stearothermophilus
FDQQKPLDFIAVGRLCIDLNANEIHRPMEETVTFTKYVGGSPANIAIGMARLGMKTGFIGRVADDQMGRFIVRYLKNNGIDTSHVITDKSGSVTGLAFTEIKIPTDCSILMYRDNVADLKLEPNDIDEDYIRRAKCLLISGTALAKSPSREAVFLVLDYARRHGTVVVFDLDYRPYTWQSKEETAIYYNLAAEKCDVIIGTREEFDMTEQFDDRRCDDEQTARKWFDYNAKIVVIKHGKDGSIAYTKTGETFVGTIFPANIVKTFGAGDSYAAGFIYGLMNGWPIPKAMEYGAAAASIVISSHSCSDAMPTLAQIEQFIE

SEQ ID NO: 22985 - protein, 399 aa, Bacillus stearothermophilus
  unsure (1)..(399): unsure at all Xaa locations
HQRLKSLLEQLDGTYXTEGNRIFYLAMAPEFFGTVTSRLQSEGLTETRGFKRLVIEKPFGHDLASAEKLNDEIRRVFSEREIYRIDHYLGKEMVQNIEVIRFSNAIFEPLWNNRFIANIQITSSETLGVEDRGRYYDHSGALRDMVQNHMLQMVALLAMEPPIKLTTDDIRHEKVKVLRALRPIAHDEVDRYFVRGQYGRGVIHGKNVPAYREEPNVDPDSNTETFVAGKLLIDNFRWAGVPFYIRTGKRMAEKSTKIVVQFKDVPMNLYYRTNETIAPNLLVIHIQPDEGITLHLNGKKTGESTTITAPFQLDYCNNCIDGINTPEAYEKLLYDCMRGDATNFTHWDEVAASWQFVDPISEVWANTKASDFPNYAAGSMGPAAADELLKKDGFHWWPI

SEQ ID NO: 22986 - protein, 185 aa, Bacillus stearothermophilus
GRVLIDGIDVREFSAEQLRAYVRFVPQEVLLFSGTVADNLRFGKMTATMEEIVQAARDAQIHETITRFPDGYDALIGQKGVNLSGGQKQRLSIARALVGEPRILLLDDSTSALDAETEAKLLAALRRYACTTVMVTQKVSAAMAADTIFLLEDGRLIAQGSHEQLLAASELYRRIVATQEGKKGS

SEQ ID NO: 22987 - protein, 280 aa, Bacillus stearothermophilus
MKAYLHVASGKTFSGELAAPLEEKVSGEIVFFTGMTGYQEVLTDPSYKNQIIVFTYPLIGNYGINEDDFESKRPHVEAVVVYEASGTGFHYGAKYSLAEYLQHWNIPLLTHVDTRALVKEIRTAGTMMAELSLSPIPAVADEEAAFPVRAVSTKTIESYGEAGPHLVLIDFGYKKSILQSLLARGCRVTVVPHDTAPEAIDALKPDGLVLSNGPGDPKQLSHQLPAIRQLIDRYPTLAICLGHQLVALSYGADTEKLRFGHRGANQPVWDAVKQNVMMTS

SEQ ID NO: 22988 - protein, 341 aa, Bacillus stearothermophilus
  unsure (1)..(341): unsure at all Xaa locations
HVAVVGATGAVGQQMVRTLEDRNFPVGKLTLLSSERSAGKKMRFRSEEIEVQAASPERFNGVDIALFSAGGAVSKALAPEAVRRGAIVIDNTSAFRMEENVPLVVPEVNESDLTWHNGIIANPNCSTIQMVVALEPIRKAFGLERVIVSTYQAVSGAGAQAIEELNEQTKAVLEGKPVEANILPVKSDRKHYPIAFNAIPQIDKFQDNGFTFEEMKMINETKKIMHMPELKVAATCVRIPVASGHSESVYIEIEQDGVTASDLQAVLREAPGVVLHDDPSEQLYPMPANCVGKYDVCVGRIRRDLDNRRGFHLSIVPDNLLKCAPSNSVQIXQSLLKLRLI

SEQ ID NO: 22989 - protein, 313 aa, Bacillus stearothermophilus
VWSIPVTLAVTEEKAKELAVGDKAKLVYRGDVYGVIEIADIYRPDKTKEAKLVYKTDELAHPGVRKLFEKPDVYVGGEITLVKRTDKGQFAAFYFDPAETRKKFAEFGWNTVVGFQTRNPVHRAHEYIQKCALEIVDGLFLNPLVGETKSDDIPADIRMESYQVLLENYYPKDRVFLGVFQAAMRYAGPREAIFHAMVRKNFGCTHFIVGRDHAGVGNYYGTYDAQKIFLNFTAEELGITPLFFEHSFYCTKCEGMASTKTCPHDAKYHVVLSGTKVREMLRNGQVPPSTFSRPEVAAVLIKGLQERETVAPS

SEQ ID NO: 22990 - protein, 347 aa, Bacillus stearothermophilus
IDKMKFIAGDGLRGPIKVTGSKNSAVALFPEAILADSPVTIEGLPDISDVHILGSLIEEIGGSFSFDGKEAVIDPTNMVSMPLPNGKVKKLRASYYLMGAMLGRFKKAVVGLPGGCHLGPRPIDQHIKGFEALGATVTNEQGAIYLRAEELRGARIFLDVVSVGATINIMLAAVRAKGRTIIENAAKEPEIIDVATLLSNMGAKIKGAGTDVIRIDGVETLSGCRHAIIPDRIEAGTYMIAAAATNGEVVVDNVIPQHVESLTAKLREMGVRVETGEDQILVCGTDVLKAVDVKTLVYPGFPTDLQQPFTALLTKANGTSVVTDTIYSARFKHVDELRRMNANVKVE

SEQ ID NO: 22991 - protein, 206 aa, Bacillus stearothermophilus
DRLVQAADGTDLKFGAQTMHFADQGAYTGEVSPVMLKDLGVTYVILGHSERRQMFAETDETVNKKVLAAFTRGLTPIVCCGESLEEREAGQTNAVVASQVEKALAGLTPDQVKQAVIAYEPIWAIGTGKSSTPEDANDVCGHIRSVVSRLFGPEAAEAIRIQYGGSVKPDNIRDFLAQEHIDGALVGGASLEPASFLQLVEAGRYE

SEQ ID NO: 22992 - protein, 114 aa, Bacillus stearothermophilus
MNILEIKQVTKKFGDFIAVDHMSLTAAEGEIFGFLGANGAGKSTTINMIAGLLRPNAGEIKILGKDIAKHRQFVTRHIGVVPQQIAIYENLTAYENVEFLAGLYGLCGAELRQR

SEQ ID NO: 22993 - protein, 250 aa, Bacillus stearothermophilus
AGSDVASIQTTAVRDGDDYILNGQKTWISLADIADHFLVFAYTDKSKKHRGISAFIVERTMPGFSVAPIKGKLGIRSGNTGELFFDNVRVSKENLLGEEGEGFKIAMSALDNGRFTVAAGAVGLIMACLEASVKYCHERKTFGKEIGRHQLVQQMIARMEAGLQISRLLVYKVGFLKNEGRRCTRETSLAKWIACDYANQAADDAVQIHGAYGYSNEYPVERYLRNSKAPVIYEGTREIHTIMQAEYVLG

SEQ ID NO: 22994 - protein, 224 aa, Bacillus stearothermophilus
AHASTVGGKVAINHPFGKNMIGAFHQPEAVVYDTSFLRTLPERELRSGFAEVIKHALIRDRRFYDWLRAEIKTLADLRGEKLAYCIEKGIDIKASVVREDEKETGVRAHLNFGHTLGHALESELGYGALTHGEAVAVGMLFAVFVSERFYGRSFAEHRLADWFAGYGFPVSLPTTVQTRRLLEKMKGDKKAYAGTVRMVLLCEIGDVEVVELEDDNLLTWLDEF

SEQ ID NO: 22995 - protein, 371 aa, Bacillus stearothermophilus
RQLRRAEASGATVILNGKPMLNLASNNYLGLADDRRLIEAGCEAMRAYGAGAGASRLVVGNHPLYERAEAALKQWKKAEAALIFNSGYTANIGVLTALIGRDDLVFSDELNHASLIDGIRLSKAACFRYRHHDIDQLESLLKQSPPAKRKWIVTDAVFSMDGDMAPLEELVELKRRYRAVLLVDEAHSGGVFGPNGEGLLHHFGLEKEEDVIAIGTFSKALGSFGAYVTGEPWLVDYLINSARSLIFTTALPPSVLAANEAAIHIVQAEPKRRERLHALSERFRTKLKRLGFDTGGSETPIVPVIVGPNDRAVAMSEQLQEAGIAAVAIRPPTVPEGTARIRFSITAAMTEEDIDMAVDCIAFAGKQIGLI

SEQ ID NO: 22996 - protein, 310 aa, Bacillus stearothermophilus
  unsure (1)..(310): unsure at all Xaa locations
IELDNLCKTYGDHRAVDHLSLSIQKGEIFGLLGPNGAGKTTTILMMLGFTEPTSGSVRVCGIDPVRNPIEVKRKVGYLPDDVGFYHHMTGLENLLYTGALNGIPRAEAEKMAWELLEKVNLTDAAHKKAGKYSRGMRQRLGLHDVLMKCPEVIILNDLTLGIYHEGVRELLRLIRSLSRHXGITVLLSSHQLHHVQQICDLVGLFVGGRLLAEGNIERLAQQLFLQDAYVIHVVASPLDASLRSKIEAIPGVNKVEQTENGWDVYCQTDVSAAISQTIIESGSSLFHLSRRDFGLDEIYHRYFEGRDVHE

SEQ ID NO: 22997 - protein, 237 aa, Bacillus stearothermophilus
MEHKAPLVEFLGLTFNLSDMLMITITSLIVFIIAVAATRSLQLRPTGMQNFMEWVFDFVRGIINSTMDWQTGGRFLTLGVTLIMYVFVANMLGLPFSVHVNGELWWKSPTADATVTLTLAVMVVGLTHYYGVKMKGASDYLRDYTRPVAWLFPLKIIEEFANTLTLGLRLFGNIYAGEILLGLLASLGTHYGVLGAVGAAIPMMVWQAFSIFVGTIQAFIFTTFTMVYMAHKVSHDH

SEQ ID NO: 22998 - protein, 239 aa, Bacillus stearothermophilus
MKKVRKAIIPAAGLGTRFLPATKAMPKEMLPIVDKPTIQYIVEEAIASGIEDIIIVTGKGKRAIEDHFDYAFELEQMLKQKGKLDLLEKVKEPSKVDIHYIRQKEPKGLGHAVWCARNFIGDEPFAVLLGDDIVQAEKPCLKQLIEQYEQTFSLVIGVKRVPEEETHRYGIIDPLEQQGRRYQVRRFVEKPVPGTAPSNLAIVGRYMLTPEIFLFLQKQEVWSGGEIFLTDAIGRLYEI

SEQ ID NO: 22999 - protein, 382 aa, Bacillus stearothermophilus
LTETFKNVFGGGEERVRIFFAPGRVNLIGEHTDYNGGHVLPCALEIGTYALVRQTDEPFVRLYSQNFPETGVITVSYDDLAYRSEHGWANYPKGILAAFQALSPLETGLDILYYGTIPNGAGLSSSASIELVTAVMLNELVRRGLDQLELVKMSQTVENKYVGVNCGIMDQFAVGMGKQDCAILLNCQTLEYRYLPLVLNDCSIVIANTNKKRGLADSAYNERRATCEAALAKLQSVRNIASLGELTSAELARYAHLLSPLEQKRARHAVTENERTLEAARALERGDLIRFGELMKQSHLSLRNDYEVTGVELDTLVEAAWSHEGTVGARMTGAGFGGCTVNIVKKACVQDFIERVGNAYAEKIGYEASFYVVEVGDGAREL

SEQ ID NO: 23000 - protein, 314 aa, Bacillus stearothermophilus
VKIAIAGAGYVGLVTAACLADKGHDVICVDVNEEKIRRLNEGIVPIYEPGLEPLIQRNSARLRFTTNDAEAYRWAEVIMVAVGTPPLPDGSVQLDAVWKALGRIAMAVERDCLVAIKSTVPVGTGDEAARFLEEHGRGGVRIDIVSNPEFLSQGTAVRDTLQAPRIVLGVESERAERMMKDLYAPFALPYVVTDRKSAEMIKYAANVFLALKISYINEIANVCELVGADIQAVAEGIGMDPRIGRRFLRAGVGYGGSCLPKDASALYSLGGSHRYSLKTGWAGMDRYEKQKWKLVEKARAHLWVVNEPTLGRLG

SEQ ID NO: 23001 - protein, 333 aa, Bacillus stearothermophilus
QLEQWDKQYVWHPFTQMKQYAKERPLIIERGQGSYLYDVDGNRYLDGYASLWVNVHGHNDPELNAALREQLEKIAHSTLLGSANVPSILLAKRLLEYWPHMSKVFYSDTGAAAVEIALKIAYQYWKNIDPVQYAKKNKFVSLKEAYHGDTVGAVSVGGMETFHRIFAPLLFERIEVPSPYVYRMDEYGSEQEIVGYCLRELERVLEEQHDQIAAVVIEPLVQGAAGIIVHPRGFLKGVERLCRRYGVLFICDEVAVGFGRTGTMFACEQEEVQPDLVCLGKGITGGYLPLAATLVTEEIYAAFLGDVDEDKTFYHGHTYTGNQLTCSVALKNI

SEQ ID NO: 23002 - protein, 103 aa, Bacillus stearothermophilus
VEGQTVIPLRERNIILIGFMGAGKTTIGQLVAKKLYRDFIDVDAEIERRHGMTIPEMFAQKGEAYFRQVERQLIVDLCTNTRLKILSLGGGAYLQEDVRRVCL

SEQ ID NO: 23003 - protein, 410 aa, Bacillus stearothermophilus
MTATKQTAQVTAVADGTVVTPKGFQAAGVHAGLRYSKNDLGVILCDVPASAAAVYTQSHFQAAPLKVTQASLAVEQKLQAGIVNSACANACTGEQGLKDAYEMRELCAKQFGLALHHVAVASTGVIGEYLPMEKIRAGIEKLVPGATMADAEAFQTAILTTDTVMKRACYQTTVDGKTVTVGGAAKGSGMIHPNMATMLAFITTDANVSSPVLHAALRSITDVSFNQITVDGDTSTNDMVVVMASGLAGNDELTPDHPDWENFYEALRKTCEDLAKQIAKDGEGATKLIEVRVRGAKTDEEAKKIAKQIVGSNLVKTAVYGADANWGRIIGAIGYSDAEVNPDNVDVAIGPIVMLKGSEPQPFSEEEATAYLQQETVVIEVDLHLGDGFGVAWGCDLTYDYVKINASYRT

SEQ ID NO: 23004 - protein, 222 aa, Bacillus stearothermophilus
QKPVYGLTEWNREPVREPVLLSNPGCYPTATLLGLAPLVKEGLIKEDSIIVDAKSGVSGAGRKAGLGTHFSEVNENVKIYKVNVHQHIPEIEQTLQTWNEAMEPITFSTHLIPMTRGIMATIYAKAKQSISPNDLVDLYKTSYEGSPFVRIRQLGQFPATKEVYGSNYCDIGFAYDERTGRVTVVSVIDNLMKGAAGQAVQNFNLMMGWDEAEGLQSLPIYP

SEQ ID NO: 23005 - protein, 430 aa, Bacillus stearothermophilus
QIAVVGVDYKTAPVEIREKLAFAEAELGAAMKQLAKQKSVLENVIVSTCNRTEVYAVVDQLHTGRYYMKAFLAEWFGVKVEAIAPYLRVLEGEAAIKHLFRVAAGLDSMVLGETQILGQVKDSYLLAQEVGTSGTIFNHLFKQAVTFAKRAHSETGIGAHAVSVSYAAVELAKKIFGRLAGKHVLIIGAGKMGTLAAQNLYGSGVGKVTVVNRTLEKAKQLAKQFAGEAKPLGELSCALLEADIVISSTGAKGYILTKEMVAPLEKMRKGRPLFMVDIAVPRDLDPALADLETVFLYDIDDLQDVVAANLAERQKAAARIEMMIEAELMAFSQWLQTLGVVPVIAALREKALAIQAETMKSLERKLPHLSERDWKVLNKHTKSIINQLLRDPILQAKELAAGPNAEEALLLFMKIFNIEDAVKAERHMQQ

SEQ ID NO: 23006 - protein, 185 aa, Bacillus stearothermophilus
IEADLSAPDGVEKLVSQIDRPVDAIVYNSGASYYGLLTDMNDELIERMVRLHMTSPALLIKRLIPSMVARKRGHIVFISSIWGLCGASCEAVYSMTKGGQNAFAKALAKELAPSGIRVNAVAPGAIDTDMLRVFRPEELEALTDEIPAGRLGTPDEVAETVAFLLSDAASYITGQVISVNGGWYC

SEQ ID NO: 23007 - protein, 220 aa, Bacillus stearothermophilus
  unsure (1)..(220): unsure at all Xaa locations
MTLLEVKDLFGGYTAQNVLEDMTFAVYRREMVALIGLNGAGKSTTIKHIIGLMEPRRGAISINGYRLADGPETYRRQFAYIPETPVLYEELTLEEHLRLAAMAYGLSEAEYERRLPPLLREFRLERRLSSFPAHFSKGMKQKVMIVCAFLLEPPLYIIDEPFLWLDPIAIHALLERMNEQKANGADILLPTHILATAERYCDXFVILHNGRRKAKGTLDD

SEQ ID NO: 23008 - protein, 303 aa, Bacillus stearothermophilus
EVPAVQINRMCGSGQQAIHFAAQEIRSGDMDVTIAAGVESMTKVPILSDGNEQTIPPSLHEKYEFIHQGVSAERIAKKYGLTREELDAYAYESHQRALAALREGKFRAEIVPVKGLDRDGREILVALDEGPRADTSPEALAALKPVFQEDGLITAGNASQMSDGAAAVLLMEREAARRFGLKPKARIVAQTVVGSDPTYMLDGVIPATRQVLKKASLSIDDIDLIEINEAFAPVVLAWQKEIGAPLEKVNVNGGAIALGHPLGATGAKLMTSLVHELERRGGRYGLLTICIGHGMATATIIER

SEQ ID NO: 23009 - protein, 307 aa, Bacillus stearothermophilus
AASAGKQRTPQKTFVAAPSVRKFAREQNVSLEEITPSGKNGRILKSDIEAALSVRQQKATDEAAASVEILEKQESREKVRRVPLTGIRKAIAKAMVRSTRTIPQVTHFGEPDATRLVQHRRRIQPLAEQQGVKLTYLAYVVKALAAVLKKYPMLNASLDEEREEIVIHEFIHIGFAVDTDRGLLVPVIRDADQKSLFQIAKEIEELTAKARAGTIQAVEMSGGTCTVSNIGSANGSWFTPIIHYPQSCLLGIGKVEKKPVVVDDSIEIASVMPLSLTYDHRLIDGMMAQHALNECQTYLSEPDWLLV

SEQ ID NO: 23010 - protein, 479 aa, Bacillus stearothermophilus
  unsure (1)..(479): unsure at all Xaa locations
KSLVLAEKPSVARDIARVLGCKETHKPYFEGPRYIVTWALGHLVELKMPEDYDRKYETWRLEDLPIIPKKMGLKVIRQTSHQFRAIERLAKRPDVKDVIIATDAGREGELVARWILEMIGWTKPIWRLWISSQTDRAIRDGFRQLKPGAQFDRLYQSAVCRAEADWLIGLNVSRALTTKYNDPLSAGRVQTPTLAMIIEREREIQSFVPVPYWTIRAKIGSITPVWERHGGHRLFDXDEAKQLLARLDGQPARVVSVKRKRKSEPAPLPYDLTELQRDANKRFGFSAKKTLSVLQRLYEQHKLVTYPRTDSRYLPSDMEATMIERLLAMKSGYEDVIAPLLAKGKAKAAKRVFNDDKVTDHHAIVPTDERLNLSRLSTDERKLYDLIARRFLALFFPPYESETTTAVFDIGGEMFVAKETAGVNFGFKAALGKEETDAKPTLSHLAESQTLPSVQLEREQSFTEPPARYSEADLLAQME

SEQ ID NO: 23011 - protein, 361 aa, Bacillus stearothermophilus
LVRPSYVLGGRAMEIVYNRGELLHYMEHAVRVNPQHPVLVDRYITGKEVEVDAIADGETVVIPGIMEHIERAGVHSGDSIAVYPPQTLSAEVIDKIADYTIRLARGLHIVGLLNIQFVVSGSDVYVLEVNPRSSRTVPFLSKITGVPMANLATKAILGAKLAEMGYETGVCPVRSGVYVKVPVFSFAKLRNVDISLGPEMKSTGEVIGKDVTFEKALYKGLVASGIHIQPHGAVLLTVADKDKEEAVDLARRFADIGYQLLATNGTAETLKAAGIPVTVVNKIHSASPNILDVIRQGKAQVVINTLTKGKQPESDGFRIRREAVENGIPCLTSLDTARAMLQVLESMTFSTTAMTEGLVRS

SEQ ID NO: 23012 - protein, 281 aa, Bacillus stearothermophilus
SFSFTKMHGLGNSYIYVDLFRETLPEEELPAIARSVADVHTGIGSDGLILICPSEKAPLKMRIFNSDGSEGKNCGNGLRCVAKYAYEHGIVRDRTFLIETLSGLVEARVAVADGEVTSVTVDMGEPRLERSAIPMVGPKAERVVAEPFAIAGGEYEITAVSMGNPHVIFYVDDIQKAPVTTLGPLVEKDSRFPEGVNVEFVEVVNERELHFRVWERGSGVTQACGTGACAAVVASVLNGKTVRGEETVVHLAGGDLTIVWGHDGRVRMTGPAETVCAGVYY

SEQ ID NO: 23013 - protein, 384 aa, Bacillus stearothermophilus
RNCAFVYSEQFLQYKFHDAHPFNQLRVKMTYDLLCTLGALEDRQIVAPRMATDDELALIHDRSYIEAVKAAGRGELSEAAAQNYGLGTEDTPIFPNMHEASALLVGSTLTAVDAVLSGAAEHALNLGGGLHHGFRGKASGFCVYNDSAVAIQYIREKYGLRVLYVDTDAHHGDGVQWAFYDDPNVCTFSIHKTGRYLFPGTGNVNERGLGAGYGYSFNIPVDAFTEDESWIAAYTTALRKIADFFRPDVIVTQNGVDAHYYDPLTHLSVTMKTYRAIPKLAHEIAHEYCGGRWIAVGGGGYDIWRVVPRAWALLWLEMTGQADVSGPLPDEWRERWQPLSPVALPLEWDDPDDLYPPIPRKAEISEKNAQTVEKALYFIRSQRR

SEQ ID NO: 23014 - protein, 355 aa, Bacillus stearothermophilus
SFQPTEEEQAFFQVARSLAVEKIRPAARECEKRRIVSADLSDRVDELGLSALELPESWGGLELPLLSQAIIWQGLSYGDLGVIQGLPGAGEASSLFRLSSEHRVWHRYREMAKGGWPTVAWIDEAEQKEPLKEAIRVRRRGSGYVVDGVSSPVRLASKADWAVIAARDEEEETVLLALDERVWEIEEGDIRLGLLAAGIARLRFAEVYAGPEQLVACGSEADALLNRVRARNQVIEAAKEVGLMEAALDYTIEYTAGRKAFGQEIAKFQGVSFTIAEMAFECRGAKWLVWQAAAAVDRGDEQAGGYAWSALSRAHRSLRYDTDQAVQMLGGHGYEQEYPAEKWMRDAQAQVMLYG

SEQ ID NO: 23015 - protein, 236 aa, Bacillus stearothermophilus
  unsure (1)..(236): unsure at all Xaa locations
MGITAENLAKKXGISREEQDAFALRSQQRMARAMQEGRFDEQIVPIAVPVKKGEPFIFDTDEHPRPNTTMEALAKLPPAFLEGGTVTAGNSSGLNDGASALVIMSREKAEELGLKPLAAIRAHAVAGVDPNIMGIGPVPATRKVLEKAGLTLDEMDIIEINEAFAAQVIACDRELEMDPEKVNINGGAIAHGHPLGATGAILITKAVYELKRRGGKYALITACIGGGQGIATIIER

SEQ ID NO: 23016 - protein, 378 aa, Bacillus stearothermophilus
DREGQPRLIKYDRFGNDISEVWVNEGYEQTAKQTYETGIVGYVHKPIPELGRKGNYVYSYAQGYVLSQAEPGFYCPVTLTMATAYVLEHFADEKLKATYLPHVISTGEVELYEGATFLTERQGGSDVGANAVRAVPCGDHYKLYGEKYFASNAARCGVALVLARIDGSGPGTKGLSLFLVPWRKEDGTLNGISIRRLKDKLGVRAVPSAEVVFDGAKAYVVGDPAKGFYYMMEVLNLSRVCNAVASVGIMKRALEEAKQYAERRTAFGHVLTDYPMVRETLANLTARQEVETSACFDMIALFDRVMAAPHEASEAEKAWLRLLIALLKMRTAEEAIAFSHEAIELHGGNGYIQDFVTPRLLRGPQVLALWEGTANILA

SEQ ID NO: 23017 - protein, 572 aa, Bacillus stearothermophilus
KFARVALKTRHIDYNGRFCMSAAAAAMNDAFGLDRGLTNPLSDIPLAQTIILAGTNIAECQPTLMPYFYEAKKNGAFIIVVDPRETKTAALADLHLPLKPGTDAALAVGIGKVLLDEGFIDETFVRERTVGFAEWKQHIEAVKMDEIARVTDVPAEKIRLAARKYGEAADAIVLTARGLEQQADGYAAVRHWMNVVLATGKIGRPGSGFGSITGQGNGQGGREHGQKADQLPGYRSIEHLEHRRYIAGIWGISPDELPRKGVSAYEMMQKIDAGEITGLLVMGSNPVVSSPNAAFVAKALQKLKFLVVADMFLSETAELADLVLPVSSYLEDEGTVTNVEGRVCFRPAARKRPGEVKHDWQILCAIAHKLGKGRCFSFTSAEEIFNELRLASRGGKADYYGVTYERLRRERVYWPCPDPHHPGTPRLFTERFAHPDGKARFAVLPFWMDKEETDERYPLYLTTGRVLVHYLSGTQTRRSPALAARQPEATVEIHPRTAKRYGIGPGMLVRIETRRGAAVVRSRYNDQIREDTIFVPFHWSGLGQINNVTSDELDPHCRMPAFKRCAARVRPV

SEQ ID NO: 23018 - protein, 375 aa, Bacillus stearothermophilus
NELGLEADGFLAELVDDLQSKISAYRSEPPRLFDAIKASGEDHNARLMALYLQDCGLEASYVSPLEAGIIVTDEPGNAQVLPESYDKLKQLRERRGVLVIPGFFGYSRSGHIVTFPRGGSDITGSIVAAGVKADVYENFTDVDSIYCVNPSIVADARKLKEITYREMRELSYSGFSVFHDEALEPVYRAGIPVCVKNTNNPAAPGTWIVAKRNHIDEPVAGIASDTGFCSINISKYLMNREIGFGRRVLQILEDEGISYEHTPSGIDNMSIILRADQLADGKEKRILARIREELAVDEVTIEYGLALIMVVGEGMEKTIGMAAKATTALADANINLEMINQGSSEVSMMFGVKEEVVNEAVRALYNAYFQQATVS

SEQ ID NO: 23019 - protein, 193 aa, Bacillus stearothermophilus
REATIARTTNETSIQLSLSLDGEGKAELETGVPFLTHMLDLFAKHGQFDLYIEAKGDTHIDDHHTTEDIGICLGQAIKEALGDKKGIKRYGNAFVPMDDALAQVVIDLSNRPHFEFRGEFPATKVGAFDVELVHEFLWKLALEARMNLHVIVHYGRNTHHMIEAVFKALGRALDEATMIDPRVKGVPSTKGML

SEQ ID NO: 23020 - protein, 274 aa, Bacillus stearothermophilus
LVSHEWLLRHLHDENTRILDCRFWLGDPAKGAAVYQEDHIPGAVYMDLERDLSGPVGEHGGRHPLPSAEQAADVFGRVGIDETVTVVAYDDQDGAMAARCWWLLRYFGHAHAYVLDGNYREWKKKGHPVTNVVPAVASRPFRPRPDRSWLATVEDVRAAVRDRSAVLIDSREWKRYAGLEEPIDRRAGRIPGAVHRFWKDGMTEGGYWKSAVEQAARFADFDRGQPLIVYCGSGVTACPNVLALHEAGYHNVRLYVGSFSDWISYPDHPIETGD

SEQ ID NO: 23021 - protein, 182 aa, Bacillus stearothermophilus
VTKQKEKRGRRWPWFVAVCVVATLRLFVFSNYMVEGKSMMPTLESGNLLIVNKLSYDIGPIRRFDIIVFHANKKEDYVKRVIGLPGDRIAYKNDILYVNGKKVDEPYLRPYKQKLLDGRLTGDFTLEEVTGKTRVPPGCIFVLGDNRLSSWDSRHFGFVKINQIVGKVDFRYWPFKQFAFQF

SEQ ID NO: 23022 - protein, 190 aa, Bacillus stearothermophilus
NLPNKITVARIMLIPFFLIVMLVPFGWGSIQIGGTELPVAHLAGALIFIIASATDWIDGYYARKYGLVTNLGKFLDPLADKLLVSAALIVLVELGAVPAWMVIVIISREFAVTGLRLVLAGEGEVVAANMLGKIKTWTQIVAISALLLHNFPFSLISFPFAELALWVAVIFTIWSGWDYFAKNRHAFSHS

SEQ ID NO: 23023 - protein, 371 aa, Bacillus stearothermophilus
EHHMFRAAFRKFLEKEAYPHYNDWEKRGIIPRSFWAKMGENGFLCPWVDEKYGGLNADFAYSVVINEELEKVGSSLVGIGLHNDIVTPYIASYGTEEQKQKWLPKCVTGELITAIAMTEPGAGSDLANISTTAVKDGDYYIVNGQKTFITTGIHADLIVVACKTDPQAKPPHRGISLLVVERDTPGFTRGRKLEKVGLHAQDTAELFFQDAKVPAYNLLGEEGKGFYYLMEKLQQERLVVAIAAQTAAEVMFSLTKQYVKQRTAFGKRVSEFQTVQFRLAEMATEIALGRTFVDRVIEEHMAGKQIVTEVSMAKWWITEMAKRVAAEAMQLHGGYGYMEEYEIARRYRDIPVSAIYAGTNEMMKTIIARQL

SEQ ID NO: 23024 - protein, 387 aa, Bacillus stearothermophilus
MQEFIFRNPTKLIFGKGQLERLKEEVPRYGKKVLLVYGGGSIKRNGLYDEVMKILGNIGAEVIELPGVEPNPRVSTVRKGVDICKREGVEFLLAVGGGSVIDCTKAIAAGAKFDGDPWDFITKKAPVTGALPFGVVLTLAATGSEMNSGSVITNWETKEKYGWGSPFTFPQFSILDPTYTMTVPKDHTVYGIVDMMSHVFEQYFHHTPNTPLQDRMCEAVLKTVIETAPKLINDLENYELRETIMYSGTIALNGFLQMGVRGDWATHNIEHAVSAVYDIPHAGGLAILFPNWMKHVLDENVSRFAQLAVRVFDVDPAGKSERDVALEGIERLREFWSSLGAPSRLADYGIGEENLELMADKAMAFGEFGRFKTLNRDDVLAILRASL

SEQ ID NO: 23025 - protein, 243 aa, Bacillus stearothermophilus
MKPISIIGVPMDLGQTRRGVDVGPSAMRYAGVIERLERLHYDIEDLGDIPIGKAERLHEQGDSRLRNLKAVAEANEKLAAAVDQVVQRGRFPLVLGGDHSIAIGTLAGVAKHYERLGVIWYDAHGDVNTEETSPSGNIHGMPLAASLGFGHPALTQIGGYSPKIKPEHVVLIGVRSLDEGEKKFIREKGIKIYTMHEVDRLGMTRVMEETIAYLKERTDGVHLSLDLDGLDPSDAPGVGTPVI

SEQ ID NO: 23026 - protein, 304 aa, Bacillus stearothermophilus
PASVPAFSLNRMCGSSQQAIHSAAQAILAGDIDIAIAAGVESMTRVPMGSDMGRFSRQLTSRYNIVPQGISAEMIAKKWGLSREELDEFSLASHEKAAAATDRGMFEREIIPLDVPGEDGAVRFARDEGIRRDTSLEKLAALTPSFQPKGGVITAGNSSQVSDGAAGVLLMSAEKAAALGLRPRARIVARAVVGEDPVMMLTGIIPATRSVLQKAGLRLDQMDAIEVNEAFASVVKAWERELEPDMTKVNPRGGAIALGHPLGASGARLMTTLLHELEDMDGTYGLQVMCIGFGMATATIIERL

SEQ ID NO: 23027 - protein, 453 aa, Bacillus stearothermophilus
MNERIERDSLGEVRVPADKYWGAQTERSRQNFRIGKETMPLELIYAYAELKKAAAIVNHRAGKLSEAKQRAIVAACEEILAGQWDDHFPLVVWQTGSGTQTNMNVNEVVARRASELLDEGEGRIHPNDDVNMSQSSNDTFPTVMHIAIFTKIQTHLLPALDGLIGTFATKERQYGKTIKIGRTHLQDATPLTFGQEISGWRAMLEKSKAMIMEASEKLLDLAIGGTAVGTGINAPPGFGEQVAEQLKTQTGYPFRSSTNKFHALTSHDEIVYVHGALKALAADLMKIANDIRWLASGPRSGLGEITIPANEPGSSIMPGKVNPTQSEAMTMVAVQVFGNDATIGFAASQGNFQLNVFKPVIAYNAIQSVQLLGDVIRSFDERCAQGLEANEAKMKEYVDRSLMLVTALSPHIGYDRAGEIAKLAHLERLTLKETAMKTWYCTGEQDEEWGKPE

SEQ ID NO: 23028 - protein, 558 aa, Bacillus stearothermophilus
TVVLALGVQRMIKRNAIVRKLPAVETLGCASVICSDKTGTMTENMMTVTQVWAGGRTFAVSGVGLETDGEFSERGRTVDPNRVPELARLLTMGVLCNSSELKEENGRRYVDGDPTEGALLVAAAKAGLAKGMLLREYTIEQEFPFDSERKMMTVIIRDRNGRRFVVTKGAPDVLLERADRLEWNGREQMLTPAWKETIEKAIRQMASSALRTIAVAYRPLSETERIESEKDAETKLRFLGVAGMIDPPRPEVKQAVARCKEAGMKTVMITGDHVLTATAIAKQLGVLPPGGKVMDGATLSKLSVDELERVVDEIYVFARVAPEHKLKIVNALKRRGHIVAMTGDGVNDAPALKAADIGVAMGRSGTEVAKEAASLVLLDDNFATIEAAIEEGRNIYENIRKFIRYLLASNVGEILVMLFAMLLALPLPLVPIQILWVNLVTDGLPAMALGLDQPEENVMKRPPRRPDEGVFARGLGWKIVSRGFLIGVVTLAAFLTAYERSGEDLVYAQTAAFATLVLAQLIHVFDCRCDHSVFDRSPFGNIYLVAAVIVSLLLLVVV

SEQ ID NO: 23029 - protein, 252 aa, Bacillus stearothermophilus
MAETQFTRFPFQPFIIEAIKTLRFYKPTEIQERIIPGALRGESMVGQSQTGTGKTHAYLLPIMEKIKPERAEVQAVITAPTRELATQIYHETLKITKFCPKDRMIVARCLIGGTDKQKALEKLNVQPHIVIGTPGRINDFIREQALDVHTAHILVVDEADLMLDMGFITDVDQIAARMPKDLQMFVFSATIPEKLKPFLKKYMENPTFVHVNPKQTANENIEHVLIPLRGREKTKLLHDVLLSYNPYLAIVF

SEQ ID NO: 23030 - protein, 442 aa, Bacillus stearothermophilus
TYAEWEREVNRWANAFLEAGVRKGDRVSTVLYNTLELATALFACAKIGAVFNPINFRLRAEEIAYILTDAEPKIVLFERAVEPELAAIHSRFPHVSFWSIDRDPPPFAKNAHEQAARALGEAPRVHVDESDLYAIMYTSGTTGRPKGVMHRHRDMIEQSVICHGVMRIRETDRRLAAAPLFHCAELHCCLLPRVHAGAASVILHQFDAKLVLETIERERITIMFGAPTMWNMILQENVSGYDLSSLRLGLYGAAPMAPALVRQCQEQLGIELIQAYGMTEMGPAVTFLLEDEQLKKAGSAARACLNHEIRVVRAREDGPSDPDDVLPPYEVGEIVMRGPCMMAGYYKREEATEKALYKGWYHSGDLGYLDEDGYLYVADRVDDMVISGGENVYPREVENVLYEHPKVLDVAVLGEPDELWGEQVVAFVVKKDDLLTADELEQ

SEQ ID NO: 23031 - protein, 525 aa, Bacillus stearothermophilus
MRREDLIAPERYNLTSEMERHAAAGPDRIALKWESEQGETKEITYGRLMACANQIGNAFLSHGLEKGDKVLVMMPRLIETYEVYIGVLKAGLVVIPSSEMLRTKDLQYRLVHSEAKAVVAYAPYTDEFAPIDGIERLTKFVIGEPRDGWIPLEDAMAKESETLEAADTSRDDMAFLSYTSGTTGNPKGVVHCHGWAYAHLRTAAKNWLCIEEGDLVWATAGPGWPKWIWSPFLSVLGSGATGFVYYGRFEPEKYLQLLEKYNINVLCCTPTEYRLMAKVPDIGRYHLSHLHSAVSAGEPLNREVIDTFAKHFGVEVRDGYGQTENTLLVGVMKGMPIKPGSMGKPTPGNRVEIIDENGEPCPPGQVGDIAVHIETPALFKYYYKDPERTAMQFRGDYYITGDKARKDEDGYFWFEGRGDDIIISAGYTIGPFEVEDALVKHPAVKECAVVASPDEVRGHVVKAFVVLRDGVDKDDPSLIPALQEHVKQLTAPYKYPRKIEFVDDLPKTASGKIRRVELREREARL

SEQ ID NO: 23032 - protein, 312 aa, Bacillus stearothermophilus
LKIVVTGGAGFIGSHLAARLSGLGYDVAAVDCFHPYYSAERKERQFQTLTGGRVPLVRLDLLDGERTKRWLVEFRPDVVYHLAALPGVPYSLEEPLAYIDYDIKATVNVLAAAGEAGAAHVLFASSSSVYGDRGNVPLREEMADGRVVSPYAAAKYGAESFCHAYAHLYGYQMTIFRYFTVYGPWGRPDMAIGTFLPPIAGGRAIVVYGKGTARDYTYIDDIVEGMIAALHRSGGRSEVFNLGAGAPVTMEQLLAELRKHFPDMKIVHAPERKGDVKATWADITKAERAFGYKPKVAFAEGLARTVAWAREY

SEQ ID NO: 23033 - protein, 253 aa, Bacillus stearothermophilus
PLAKITEEQAKRLEERLNEGQDEVEFRMYLWLKHIEPFIEDAVKRMHDDGIKEADGIVLAPHYSTFSIRSYNERAKAAAEKLGGPTIYTIDQWYDEPKFLQYWAEQVRAIFAAMPERERERAVLIVSAHSLPEKIIQAGDPYPTQLEDTAKRIADQAGVAHYAVGWQSAGQTPEPWLGPDVQDLTRQLYEERGYTSFVYAPVGFVADHLEVLYDNDIECKQVTEEIGARYYRPEMPNTNPLFIDALASVVLKR

SEQ ID NO: 23034 - protein, 254 aa, Bacillus stearothermophilus
MHVLDLFKIEGKTAIVTGGGRGLGEQIAVGLAEAGANVVVCSRKVEACEQVKEKLEQLGVRSLALRCDVTNPEEVKHVVETTVKEFGGIDILVNNSGATWGAPVEEMPLEAWQKVINVNVTGTFLMSQAVGKVMIAKQTGGSIINIASVAGLGGTHPDILNTIGYNTSKGAGITFTRDLAAKWGKHGIRVNAEAPGFLPTKMSKVALERVGKKVLEHTPLGRFGGEDDLKGAVLFLASPASAFVTGALLVVDGG

SEQ ID NO: 23035 - protein, 305 aa, Bacillus stearothermophilus
  unsure (1)..(305): unsure at all Xaa locations
VFNCYAPDTGIMEVLVRYGTXEQKKKWLIPLLNGEIRSCFSMTEPDVASSDATNIRASIRPDGDEYVITGRKWWSSGAGDPRCKVAIVMGKTNPDAPKHEQQSMIIVPLDTPGVKIERMLPVFGFDHAPHGHAEITYDHVRVPKENIIWGEGKGFAIAQGRLGPGRIHHCMRLIGAAERALELMCRRVQSRVAFGKPLAEHGVIREWIAQSRIEIEQARLLTLKAAYMMDTVGNKAARKEIAMIKVVAPNVALKVIDRAIQAFGAAGVSNDFPLAAMWANSRTLRLADGPDEVHKEQVAKLELRQ

SEQ ID NO: 23036 - protein, 281 aa, Bacillus stearothermophilus
VAETIAVIGAGVMGSGIAQTAAMAGKTVYLYDVSEAALQNGLASAEKSLRRFVKTGGLSEPEARAALGRIRSTVDLAEAVRGADVVIEAVPENLALKKDVFQQLDQLAKPDAILATNTSELSVTALAAATNRPENVIGMHWFNPAPVMKLIEIVKGETTSDDTVDAIRRLSVELGKETVVVKDRQGFVTTRALAAHMIECIRMYEEGVASAEDIDKAVRLGLNYPMGPFELADMVGLDTLLFVSENMTEAYGDRFRAPQLLRKLVEAGHLGRKTGKGFYTY

SEQ ID NO: 23037 - protein, 308 aa, Bacillus stearothermophilus
MTHLFALSELPLDEIHRLLDEAEAFRSGRIWRPAAPMYVANLFFEPSTRTKCSFEMAERKLGLHVIPFDPERSSVQKGETLYDTVRTLEAIGVDAVVIRHHEDAYFEALRHAVGIPIINAGDGCGHHPTQSLLDLLTIRQEFGAFTGLTVAIIGDIRHSRVARSNAEVLTRLGANVLFSGPAEWKDETNPYGTYVEVDEAIARADVVMLLRIQHERHAETMGLTKEEYHARYGLTLERARRMKSGAIILHPAPVNRGVEIASELVEAKASRIFKQMENGVYMRMAVLKRAMEGRMEHGRMAEKWHVVQ

SEQ ID NO: 23038 - protein, 520 aa, Bacillus stearothermophilus
  unsure (1)..(520): unsure at all Xaa locations
MNAPLLLHHFFDSAVALYGDKTAMICSGRTVTYRELGERVSRLANGLRGLGVRKGDRVAYLAPNTLEMLEGFYGVFEVGGVMVPLNTRLKPDDYVFILNHSETKVLFVDQELYGLIAPVKNKLETVEEIIVHHKTEATIDETAYDEWLAAQSSAPVPRPMIDENDVCSLLYTSGTTGNPKGVMLTHRNNYLHALVTMHHLRVSDRDTYLHVLPMFHVNGWGAPFYYTANGATQIGLRKVDPKVIFDLVKEHQVTVMHMAPTVLNMLLQYYEQYQPDVPEGVRVVIAGSAPPPAFVARVEEKLGWEFIQVYGMTESSPLSTISLIRPQLDGLPVEQKQRIKAKAGYPMIGCEVKVVDENGDEVPHNGRAIGEVIVRSHGVMKGYWKNEEATAATIRDGWLYTGDMATVDEYGHIDIVDRKKDIIISGGENISSIEVEAALYEHPAVLEAAVIAAPHEKWGETPHAFVXLAPRHNVIDDELIVFSLEKLAHLKAIYSVTCFYELPKTACGKIQKVHLRRQYW

SEQ ID NO: 23039 - protein, 411 aa, Bacillus stearothermophilus
KVLLTNKEQRAKLPPRDNMPTLEHIFVIDGPSHDQDQPFWETLSKESTEHSIEETTVDDLLAIQYTSGSTGMPKGAMWPHNVLINIYPYMRYAIGLRDDDVFFGGADPGWAYGLIFCTFAPMAFGVPIVFYEGPFKPETCYSLMEKYRVTNFAYAPTAYRAMAAAGADVIRRYQLNVRAMSSAGEPLNPEVIRFFQEHVGVTIHDHYGLSETLMLIGNFNAAEMEIRPGSMGWPLPGFDVALLDENGTPVADGEVGQIAFNTDSIPNVFKGYWKDPEKTAERLVGKWFLTGDLATKDEDGYFWFQGRADDIISSAGYRIGPFEIESCLLEHPAVVEAAAVGKPDPVKGEIVKAFVVLREGFAPSDELADELSLFVKTRLSKHEYPREVEFVAELPKTPSGKIQRFILRNQE

SEQ ID NO: 23040 - protein, 647 aa, Bacillus stearothermophilus
  unsure (1)..(647): unsure at all Xaa locations
ESTWGEALDLVAEKLGAIKRQYGGNAIGFISSSKISNGENYLMQKLARQVFETNNVDNCSRYCQSPATDGLFRTVGMGGDSGTIHDIASAGLVIIIGANPAEGHPVIATRVKRAHKLFGQKLIVADLRRNEMAERADLFIRPKQGTDQVWLMAVTKYIIDQGWHDEAFIRERVHFFEEFKQLLEKYTLDYAEQVTGVAKADLIRIAEMIREADGTCVLWGMGVTQNTGGSDTSAAISNLLLATGNYGRPGAGAFPLRGHNNVQGACDMGSLPVWLPGYQHVTDDEARAKFEKAYGVRIDAKPGLDNIQMLEAAERGELKAMYIIGEDMALVDCNANHVQETLASLYFVVHQHIFLXETAQFADVILPSAPSLEKEGTFTNTERRIHRFYQALEPLGDSKPDWWIIQEIAKRLGADWNYAGPKEIMDEIASLAPLYSQAHYDRLEGWNSLCWGSHDGADTPLLYKERFNFPDGKARFALADWVEPVQYPEEYDLLVNNGRLLEHFHEGNLTYKSKGIEHKFPEVFVEVSPELAKERGIEDGALVRLISPYGRVKVRVLVTDRVRGNELFLPMHSTANESAINMLTGPQTDHRTNTPAYKQARVRMEVIERSGKTPLPRTNPRFKKRHPQNGVEVERKWRRSDYVPLTE

SEQ ID NO: 23041 - protein, 328 aa, Bacillus stearothermophilus
MMSAFQAFVVNKTETEFTAGVQTISMDDLPEGDVLVRVHYSSVNYKDGLASIPDGKIVKTYPFVPGIDLAGVVVSSQHPRFREGDEVIATGYEIGVTHFGGYSEYARLHGEWLVPLPKGLTLKEAMAIGTAGFTAALSIHRLEEHGLTPERGPVLVTGATGGVGSLAVSMLAKRGYTVEASTGKAAEHDYLRVLGAKEVLAREDVMAERIRPLDKQRWAAAVDPVGGRTLATVLSRMRYGGAVAVSGLTGGAEVPTTVHPFILRGVSLLGIDSVYCPMDLRLRIWERLAGDLKPDLERIAQEISLAELPQALKRILRGELRGRTVVRL

SEQ ID NO: 23042 - protein, 342 aa, Bacillus stearothermophilus
  unsure (1)..(342): unsure at all Xaa locations
IPFYDSXSKGRGILKKLINDPQRVVDDMLEGFVAAHSRRVRRIPGTNVIVRKDAPVKGKVGIVSGGGSGHEPAHAGYVGKGMLDAAVCGEVFTSPTPDQILAAIQAVDSGNGVLLIIKNYTGDVMNFEMAAELAEAEGIRVAKVIVNDDVAVEDSTFTTGRRGIAGTVFVHKIAGALAERGASLEEVEAAAKKAIQGVRSMGVALNPCIVPAAGTPGFALGENEMEVGIGIHGEPGIEKVTVQPAENIADGLLVRIVEDMKLNQGDQVAVMINGLGATPLMELYIVHKRVAEWLAEKQIHIHETFVGEYMTSLEMAGCSISLLKLDDEMIDLLRSPADAAAF

SEQ ID NO: 23043 - protein, 376 aa, Bacillus stearothermophilus
MRRKTMLIHGGIPGDPHTGAVSVPIYQVSTYKQEEVGKHKGFEYSRTGNPTRAALEKLIADLEGGEAGFAFASGMAAITAVMMLFQSGDHLVLTDDVYGGTYRVMTNVLNRFGLEATFVDTSDVANIEAHIRPNTKAIYIETPTNPLLKITDLQAAAAIARAHGLLLIVDNTFSTPYFQTPLELGADIVIHSATKYLGGHSDVVAGLAVVRTPELAERLHYVQNSTGGVLGPQDSWLLMRGMKTLAVRMEEYEENARQIAVFLAEHKTVKRVHYPGLPDHPNHELAKKQMRGFGGMISFDVGSLECAEKVLSRVRYFTLAESLGAVESLISLPGKMTHASIPKERREQLGITDGLIRLSVGLEDVNDLLDDLAQAL

SEQ ID NO: 23044 - protein, 244 aa, Bacillus stearothermophilus
  unsure (1)..(244): unsure at all Xaa locations
ILEVSNVSKVFKWKDKTIRAVNQVSFHLTEKAIIGISGRNGSGKTTLLKLIAGLLIPDEGNVMLFGQPLNDRNAKENVSILLEGSRSFYWNLRGRENLEYFCQLNKIRNMKKEIDNMIELLRLDTFIDNLTGSYSRGMQQKLSLAIALLSKPKLLILDEPTNGLDYESKVQLSKILQQLVSELGISILIVCHESVFLQSTVNHILIMEKGAIVESLKINKTDFNFYDFVSFEFSGSRVLINQXY

SEQ ID NO: 23045 - protein, 212 aa, Bacillus subtilis [sequence omitted]

SEQ ID NO: 23046 - protein, 289 aa, Bacillus subtilis
MRILEKAPAKINLSLDVTRKRPDGYHEVEMIMTTIDLADRIELTELAEDEVRVSSHNRFVPDDQRNLAYQAAKLIKDRYNVKKGVSIMITKVIPVAAGLAGGSSDAAATLRGLNRLWNLNLSAETLAELGAEIGSDVSFCVYGGTALATGRGEKIKHISTPPHCWVILAKPTIGVSTAEVYRALKLDGIEHPDVQGMIEAIEEKSFQKMCSRLGNVLESVTLDMHPEVAMIKNQMKRFGADAVLMSGSGPTVFGLVQYESKVQRIYNGLRGFCDQVYAVRMIGEQNALD

SEQ ID NO: 23047 - protein, 317 aa, Bacillus subtilis
MSNQYGDKNLKIFSLNSNPELAKEIADIVGVQLGKCSVTRFSDGEVQINIEESIRGCDCYIIQSTSDPVNEHIMELLIMVDALKRASAKTINIVIPYYGYARQDRKARSREPITAKLFANLLETAGATRVIALDLHAPQIQGFFDIPIDHLMGVPILGEYFEGKNLEDIVIVSPDHGGVTRARKLADRLKAPIAIIDKRRPRPNVAEVMNIVGNIEGKTAILIDDIIDTAGTITLAANALVENGAKEVYACCTHPVLSGPAVERINNSTIKELVVTNSIKLPEEKKIERFKQLSVGPLLAEAIIRVHEQQSVSYLFS

SEQ ID NO: 23048 - protein, 180 aa, Bacillus subtilis
MMKHDIEKVLISEEEIQKKVKELGAELTSEYQDTFPLAIGVLKGALPFMADLIKHIDTYLEMDFMDVSSYGNSTVSSGEVKIIKDLDTSVEGRDILIIEDIIDSGLTLSYLVELFRYRKAKSIKIVTLLDKPSGRKADIKADFVGFEVPDAFVVGYGLDYAERYRNLPYIGVLKPAVYES

SEQ ID NO: 23049 - protein, 637 aa, Bacillus subtilis
MNRVFRNTIFYLLILLVVIGVVSYFQTSNPKTENMSYSTFIKNLDDGKVDSVSVQPVRGVYEVKGQLKNYDKDQYFLTHVPEGKGADQIFNALKKTDVKVEPAQETSGWVTFLTTIIPFVIIFILFFFLLNQAQGGGSRVMNFGKSKAKLYTEEKKRVKFKDVAGADEEKQELVEVVEFLKDPRKFAELGARIPKGVLLVGPPGTGKTLLAKACAGEAGVPFFSISGSDFVEMFVGVGASRVRDLFENAKKNAPCLIFIDEIDAVGRQRGAGLGGGHDEREQTLNQLLVEMDGFSANEGIIIIAATNRADILDPALLRPGRFDRQITVDRPDVIGREAVLKVHARNKPLDETVNLKSIAMRTPGFSGADLENLLNEAALVAARQNKKKIDARDIDEATDRVIAGPAKKSRVISKKERNIVAYHEGGHTVIGLVLDEADMVHKVTIVPRGQAGGYAVMLPREDRYFQTKPELLDKIVGLLGGRVAEEIIFGEVSTGAHNDFQRATNIARRMVTEFGMSEKLGPLQFGQSQGGQVFLGRDFNNEQNYSDQIAYEIDQEIQRIIKECYERAKQILTENRDKLELIAQTLLKVETLDAEQIKHLIDHGTLPERNFSDDEKNDDVKVNILTKTEEKKDDTKE

SEQ ID NO: 23050 - protein, 810 aa, Bacillus subtilis
MMFGRFTERAQKVLALAQEEALRLGHNNIGTEHILLGLVREGEGIAAKALQALGLGSEKIQKEVESLIGRGQEMSQTIHYTPRAKKVIELSMDEARKLGHSYVGTEHILLGLIREGEGVAARVLNNLGVSLNKARQQVLQLLGSNETGSSAAGTNSNANTPTLDSLARDLTAIAKEDSLDPVIGRSKEIQRVIEVLSRRTKNNPVLIGEPGVGKTAIAEGLAQQIINNEVPEILRDKRVMTLDMGTVVAGTKYRGEFEDRLKKVMDEIRQAGNIILFIDELHTLIGAGGAEGAIDASNILKPSLARGELQCIGATTLDEYRKYIEKDAALERRFQPIQVDQPSVDESIQILQGLRDRYEAHHRVSITDDAIEAAVKLSDRYISDRFLPDKAIDLIDEAGSKVRLRSFTTPPNLKELEQKLDEVRKEKDAAVQSQEFEKAASLRDTEQRLREQVEDTKKSWKEKQGQENSEVTVDDIAMVVSSWTGVPVSKIAQTETDKLLNMENILHSRVIGQDEAVVAVAKAVRRARAGLKDPKRPIGSFIFLGPTGVGKTELARALAESIFGDEESMIRIDMSEYMEKHSTSRLVGSPPGYVGYDEGGQLTEKVRRKPYSVVLLDEIEKAHPDVFNILLQVLEDGRLTDSKGRTVDFRNTILIMTSNVGASELKRNKYVGFNVQDETQNHKDMKDKVMGELKRAFRPEFINRIDEIIVFHSLEKKHLTEIVSLMSDQLTKRLKEQDLSIELTDAAKAKVAEEGVDLEYGARPLRRAIQKHVEDRLSEELLRGNIHKGQHIVLDVEDGEFVVKTTAKTN

SEQ ID NO: 23051 - protein, 483 aa, Bacillus subtilis
MGNEVRVRYAPSPTGHLHIGNARTALFNYLFARNQGGKFIIRVEDTDKKRNIEGGEQSQLNYLKWLGIDWDESVDVGGEYGPYRQSERNDIYKVYYEELLEKGLAYKCYCTEEELEKEREEQIARGEMPRYSGKHRDLTQEEQEKFIAEGRKPSIRFRVPEGKVIAFNDIVKGEISFESDGIGDFVIVKKDGTPTYNFAVAIDDYLMKMTHVLRGEDHISNTPKQIMIYQAFGWDIPQFGHMTLIVNESRKKLSKRDESIIQFIEQYKELGYLPEALFNFIGLLGWSPVGEEELFTKEQFIEIFDVNRLSKSPALFDMHKLKWVNNQYVKKLDLDQVVELTLPHLQKAGKVGTELSAEEQEWVRKLISLYHEQLSYGAEIVELTDLFFTDEIEYNQEAKAVLEEEQVPEVLSTFAAKLEELEEFTPDNIKASIKAVQKETGHKGKKLFMPIRVAVTGQTHGPELPQSIELIGKETAIQRLKNI

SEQ ID NO: 23052 - protein, 1193 aa, Bacillus subtilis
MTGQLVQYGRHRQRRSYARISEVLELPNLIEIQTSSYQWFLDEGLREMFQDISPIEDFTGNLSLEFIDYSLGEPKYPVEESKERDVTYSAPLRVKVRLINKETGEVKDQDVFMGDFPIMTDTGTFIINGAERVIVSQLVRSPSVYFSGKVDKNGKKGFTATVIPNRGAWLEYETDAKDVVYVRIDRTRKLPVTVLLRALGFGSDQEILDLIGENEYLRNTLDKDNTENSDKALLEIYERLRPGEPPTVENAKSLLDSRFFDPKRYDLANVGRYKINKKLHIKNRLFNQRLAETLVDPETGEILAEKGQILDRRTLDKVLPYLENGIGFRKLYPNGGVVEDEVTLQSIKIFAPTDQEGEQVINVIGNAYIEEEIKNITPADIISSISYFFNLLHGVGDTDDIDHLGNRRLRSVGELLQNQFRIGLSRMERVVRERMSIQDTNTITPQQLINIRPVIASIKEFFGSSQLSQFMDQTNPLAELTHKRRLSALGPGGLTRERAGMEVRDVHYSHYGRMCPIETPEGPNIGLINSLSSYAKVNRFGFIETPYRRVDPETGKVTGRIDYLTADEEDNYVVAQANARLDDEGAFIDDSIVARFRGENTVVSRNRVDYMDVSPKQVVSAATACIPFLENDDSNRALMGANMQRQAVPLMQPEAPFVGTGMEYVSGKDSGAAVICKHPGIVERVEAKNVWVRRYEEVDGQKVKGNLDKYSLLKFVRSNQGTCYNQRPIVSVGDEVVKGEILADGPSMELGELALGRNVMVGFMTWDGYNYEDAIIMSERLVKDDVYTSIHIEEYESEARDTKLGPEEITRDIPNVGEDALRNLDDRGIIRIGAEVKDGDLLVGKVTPKGVTELTAEERLLHAIFGEKAREVRDTSLRVPHGGGGIIHDVKVFNREDGDELPPGVNQLVRVYIVQKRKISEGDKMAGRHGNKGVISKILPEEDMPYLPDGTPIDIMLNPLGVPSRMNIGQVLELHMGMAARYLGIHIASPVFDGAREEDVWETLEEAGMSRDAKTVLYDGRTGEPFDNRVSVGIMYMIKLAHMVDDKLHARSTGPYSLVTQQPLGGKAQFGGHGFGEMEVWALEAYGAAYTLQEILTVKSDDVVGRVKTYEAIVKGDNVPEPGVPESFKVLIKELQSLGMDVKILSGDEEEIEMRDLEDEEDAKQADGLALSGDEEPEETASADVERDVVTKE

SEQ ID NO: 23053 - protein, 277 aa, Bacillus subtilis
MAIKKYKPSSNGRRGMTTSDFAEITTDKPEKSLLAPLHKKGGRNNQGKLTVRHQGGGHKRQYRVIDFKRDKDGIPGRVATVEYDPNRSANIALINYADGEKRYILAPKGIQVGTEIMSGPEADIKVGNALPLINIPVGTVVHNIELKPGKGGQLVRSAGTSAQVLGKEGKYVLVRLNSGEVRMILSACRASIGQVGNEQHELINIGKAGRSRWKGIRPTVRGSVMNPNDHPHGGGEGRAPIGRKSPMSPWGKPTLEFKTRKQKNKSDKFIVRRRKNK

SEQ ID NO: 23054 - protein, 276 aa, Bacillus subtilis
MKTPFERLALYDINASIKEGSYVAVIGHTGSGKSTLLQHLNGLLKPTKGQISLGSTVIQAGKKNKDLKKLRKKVGIVFQFPEHQLFEETVLKDISFGPMNFGVKKEDAEQKAREMLQLVGLSEELLDRSPFELSGGQMRRVAIAGVLAMDPEVLVLDEPTAGLDPRGRKEIMDMFYELHQRGNLTTILVTHSMEDAAAYADEMIVMHKGTIQASGSPRDLFLKGEEMAGWGLDLPETIKFQRHLEAALGVRFNEPMLTIEDAAAEIRALFQGEKTL

SEQ ID NO: 23055 - protein, 448 aa, Bacillus subtilis
MGKYFGTDGVRGVANSELTPELAFKVGRFGGYVLTKDKQRPKVLIGRDTRISGHMLEGALVAGLLSIGAEVMRLGVISTPGVSYLTKAMDAEAGVMISASHNPVQDNGIKFFGGDGFKLSDEQEAEIERLMDEPEDKLPRPVGADLGLVNDYFEGGQKYLQFLKQTADEDFTGIHVALDCANGATSSLATHLFADLDADVSTMGTSPNGLNINDGVGSTHPEALSAFVKEKNADLGLAFDGDGDRLIAVDEKGNIVDGDQIMYICSKHLKSEGRLKDDTVVSTVMSNLGFYKALEKEGIKSVQTAVGDRYVVEAMKKDGYNVGGEQSGHLIFLDYNTTGDGLLSAIMLMNTLKATGKPLSELAAEMQKFPQLLVNVRVTDKYKVEENEKVKAVISEVEKEMNGDGRILVRPSGTEPLVRVMAEAKTKELCDEYVNRIVEVVRSEMGLE

SEQ ID NO: 23056 - protein, 600 aa, Bacillus subtilis
MCGIVGYIGQLDAKEILLKGLEKLEYRGYDSAGIAVANEQGIHVFKEKGRIADLREVVDANVEAKAGIGHTRWATHGEPSYLNAHPHQSALGRFTLVHNGVIENYVQLKQEYLQDVELKSDTDTEVVVQVIEQFVNGGLETEEAFRKTLTLLKGSYAIALFDNDNRETIFVAKNKSPLLVGLGDTFNVVASDAMAMLQVTNEYVELMDKEMVIVTDDQVVIKNLDGDVITRASYIAELDASDIEKGTYPHYMLKETDEQPVVMRKIIQTYQDENGKLSVPGDIAAAVAEADRIYIIGCGTSYHAGLVGKQYIEMWANVPVEVHVASEFSYNMPLLSKKPLFIFLSQSGETADSRAVLVQVKALGHKALTITNVPGSTLSREADYTLLLHAGPEIAVASTKAYTAQIAVLAVLASVAADKNGINIGFDLVKELGIAANAMEALCDQKDEMEMIAREYLTVSRNAFFIGRGLDYFVCVEGALKLKEISYIQAEGFAGGELKHGTIALIEQGTPVFALATQEHVNLSIRGNVKEVAARGANTCIISLKGLDDADDRFVLPEVNPALAPLVSVVPLQLIAYYAALHRGCDVDKPRNLAKSVTVE

SEQ ID NO: 23057 - protein, 462 aa, Bacillus subtilis
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 23058 - protein, 539 aa, Bacillus subtilis
MNQLHRRMGTFSLMMVGLGSMIGSGWLFGAWRAAQIAGPAAIISWVIGMVVILFIALSYSELGSMFPEAGGMVKYTQYSHGSFIGFIAGWANWIAIVSVIPVEAVASVQYMSSWPWEWAKWTSGLVKNGTLTGEGLAFASVLLLIYFLLNYWTVNLFSKANSLITIFKIIIPGLTIGALLFVGFHGENFTGGQSIAPNGWASVLTAVATSGIVFAFNGFQSPINMAGEAKNPGKSIPIAVVGSLFVATVIYVLLQIAFIGAVNPSDIAHGWSHLNFNSPFADLAIALNINWLVIVLYADAFVSPSGTGITYTATTSRMVYGMEKNKYMPSIFGKLHPIYGVPRQAMFFNLIVSFIFLFLFRGWGVLAEIISVATLISYITGPITVMTLRRTGKDLYRPLRLKGLNVIAPLGFIFASLVLYWARWPLTGQVLFIILIGLPIYFYYQAKAKWKGFGRNFKAGVWMVFYLLAMMVISYLGSDKFGGLNVIHYGWDMVLIAMVSLVFYVWALKSGYQTEYLKDAKEINSQLLNGQSEAAAGKE

SEQ ID NO: 23059 - protein, 416 aa, Bacillus subtilis
MKRLHYAWIIVSVTFLILLAVQGVRLSFGAFVEPWERQFSIDRSTISLISTVSFIVYGISQPVIGRLVDKWGARAVLAWSALLTGVSIFLTYLVTSPWQLFLLYGLGVSLGVGGASNVAASVLVVNWFSKKRGLAFGIMEAGFGAGQMLLVPGSLMLIHWFSWKLTVVVLGLLLIVIVFPAALLMLRNNPSEKNTEPIGGLAASEKETAPKTTALSVAGMFRMRQFWFLIFPFLICGFTTVGLMDTHLIPFSHDHGFSTTVTSAAVSLLAGFNIAGILLSGIVADRWSSRKILCILYAVRALSIVILIYSHEPYLLLAFAILFGLVDFATVAPTQMLATQYFQNYSIGLMIGWLSLAHQIGSALGAYVPGVIYTVTGEYTLAFYLSIGMLVLASVMNVMLREPAAVTRDSAAVVDK

SEQ ID NO: 23060 - protein, 384 aa, Bacillus subtilis
MYQSKKVLLLGSGELGKEVVIEAQRLGVQTVAVDSYEHAPAMQVAHNSYVVDMLDPEQIRTIIEKENPDLIVPEVEAIATDELLKLEEEGFHVIPNARAAKLTMDREGIRRLAAETLGLATAGYEFANTYDEFIQAAAQIGFPCVVKPLMSSSGKGQSVCRSEADLESCWETAMEGGRVKNGRVIVEEFIPFESEITLLTVRAVNGTAFCEPIGHVQKDGDYIESWQPHDMTEQQIEEAKHIAKTITDELGGYGLFGVELFLAKDRVYFSEVSPRPHDTGLVTLVTQNLSEFALHVRAILGFPITEITQLSPGASRPLKAPEELADYTVEGLENALAVPKTQVRVFGKPITKAGRRMAVALSAADSVETARENAKKALDQLILK

SEQ ID NO: 23061 - protein, 177 aa, Bacillus subtilis
MNYIPCMITIGNFICGLLAIHSLLYHNIHSAVLFIFTGMFLDFFDGMAARKLNAVSDMGRELDSFADLVTFGVAPSMLAYSVALYTLPFIGILCALTYSICGMLRLSKFNIEQSKLPTFIGMPIPFAGMCLVILSFTYNPILLAIGTCGLSYLMVSKIKFPHFKKHAAENLESGRWN

SEQ ID NO: 23062 - protein, 263 aa, Bacillus subtilis
MFNTAVKILYRSLIELTNHRLSSYLIKGFCESKISKPVIPLFSKHFRLNWDDVDGTAADYGSLSELFIRQINLERRPVSKEAHAVVSPVDGVVQTVGIINPNQTFTVKGKDYSFAELTGCKSADHQYNGGYFVVLYLSPRHYHRFHSPISCRYQKLAELGNRSYPVNQLGLKYGKDVLSKNYRFVYELNSGSRNVLMIPVGAMNINSIVQTNTRTELEIGEELGYFSFGSTVILVFEKDAFQPSAHLAEGQEVQVGELIGYEE

SEQ ID NO: 23063 - protein, 414 aa, Bacillus subtilis
MKKLIAFQILIALAVGAVIGHFFPDFGMALRPVGDGFIRLIKMIVVPIVFSTIVIGAAGSGSMKKMGSLGIKTIIWFEVITTLVLGLGLLLANVLKPGVGLDLSHLAKKDIHELSGYTDKVVDFKQMILDIIPTNIIDVMARNDLLAVIFFAILFGVAAAGIGKASEPVMKFFESTAQIMFKLTQIVMVTAPIGVLALMAASVGQYGIELLLPMFKLVGTVFLGLFLILFVLFPLVGLIFQIKYFEVLKMIWDLFLIAFSTTSTETILPQLMDRMEKYGCPKRVVSFVVPSGLSLNCDGSSLYLSVSCIFLAQAFQVDMTLSQQLLMMLVLVMTSKGIAAVPSGSLVVLLATANAVGLPAEGVAIIAGVDRVMDMARTGVNVPGHAIACIVVSKWEKAFRQKEWVSANSQTESI

SEQ ID NO: 23064 - protein, 470 aa, Bacillus subtilis
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 23065 - protein, 315 aa, Bacillus subtilis
MNPIQHILDTYPLIVLDGAMATELERKGCNLNDSLWSAKILMEEPELIKQVHTDYFAAGADCAITASYQSTFEGFAARGLSEAEARRLIELSVSIAAEARDEFWSLEENRLNRPKPIIAASIGPYGAYLADGSEYRGNYAISEDELIEFHRPRMKALIEAGADVLACETIPCLTEAKAIVRLLKEFPETYAWISFSAKDGLHISDGTPAADCASWLDEHRQIAALGINCTPLQHIPSLIEELKKNTSKPIIVYPNSGEQYDPETKTWNGAACAESYGASARTWHEKGARLIGGCCRTKPENIQEIAAWARSLKTT

SEQ ID NO: 23066 - protein, 308 aa, Bacillus subtilis
MSRIRKAPAGILGFPVAPFNTQGTLEEEALFQNIEFLLNEGLEAIFIACGSGEFQSLSQKEYEQMVEVAVSAAGGKVPVYTGVGGNLSTALDWAQLSEKKGADGYLILPPYLVHGEQEGLYQYAKTIIESTDLNAILYQRDNAVLSVEQIKRLTECEQLVGVKDGVGNMDLNINLVYTIGDRLGWLNGMPMAEVTMPAYLPIGFHSYSSAISNYIPHISRMFYDALKNGNDELVKELYRHVILPINDIRKQRKGYAVSLIKAGMEIMGLNVRNTARPPVGPVEKDHYQQLEAILKQPADRFPKKAATV

SEQ ID NO: 23067 - protein, 488 aa, Bacillus subtilis
MSVITEQNTYLNFINGEWVKSQSGDMVKVENPADVNDIVGYVQNSTAEDVERAVTAANEAKTAWRKLTGAERGQYLYKTADIMEQRLEEIAACATREMGKTLPEAKGETARGIAILRYYAGEGMRKTGDVIPSTDKDALMFTTRVPLGVVGVISPWNFPVAIPIWKMAPALVYGNTVVIKPATETAVTCAKIIACFEEAGLPAGVINLVTGPGSVVGQGLAEHDGVNAVTFTGSNQVGKIIGQAALARGAKYQLEMGGKNPVIVADDADLEAAAEAVITGAFRSTGQKCTATSRVIVQSGIYERFKEKLLQRTKDITIGDSLKEDVWMGPIASKNQLDNCLSYIEKGKQEGASLLIGGEKLENGKYQNGYYVQPAIFDNVTSEMTIAQEEIFGPVIALIKVDSIEEALNIANDVKFGLSASIFTENIGRMLSFIDEIDAGLVRINAESAGVELQAPFGGMKQSSSHSREQGEAAKDFFTAIKTVFVKP

SEQ ID NO: 23068 - protein, 455 aa, Bacillus subtilis
MKKDFASVTPAGKKTSVRWFIVFMLFLVTSINYADRATLSITGDSVQHDLGLDSVAMGYVFSAFGWAYVIGQLPGGWLLDRFGSKTIIALSIFFWSFFTLLQGAIGFFSAGTAIILLFALRFLVGLSEAPSFPGNGRVVASWFPSSERGTASAFFNSAQYFAIVIFPPLMGWLTHSFGWHSVFVVMGIAGILLAVIWLKTVYEPKKHPKVNEAELAYIEQGGGLISMDDSKSKQETESKWPYIKQLLTNRMLIGVYIAQYCITTLTYFFLTWFPVYLVQARGMSILEAGFVASLPALCGFAGGVLGGIVSDILLKKGRSLTFARKVPIIAGMLLSCSMIVCNYTDSAWLVVVIMSLAFFGKGFGALGWAVVSDTSPKECAGLSGGLFNTFGNIASITTPIIIGYIVNATGSFNGALVFVGANAIAAILSYLLLVGPIKRVVLKKQEQDPDQSLPV

SEQ ID NO: 23069 - protein, 310 aa, Bacillus subtilis
MDQTRTLGKTKLKVKRIGFGANAVGGHNLFPNLNDETGKDLVRTALDGGVNFIDTAFIYGLGRSEELIGEVVQERGVRNELIIATKGAHKEVDGSIELDNSREFLRSEVEKSLKRLKTDYIDLYYVHFPDGKTPLAEVAGTLKELKDEGKIKAIGASNLDYQQLQDFNADGYLEVFQAEYSLIQRDAEKELLPYCEKQGISFIPYFPLASGLLTGKFTQDTVFDDFRKDKPQFQGETFIHNLKKVDKLKAVAEEKQADTAHVALAWLLTRPAIDAIIPGAKRPEQLQDNLKTLNIELTEDEVNFISDIFK

SEQ ID NO: 23070 - protein, 258 aa, Bacillus subtilis
MYKDLTGKTAIVTGSSKGIGKAIAERFGKEKMNVVVNYHSDPSGADETLEIIKQNGGKAVSVEADVSKEEGIQALLDTALEHFGTLDVMVNNSGFNGVEAMPHEMSLEDWQRVIDVNVTGTFLGAKAALNHMMKNNIKGNVLNISSVHQQIPRPVNVQYSTSKGGIKMMTETLALNYADKGIRVNAIAPGTIATESNVDTKKEESRQKQLKKIPMKAFGKPEEVAAAAAWLVSEEASYVTGATLFVDGGMTLYPSQLE

SEQ ID NO: 23071 - protein, 561 aa, Bacillus subtilis
MKTDWWKDAVVYQIYPRSFQDSNGDGIGDLRGIISRLDYIKELGADVIWICPIYPSPNVDYGYDVTNHKAIMDSYGTMDDFHELLDQVHQRGLKLVMDFVLNHTSVEHPWFKEAELDKNSKYRSYYYWRPGTKNGPPTDWLSNYGCPVWQYEEHTGEYYLHMNAVKQADLNWENPEVRQAVYDMMKFWLDKGVDGLRIDQLHLISKKEYLPSYEDYINQQAEPKPFQPNGERIHDYLKEITDEVFSHYDVMSVGEVGSVTPEEGLKYTGTDKHELNMIFHFQHMELDQQPGKEHWDLKPLELSDLKSVLTKWQKKLEHQGWNTLFWCNHDQPRIVSRFGDDGEYRKASAKMLAAVIYFMKGTPYIYQGEEIGMTNAPFTRIEDYKDIQTINMYHKRVFEKGYDPNDVMRSILAKSRDHARTPMQWNSGKNAGFTDGTPWLKVNPNFTAINVEEAQGDPDSVLNYYKKLISLRKQYADLMKGSFDLLLPDDPQLFVYMRENSKQQLLSVNNFSKEQAVFQWPKNCGKAQASLLLSNYNNDDLDDEMVFRPYESRVYLLDKTN

SEQ ID NO: 23072 - protein, 400 aa, Bacillus subtilis
MGKQQPISQRKLLGVAGLGWLFDAMDVGILSFIIAALHVEWNLSPEEMKWIGSVNSIGMAAGAFLFGLLADRIGRKKVFIITLLCFSIGSGISAFVTSLSAFLILRFVIGMGLGGELPVASTLVSEAVVPEKRGRVIVLLESFWAVGWLAAALISYFVIPSFGWQAALLLTALTAFYALYLRTSLPDSPKYESLSAKKRSMWENVKSVWARQYIRPTVMLSIVWFCVVFSYYGMFLWLPSVMLLKGFSMIQSFEYVLLMTLAQLPGYFSAAWLIEKAGRKWILVVYLIGTAGSAYFFGTADSLSLLLTAGVLLSFFNLGAWGVLYAYTPEQYPTAIRATGSGTTAAFGRIGGIFGPLLVGTLAARHISFSVIFSIFCIAILLAVACILIMGKETKQTELE

SEQ ID NO: 23073 - protein, 321 aa, Bacillus subtilis
MMNKHVNKVALIGAGFVGSSYAFALINQGITDELVVIDVNKEKAMGDVMDLPHGKAFGLQPVKTSYGTYEDCKDADIVCICAGANQKPGETRLELVEKNLKIFKGIVSEVMASGFDGIFLVATNPVDILTYATWKFSGLPKERVIGSGTTLDSARFRFMLSEYFGAAPQNVHAHIIGEHGDTELPVWSHANVGGVPVSELVEKNDAYKQEELDQIVDDVKNAAYHIIEKKGATYYGVAMSLARITKAILHNENSILTVSTYLDGQYGADDVYIGVPAVVNRGGIAGITELNLNEKEKEQFLHSAGVLKNILKPHFAEQKVN

SEQ ID NO: 23074 - protein, 186 aa, Bacillus subtilis
MNAKRAIPVRERNIVLIGFMGVGKTTIGQLVAKKLYRDFIDIDQQIEKDFNMSIPEIFEKKGEDFSRKTEKEYILDICHHKRFKIVSLGGGSFKQEEIRNCCLENCLVLHLDLSWENWKQRADLLIESRPVLHNRSMDEMEQLFNERKVIYDKHNSKVATDNLSPEEVADYIVETLKIGWDLYQPM

SEQ ID NO: 23075 - protein, 515 aa, Bacillus subtilis
MTTPYKHEPFTNFQDQNYVEAFKKALATVSEYLGKDYPLVINGERVETEAKIVSINPADKEEVVGRVSKASQEHAEQAIQAAAKAFEEWRYTSPEERAAVLFRAAAKVRRRKHEFSALLVKEAGKPWNEADADTAEAIDFMEYYARQMIELAKGKPVNSREGEKNQYVYTPTGVTVVIPPWNFLFAIMAGTTVAPIVTGNTVVLKPASATPVIAAKFVEVLEESGLPKGVVNFVPGSGSEVGDYLVDHPKTSLITFTGSREVGTRIFERAAKVQPGQQHLKRVIAEMGGKDTVVVDEDADIELAAQSIFTSAFGFAGQKCSAGSRAVVHEKVYDQVLERVIEITESKVTAKPDSADVYMGPVIDQGSYDKIMSYIEIGKQEGRLVSGGTGDDSKGYFIKPTIFADLDPKARLMQEEIFGPVVAFCKVSDFDEALEVANNTEYGLTGAVITNNRKHIERAKQEFHVGNLYFNRNCTGAIVGYHPFGGFKMSGTDSKAGGPDYLALHMQAKTISEMF

SEQ ID NO: 23076 - protein, 710 aa, Bacillus subtilis
MTERLLRYFRDKQQDVQSEKTYDTQCPFCSMQCKMQLVEQTIVTRKKYTAIGIDNPTTQGRLCIKGMNAHQHALNSSRITRPLLKKNGEFMPVSWEEALNHIKDQVTMIQTEHGHDAMAVYGSASITNEEAYLLGKFARVGLQTKYIDYNGRLCMSAAATAANQTFGADRGLTNPLSDIPHTRVIILAGTNIAECQPTIMPYFEKAKENGAYFIAIDPRETATTKIADLHLKIKPGTDAALANGLVKIIIDEQLINEDFIQSRTNGFEELKQHTDSLDLNDIAEQTSVSLVDIRKAAVKFAKETSGMLFTARGIEQQTDGTAAVKGFLNMVLITGKIGKPYSGYGAITGQGNGQGAREHGQKADQLPGYRSIENEEHRAHIAKVWGIHQDDLPRKGVSAYEVMEKINDGDIKGLFLMCSNPAVSSPNANLVKKALRRLTFFVAIDLFISETAKYADVILPASSYLEDEGTMTNVEGRVTLREASRPCPGEAKHDWQIICDLASALGKGRYFSYTSAEDIFNELREASRGGIADYSGISYGRLRREGGIHWPCPESDHPGTGRLFTESFAHPDQKAALSVIPNEPPVPKEKPTADYPLYLTTGRVMSHYLTGVQTRKSAALAARHFESFMEIHPQTAATYNIEDRVLVKIESPRGSITVRSKLSEQIRKDTVFVPIHWADAQNVNDLIGEALDPACKMPGFKVCAVRIIPI

SEQ ID NO: 23077 - protein, 477 aa, Bacillus subtilis
MIHQHPESFPKHFLWGSASAAYQIEGAWNEDGKGPSVWDVFTKIPGKTFKGTNGEIAVDHYHRFKEDVALMAEMGLKAYRFSVSWPRVFPKGKGEINEAGLAFYDSLIDELLSHHIEPVLTLYHWDLPQALMDEYGGFESRNIIEDFNHYCITLYKRFGDRVKYWVTLNEQNYNFNHGFITAMHPPGVKDRKRFYEANHIAFLANAKAIESFREYVPEGKIGPSFAYSPAYPLSSHPEDILAFENAEEFTNNWWLDMYCWGTYPQIPFRCLEKQGWAPTIEAGDMDLLAKGKPDFVGVNYYQTITYERNPLDGVSEGKMNTTGQKGTNQETGIPGVFKTKKNPHLTTSNWDWTIDPIGLRIGLRRITSRYQLPVFITENGLGEFDKVEDGTVQDDYRIDYLRSHLEQCRQAISDGVDLIGYCSWSFTDLLSWLNGYQKRYGFVYVNRDEESTSDLKRLKKKSFYWYQDVIKTNGESL

SEQ ID NO: 23078 - protein, 454 aa, Bacillus subtilis
MKVVKFGGSSLASGAQLDKVFHIVTSDPARKAVVVSAPGKHYAEDTKVTDLLIACAEQYLATGSAPELAEAVVERYALIANELQLGQSIIEKIRDDLFTLLEGDKSNPEQYLDAVKASGEDNNAKLIAAYFRYKGVKAEYVNPKDAGLFVTNEPGNAQVLPESYQNLYRLRERDGLIIFPGFFGFSKDGDVITFSRSGSDITGSILANGLQADLYENFTDVDAVYSVNPSFVENPKEISELTYREMRELSYAGFSVFHDEALIPAFRAGIPVQIKNTNNPSAEGTRVVSKRDNTNGPVVGIASDTGFCSIYISKYLMNREIGFGRRALQILEEHGLTYEHVPSGIDDMTIILRQGQMDAATERSVIKRIEEDLHADEVIVEHHLALIMVVGEAMRHNVGTTARAAKALSEAQVNIEMINQGSSEVSMMFGVKEAEERKAVQALYQEFFAGVLIS

SEQ ID NO: 23079 - protein, 436 aa, Bacillus subtilis
MSQTTASITTAQWQQKRDQFVSKGVSNGNRSLAVKGEGAELYDLDGRRFIDFAGAIGTLNVGHSHPKVVEAVKRQAEELIHPGFNVMMYPTYIELAEKLCGIAPGSHEKKAIFLNSGAEAVENAVKIARKYTKRQGVVSFTRGFHGRTNMTMSMTSKVKPYKFGFGPFAPEVYQAPFPYYYQKPAGMSDESYDDMVIQAFNDFFIASVAPETVACVVMEPVQGEGGFIIPSKRFVQHVASFCKEHGIVFVADEIQTGFARTGTYFAIEHFDVVPDLITVSKSLAAGLPLSGVIGRAEMLDAAAPGELGGTYAGSPLGCAAALAVLDIIEEEGLNERSEEIGKIIEDKAYEWKQEFPFIGDIRRLGAMAAIEIVKDPDTREPDKTKAAAIAAYANQNGLLLLTAGINGNIIRFLTPLVISDSLLNEGLSILEAGLRA

SEQ ID NO: 23080 - protein, 462 aa, Bacillus subtilis
MPDQLTVYNPATGEEIKTIPQQSATEVEEAIERSHQAFKTWSKTSANERTSLLKKWYELIVEHKEELADLITKENGKPYQEAVGEVLYGAGYIEWFAEEAKRVYGRTVPAPTTGKRIVVTRQPVGPVAAITPWNFPNAMITRKAAPALAAGCTFIIKPAPDTPLSAYELARLAYEAGIPKDVLQVVIGDGEEIGNVFTSSPKIRKITFTGSTPVGKILMKNSADTVKHVSMELGGHAPLIVDEDADIDLAVEQAMASKYRNAGQTCVCANRLIVHESIKDEFAAKLSEQVSKLKVGNGLEEGVNVGPIINKRGFEKIVSQIDDAVEKGAKVIAGGTYDRNDDKGCYFVNPTVLTDVDTSMNIMHEETFGPVAPIVTFSDIDEAIQLANDTPYGLAAYFFTENYRRGIYISENLEYGIIGWNDGGPSAVQAPFGGMKESGIGREGGSEGIEPYLETKYLSIGL

SEQ ID NO: 23081 - protein, 261 aa, Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGIKLMTETLALEYAPKGIRVNNIGPGAINTPINAEKFADPKQKADVESMIPMGYIGEPEEIAAVAAWLASKEASYVTGITLFADGGMTQYPSFQAGRG

SEQ ID NO: 23082 - protein, 300 aa, Bacillus subtilis
MQRIQLAEDLQFSRVIHGLWRLNEWNYSDAELLSLIEWCIDHGITTFDHADIYGGYTCEKLFGNALALSPGLRENIELVTKCGIVLESPERPAHRSHHYNTSKSHILASVEQSLMNLRTDYIDMLLIHRPDPLMDPEGVAEAFQALKCSGKVRYFGVSNFKDHQYRMLESYLPEKLVTNQIELSAYELENMLDGTLNLCQEKRIPPMAWSPLAGGKVFTENTDKDRRVRTALESVQGEIGAASLDEVMYAWLYTHPAGIMPIVGSGKRERISAAINALSYKLDQDQWFRIFTAVQGYDIP

SEQ ID NO: 23083 - protein, 465 aa, Bacillus subtilis
METLQHLILHDMPNSEEIEAVKSGDHTLTYKGYRKRINQLANAMLQKGIQKGDRVALLCKNGHPASTVMFAALEIGAVVVPVSWQLKPYEMTGILKASEPKAMFYGAEFKEILDEVLPELSSLCVTMETGTAYETSAEFEALFAGPDHLPETEMVSPDDTALLMFTSGTTGNPKRCMITHGGIYRYVKKSNSSIARMKGLRFLACHPIYHTSALICIMLGTFAETTFVFTKDQDPVHMLKVIEEEKIQTVMALPVFYTYLLEAWEKHQTDLSSLVILMTGGTKVPSSLISRYLDIGIPLAHGYGSTEAWGISTWTPDMGMDKAASAGKPVAGVKVKVEDPLTGEELPQGEIGEIVVHTPFLFKGYEDNPEATAKVLQNGWFRTGDSGYVDEDGFIFITGRYKDVIIYGGDNVYPDQVEEVIQQIPGILETAVVGIPDPLYGEKPKAFIVKNGGQRITEEDVIAFL

SEQ ID NO: 23084 - protein, 286 aa, Bacillus subtilis
MANYPKELPAQTQSRQPGIESEMNPSPVYEYEDYKGADKLKGKVALITGGDSGIGRAVSVAYAKEGADIAIVYKDEHEDAEETKKRVEQEGVKCLLIAGDVGEEEFCNEAVEKTVKELGGLDILVNNAGEQHPKESIKDITSEQLHRTFKTNFYSQFYLTKKAIDYLKPGSAIINTTSINPYVGNPTLIDYTATKGAINAFTRTMAQALVKDGIRVNAVAPGPIWTPLIPATFPEETVAQFGQDTPMGRPGQPVEHVGCYVLLASDESSYMTGQTLHVNGGNFVTT

SEQ ID NO: 23085 - protein, 727 aa, Bacillus subtilis
MSKTVVLAEKPSVGRDLARVLKCHKKGNGYLEGDQYIVTWALGHLVTLADPEGYGKEFQSWRLEDLPIIPEPLKLVVIKKTGKQFNAVKSQLTRKDVNQIVIATDAGREGELVARWIIEKANVRKPIKRLWISSVTDKAIKEGFQKLRSGKEYENLYHSAVARAEADWIVGINATRALTTKFNAQLSCGRVQTPTLAMIAKREADIQAFTPVPYYGIRAAVDGMTLTWQDKKSKQTRTFNQDVTSRLLKNLQGKQAVVAELKKTAKKSFAPALYDLTELQRDAHKRFGFSAKETLSVLQKLYEQHKLVTYPRTDSRFLSSDIVPTLKDRLEGMEVKPYAQYVSQIKKRGIKSHKGYVNDAKVSDHHAIIPTEEPLVLSSLSDKERKLYDLIAKRFLAVLMPAFEYEETKVIAEIGGETFTAKGKTVQSQGWKAVYDMAEEDDEQEDDRDQTLPALQKGDTLAVRTLTETSGQTKPPARFNEGTLLSAMENPSAFMQGEEKGLVKTLGETGGLGTVATRADIIEKLFNSFLIEKKGQDIFITSKGKQLLQLVPEDLKSPALTAEWEQKLSAIAAGKLKSAVFIKDMKAYAHQTVKEIKNSSQTFRHDNITGTACPECGKMMLKVNGKRGTMLVCQDRECGSRKTIARKTNARCPNCHKRMELRGQGEGQTFACVCGHREKLSVFEKRKNKDKARATKRDVSSYMKKQNKDEPINNALAEQLKKLGLDK

SEQ ID NO: 23086 - protein, 574 aa, Bacillus subtilis
MAHKTAGQAMTELLEQWGVDHVYGIPGDSINEFIEELRHERNQLKFIQTRHEEVAALAAAAEAKLTGKIGVCLSIAGPGAVHLLNGLYDAKADGAPVLAIAGQVSSGEVGRDYFQEIKLEQMFEDVAVFNREVHSAESLPDLLNQAIRTAYSKKGVAVLSVSDDLFAEKIKREPVYTSPVYIEGNLEPKKEQLVTCAQYINNAKKPIILAGQGMKKAKRELLEFADKAAAPIVVTLPAKGVVPDKHPHFLGNLGQIGTKPAYEAMEECDLLIMLGTSFPYRDYLPDDTPAIQLDSDPAKIGKRYPVTAGLVCDSALGLRELTEYIERKEDRRFLNACTEHMQHWWNEIEKDETEATTPLKPQQVVARLQEAAADDAVLSVDVGTVTVWMARHFKMNANQDFIVSSWLATMGCGLPGAIAASLSEPERQAIAVCGDGGFSMVMQDLPTAVKYKLPITVVILNNENLGMIEYEQQVKGNIDYVTKLQNVDYAAFAESCGAKGIKVTKAEELAPAFHEALHSDQPVVVDVMIGNEPPLPGKITYGQAKGFSKYMLKNFFENQKFEMPSLKKSLKRLF

SEQ ID NO: 23087 - protein, 421 aa, Bacillus subtilis
MKLFKNLTVQVITAVIIGVIVGLVWPDVGKEMKPLGDTFINAVKMVIAPIIFFTIVLGIAKMGDMKKVGKVGGKAFIYFEVVTTLALIIGLFVVNIMKPGAGLDYSKLEKGDVSQYTQNGGQGIDWIEFITHIVPSNMVDAFAKGDILQVLFFSILFGVGLAALGEKGKSVIDFFDKVSHVFFKIIGYIMRAAPIGAFGAMAYTIGHFGLDSIKPLASLMMSVYITMFLFVFVALNIICKLYGFSLWNYLRFIKDELLIVLGTSSSESVLPRMMDKMERYGCSKSVVGLVIPTGYSFNLDGTSIYLSMATVFLAQVFGVDLSIGQQITIILVLMLTSKGAAGVTGSGFIVLASTLSALQVIPLEGLALLLGVDRFMSEGRAIVNLIGNGIATIIVAKSENEFDEAKSIEAVEGMKKMKTAV

SEQ ID NO: 23088 - protein, 381 aa, Bacillus subtilis
MSLFIQNDQQRQWMEKIGRIADEFQQTAAEDDEQGRFPAEKIQKLRDAGYTALTLPASHGGGGISVYDMLLFQERLARGDAPTALSIGWHLSVIGELGEGNSWDEDVFAFVAKEVQNGAVINRAATEAKTGSPTRGGRPGTHAVKKDGKWAVNGRKTFTTMSQALDYFLVTAWIEDKQTTGVFLIHKDDPGLSIEETWDMMAMRATGSHDLVLNEVMLDENKLVELLQGPRGAKPNGWLLHIPAIYLGVAQAARDYAVQFASEYSPNSLNGPIKNVPAVQQRTGEMELELLNARHFLFHIAQLYDDPVRRPHLTSELGAAKHIVTNAALSVVDKAMRIVGAKSLERTNPLQRYYRDVRAGLHNPPMDDAVIHKLAAEAFES

SEQ ID NO: 23089 - protein, 354 aa, Bacillus subtilis
MYGGKSAEHNVSLQTALAVIKALNTEKFDIHPIYITEKGEWVRGARLTEPVSNVKMLQFEQGGSAFSPAALNQEMFPQEASQQNEAIDVVFPLLHGPNGEDGTIQGMLELLNIPYVGNGVLASSAGMDKVVMKHLFAQVGLAQAKYAAFLKKDWTRSPKESCEEVEQELGYPCFVKPANLGSSVGISKCRNREELQKAFELAFQYDRKVVVEEGINGREIEIGVLGNDDPKCSVVGEIAPKTDFYDYKAKYEDGDTDLMIPAIVTDEEYATISDMAIKAFKAIDGSGLVRADFFLTADGEVLINEVNTMPGFTPFSMFPLLWKEAGVEYADLIEQLVELAKERHAEKQLIKHTF

SEQ ID NO: 23090 - protein, 511 aa, Bacillus subtilis
MVNHDITETAIRRSLNNLTITFQDFNLSSDLMKAINRMGFEEATPIQAQTIPLGLSNKDVIGQAQTGTGKTAAFGIPLVEKINPESPNIQAIVIAPTRELAIQVSEELYKIGQDKRAKVLPIYGGQDIGRQIRALKKNPNIIVGTPGRLLDHINRRTIRLNNVNTVVMDEADEMLNMGFIDDIESILSNVPSEHQTLLFSATMPAPIKRIAERFMTEPEHVKVKAKEMTVSNIQQFYLEVQERKKFDTLTRLLDIQSPELAIVFGRTKRRVDELAEALNLRGYAAEGIHGDLTQAKRMVALRKFKEGAIEVLVATDVAARGLDISGVTHVYNFDVPQDPESYVHRIGRTGRAGKTGMAMTFITPREKSMLRAIEQTTKRKMDRMKEPTLDEALEGQQQVTVERLRTTISENNLNFYMTAAAELLEDHDAVTVVAAAIKMATKEPDDTPVRLTDEAPMVSKRYKNQRSSKRRDGQGGGYRGGKGKSNNRSSYDKKRSNDRRSSGDRRQKKSY

SEQ ID NO: 23091 - protein, 458 aa, Bacillus subtilis
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 23092 - protein, 465 aa, Bacillus subtilis
MAHTEQYRFPKDFWWGSSASATQMEGAADRDGKGQNIWDYWFEKEPHRFFDHVGPADTSQFYDNYKEDIRLMKELGHNSFRMSISWSRLIPNGTGEINDKAADFYNNVIDELIANGIEPFVNLFHFDMPMALQKIGGWVNRETVDAYENYARTCFRLFGGRVKKWFTHNEPIVPVEGGYLYDFHYPNKVDFKEAVQVGFHTMLSSARAIQAYREMKQDGKIGIILNLTPSYPRSSHPADVKAGEIADAFFNRSFLDPSVKGEFPKELVDILKHEGFMPDYNAEDLDIIKKNTVDLLGVNYYQPRRVKAKEHLPNPDAPFLPDRYFDPYVMPGRKMNPHRGWEIYEKGVYDILINLKENYGNIECFISENGMGVEGEERFRDEQGIIQDDYRIEFIKEHLKWIHRAIQEGSNVKGYHLWTFMDNWSWTNAYKNRYGFVSVNLEKDGERTVKKSGKWFKEVAEHSGF

SEQ ID NO: 23093 - protein, 362 aa, Bacillus subtilis
MFKKHTISLLIIFLLASAVLAKPIEAHTVSPVNPNAQQTTKTVMNWLAHLPNRTENRVLSGAFGGYSHDTFSMAEADRIRSATGQSPAIYGCDYARGWLETANIEDSIDVSCNGDLMSYWKNGGIPQISLHLANPAFQSGHFKTPITNDQYKNILDSATAEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQKYPKTIYFLAWNDEWSAAVNKGASALYHDSWTLNKGEIWNGDSLTPIVE

SEQ ID NO: 23094 - protein, 544 aa, Bacillus subtilis
MAKEIKFSEEARRAMLRGVDALADAVKVTLGPKGRNVVLEKKFGSPLITNDGVTIAKEIELEDAFENMGAKLVAEVASKTNDVAGDGTTTATVLAQAMIREGLKNVTAGANPVGVRKGMEQAVAVAIENLKEISKPIEGKESIAQVAAISAADEEVGSLIAEAMERVGNDGVITIEESKGFTTELEVVEGMQFDRGYASPYMVTDSDKMEAVLDNPYILITDKKITNIQEILPVLEQVVQQGKPLLLIAEDVEGEALATLVVNKLRGTFNAVAVKAPGFGDRRKAMLEDIAVLTGGEVITEDLGLDLKSTQIAQLGRASKVVVTKENTTIVEGAGETDKISARVTQIRAQVEETTSEFDREKLQERLAKLAGGVAVIKVGAATETELKERKLRIEDALNSTRAAVEEGIVSGGGTALVNVYNKVAAVEAEGDAQTGINIVLRALEEPIRQIAHNAGLEGSVIVERLKNEEIGVGFNAATGEWVNMIEKGIVDPTKVTRSALQNAASVAAMFLTTEAVVADKPEENGGGAGMPDMGGMGGMGGMM

SEQ ID NO: 23095 - protein, 353 aa, Bacillus subtilis
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 23096 - protein, 320 aa, Bacillus subtilis
MRSHSVVCIGELLIDFFCTDVDVDLMEGRQFLKSAGGAPANVSAAIAKLGGDAAFSGKVGKDPFGYFLKRTLDAVHVDTSMLVMDEKAPTTLAFVSLKQNGERDFVFNRGADALFTLEDIDQEKLNEAKILHFGSATALLSDPFCSAYLRLMSIAKDNGQFISFDPNYREDLWRGRVSEFVSVAKKAIAVSDFVKVSDEELEIISGVKDHEKGVAILHEIGANIVAVTLGKSGTLLSNGKDREIIPSIPVTSIDSTGAGDAFVGAALYQLANTDQIQSVDADFVKLREIVAFANKVGALVCTKIGAIDALPSLDEIGVSL

SEQ ID NO: 23097 - protein, 473 aa, Bacillus subtilis
MNKQGNQMSFLRTIILVSTFGGLLFGYDTGVLNGALPYMGEPDQLNLNAFTEGLVTSSLLFGAALGAVFGGRMSDFNGRRKNILFLAVIFFISTIGCTFAPNVTVMIISRFVLGIAVGGASVTVPAYLAEMSPVESRGRMVTQNELMIVSGQLLAFVFNAILGTTMGDNSHVWRFMLVIASLPALFLFFGMIRMPESPRWLVSKGRKEDALRVLKKIRDEKRAAAELQEIEFAFKKEDQLEKATFKDLSVPWVRRIVFIGLGIAIVQQITGVNSIMYYGTEILRNSGFQTEAALIGNIANGVISVLATFVGIWLLGRVGRRPMLMTGLIGTTTALLLIGIFSLVLEGSPALPYVVLSLTVTFLAFQQGAISPVTWLMLSEIFPLRLRGLGMGVTVFCLWMVNFAVSFTFPILLAAIGLSTTFFIFVGLGICSVLFVKRFLPETKGLSLEQLEENFRAYDHSGAKKDSGAEVIG

SEQ ID NO: 23098 - protein, 346 aa, Bacillus subtilis
MKAARWHNQKDIRIEHIEEPKTEPGKVKIKVKWCGICGSDLHEYLGGPIFIPVDKPHPLTNETAPVTMGHEFSGEVVEVGEGVENYKVGDRVVVEPIFATHGHQGAYNLDEQMGFLGLAGGGGGFSEYVSVDEELLFKLPDELSYEQGALVEPSAVALYAVRSSKLKAGDKAAVFGCGPIGLLVIEALKAAGATDIYAVELSPERQQKAEELGAIIVDPSKTDDVVAEIAERTGGGVDVAFEVTGVPVVLRQAIQSTTIAGETVIVSIWEKGAEIHPNDIVIKERTVKGIIGYRDIFPAVLSLMKEGYFSADKLVTKKIVLDDLIEEGFGALIKEKSQVKILVRPN

SEQ ID NO: 23099 - protein, 469 aa, Bacillus subtilis
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 23100 - protein, 431 aa, Bacillus subtilis
MIERYSRPEMSAIWTDENRFQAWLEVEILACEAWAELGVIPKEDVKVMRENASFDINRILEIEKDTRHDVVAFTRAVSESLGEERKWVHYGLTSTDVVDTALSYLLKQANDILLKDLERFVDIIKEKAKEHKYTVMMGRTHGVHAEPTTFGLKLALWHEEMKRNLERFKQAKAGIEVGKISGAVGTYANIDPFVEQYVCEKLGLKAAPISTQTLQRDRHADYMATLALIATSIEKFAVEIRGLQKSETREVEEFFAKGQKGSSAMPHKRNPIGSENMTGMARVIRGYMMTAYENVPLWHERDISHSSAERIILPDATIALNYMLNRFSNIVKNLTVFPENMKRNMDRTLGLIYSQRVLLALIDTGLTREEAYDTVQPKAMEAWEKQVPFRELVEAEEKITSRLSPEKIADCFDYNYHLKNVDLIFERLGLA

SEQ ID NO: 23101 - protein, 739 aa, Bacillus subtilis
MNYISNQLLSGLNPVQQEAVKTTDGPLLLMAGAGSGKTRVLTHRIAYLMAEKHVAPWNILAITFTNKAAREMKERVESILGPGADDIWISTFHSMCVRILRRDIDRIGINRNFSILDTADQLSVIKGILKERNLDPKKFDPRSILGTISSAKNELTEPEEFSKVAGGYYDQVVSDVYADYQKKLLKNQSLDFDDLIMTTIKLFDRVPEVLEFYQRKFQYIHVDEYQDTNRAQYMLVKQLAERFQNLCVVGDSDQSIYRWRGADITNILSFEKDYPNASVILLEQNYRSTKRILRAANEVIKNNSNRKPKNLWTENDEGIKISYYRGDNEFGEGQFVAGKIHQLHSTGKRKLSDIAILYRTNAQSRVIEETLLKAGLNYNIVGGTKFYDRKEIKDILAYLRLVSNPDDDISFTRIVNVPKRGVGATSLEKIASYAAINGLSFFQAIQQVDFIGVSAKAANALDSFRQMIENLTNMQDYLSITELTEEILDKTEYREMLKAEKSIEAQSRLENIDEFLSVTKNFEQKSEDKTLVAFLTDLALIADIDQLDQKEEESGGKDAITLMTLHAAKGLEFPVVFLMGLEEGVFPHSRSLMEEAEMEEERRLAYVGITRAEQELYLTNAKMRTLFGRTNMNPESRFIAEIPDDLLENLNEKKETRATSARKMQPRRGPVSRPVSYASKTGGDTLNWAVGDKAGHKKWGTGTVVSVKGEGEGTELDIAFPSPVGVKRLLAAFAPIEKQ

SEQ ID NO: 23102 - protein, 663 aa, Bacillus subtilis
MRKLYHGACYYPELWDEETIQQDIDIMREVGVNVVRIGEFAWSVMEPEEGKIDVGFFKEIIARLYDSGIETIMCTPTPTPPIWFSHGRPERMHANEKREIMGHGSRQHACTNNPYFRKKAAIITTAIAKELGRLPGLIGWQLDNEFKCHVAECMCETCLRLWHDWLKNRYGVIERLNEAWGTDVWSETYQTFEQVPQPGPAPFLHHASLRTMYQLFSMEMIASFADEQAKIIRCYSDAPITHNGSVMFSVDNERMFQNLDFASYDTYASQENASAFLLNCDLWRNLKQGRPFWILETSPSYAASLESSAYPHADGYLQAEAVSSYALGSQGFCYWLWRQQRSGSEISHGSVLSAWGEPTIGYQNVLAVERARKEIEPIILSTEPVQAEAAMTYSDRAKAFIKTEPHRGLRHRSLVTHFYERILNTGIHRDLIPEGAPLDGYRLLFTPFVPYLSSEFIKKASAFAEAGGIWITGPLTGGRTCEHTIHTDCGLGELEKTSGIKTLFTFPMNENVNTGKAFGITAPLGLWSAVFDTESGNTLGTVEAGPGAGHAFLTERNYGEGKIVMLGSLPSGKEGDAMLEALVRHYAEEAVISSRSDVTPGTIVAPRIGENGLVWIVVNMDGKGGSVTLPESGTDLLTHRLEKAGRLAVGPHEYRVIQFDNHS

SEQ ID NO: 23103 - protein, 446 aa, Bacillus subtilis
MFHISTLDQIKIAYIGGGSQGWARSLMSDLSIDERMSGTVALYDLDFEAAQKNEVIGNHSGNGRWRYEAVSTLKKALSAADIVIISILPGSLDDMEVDVHLPERCGIYQSVGDTVGPGGIIRGLRAVPIFAEIARAIRDYAPESWVINYTNPMSVCTRVLYKVFPGIKAIGCCHEVFGTQKLLAEMVTERLGIEVPRREDIRVNVLGINHFTWITKASYRHIDLLPIFREFSAHYGESGYELEGECWRDSVFCSAHRVAFDLFETYGAIPAAGDRHLAEFLPGPYLKQPEVWKFHLTPISFRKQDRAEKRQETERLIVQQRGVAEKASGEEGVNIIAALLGLGELVTNVNMPNQGQVLNLPIQAIVETNAFITRNRVQPILSGALPKGVEMLAARHISNQEAVADAGLTKDTGLAFQAFLNDPLVQIDRSDAEQLFNDMLQCIMQS

SEQ ID NO: 23104 - protein, 254 aa, Bacillus subtilis
MKAVILCGGKGTRMSEVTNDIPKPLAMIGGKPILWHIMKIYQYYGVNEFILLLGYKGEKIKEYFLDYEWKHNSLTLDSSTGEVQMLGQPETWKITFLETGVDTLTAGRILQAKDYIGDETFLLTYGDGLANINLFHLISYHQTKGAAATVTGIDKVSQFGTLTVEDGMAKTFSEKTSSDGIINGGFFVLSPKVFDYLPKDGNTMFEDEPLKNLAKDGELAVYRHYGFWTAIDTYKNLLEVNKMWNQGQQVWKVW

SEQ ID NO: 23105 - protein, 301 aa, Bacillus subtilis
MVKELIEQGANVTGLVRDHVPQSNLYQGEHIKKMNIVRGSLEDLAVIERALGEYEIDTVFHLAAQAIVGVANRNPISTFEANILGTWNILEACRKHPLIKRVIVASSDKAYGDQENLPYDENMPLQGKHPYDVSKSCADLISHTYFHTYGLPVCITRCGNLYGGGDLNFNRIIPQTIQLVLNGEAPEIRSDGTFVRDYFYIEDAVQAYLLLAEKMEENNLAGEAFNFSNEIQLTVLELVEKILKKMNSNLKPKVLNQGSNEIKHQYLSAEKARKLLNWTPAYTIDEGLEKTIEWYTEFFKK

SEQ ID NO: 23106 - protein, 461 aa, Bacillus subtilis
MSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 23107 - protein, 485 aa, Bacillus subtilis
MFQYEELNKQFIGGKWQEGSSPNVLENKNPYTQKTFTTFRKATADDVDEAYRAAALAKKKWDAVNPFEKRTILEKAVTYIEENEEAIIYLIMEELGGTRLKAAFEIGLVKNIIKEAATFPIRMEGKILPSTIDGKENRLYRVPAGVVGVISPFNFPFFLSMKSVAPALGAGNGVVLKPHEETPICGGTLIAKIFENAGIPAGLLNVVVTDIAEIGDSFVEHPVPRIISFTGSTKVGSYIGQLAMKHFKKPLLELGGNSAFIVLEDADIEYAVNAAVFSRFTHQGQICMSANRVLVHSSIYDKFLELYQAKVESLKVGDPMDPDTIIGPLINSRQTDGLMKTVEQAIEEGAVPVKLGGFNGTIVEPTILKDVKPFMSIAKEELFGPVVSFMKFDSEDEAVDIANETPFGLSGAVHTSNLERGVAFAKRIETGMIHVNDTTINDEPNVAFGGEKQSGLGRLNGEWSLEEFTTLKWISVQHEKRSFPY

SEQ ID NO: 23108 - protein, 376 aa, Bacillus subtilis
MTQTWPFLHNAQSFIQENWNASGFQKPTPVQEQAAQLIMDGKDVIAESPTGTGKTLAYALPVLERIKPEQKHPQAVILAPSRELVMQIFQVIQDWKAGSELRAASLIGGANVKKQVEKLKKHPHIIVGTPGRVFELIKAKKLKMHEVKTIVLDETDQLVLPEHRETMKQIIKTTLRDRQLLCFSATLKKETEDVLRELAQEPEVLKVQRSKAEAGKVKHQYLICDQRDKVKLLQKLSRLEGMQALVFVRDIGNLSVYAEKLAYHHVELGVLHSEAKKMERAKIIATFEDGEFPLLLATDIAARGLDIENLPYVIHADIPDEDGYVHRSGRTGRAGKEGNVLSLVTKLEESKLKKMAKKLGVELSEAVYAGGKLKTK

SEQ ID NO: 23109 - protein, 478 aa, Bacillus subtilis
MASEKDAGKQSAVKLVPLLITVAVGLIIWFIPAPSGLEPKAWHLFAIFVATIIGFISKPLPMGAIAIFALAVTALTGTLSIEDTLSGFGNKTIWLIVIAFFISRGFIKTGLGARISYVFVQKFGKKTLGLSYSLLFSDLILSPAIPSNTARAGGIIFPIIRSLSETFGSSPANGTERKIGAFLLKTGFQGNLITSAMFLTAMAANPLIAKLAHDVAGVDLTWTSWAIAAIVPGLVSLIITPLVIYKLYPPEIKETPDAAKIATEKLKEMGPFKKSELSMVIVFLLVLVLWIFGGSFNIDATTTALIGLAVLLLSQVLTWDDIKKEQGAWDTLTWFAALVMLANFLNELGMVSWFSNAMKSSVSGFSWIVAFIILIVVYYYSHYFFASATAHISAMYSAFLAVVVAAGAPPLLAALSLAFISNLFGSTTHYGSGAAPVFFGAGYIPQGKWWSIGFILSIVHIIVWLVIGGLWWKVLGIW

SEQ ID NO: 23110 - protein, 561 aa, Bacillus subtilis
MKTEQTPWWKKAVVYQIYPKSFNDTTGNGVGDLNGIIEKLDYLKTLQVDVLWLTPIYDSPQHDNGYDIRDYYSIYPEYGTMEDFERLVSEAHKRDLKVVMDLVVNHTSTEHKWFREAISSIDSPYRDFYIWKKPQENGSVPTNWESKFGGSAWELDEASGQYYLHLFDVTQADLNWENEEVRKHVYDMMHFWFEKGIDGFRLDVINLISKDQRFPNAEEGDGRSFYTDGPRVHEFLHEMNEKVFSHYDSMTVGEMSSTTVDHCIRYTNPDNKELDMTFSFHHLKVDYPNGEKWALAPFDFLKLKEILSDWQTGMHAGGGWNALFWCNHDQPRVVSRYGDDGAYRVKSAKMLATAIHMMQGTPYIYQGEELGMTNPKFTDISSYRDVESLNMYHAFKEKGMADQDITAILQAKSRDNSRTPVQWDATENGGFTTGTPWIPVAGNYREINAEAALRDQNSVFYHYQKLIQIRKMYDIVTEGTYEIIAKDDPNIFAYLRHGSNEKLLVINNFYGTEAAFTLPDSLAPDEWKAEVLLTNDEAREGLQNMTLRPYESIVYRLTKPC

SEQ ID NO: 23111 - protein, 1462 aa, Bacillus subtilis
MRIQKRRTHVENILRILLPPIMILSLILPTPPIHAEESAAPQVHLSILATTDIHANMMDYDYYSDKETADFGLARTAQLIQKHREQNPNTLLVDNGDLIQGNPLGEYAVKYQKDDIISGTKTHPIISVMNALKYDAGTLGNHEFNYGLDFLDGTIKGADFPIVNANVKTTSGENRYTPYVINEKTLIDENGNEQKVKVGYIGFVPPQIMTWDKKNLEGQVQVQDIVESANETIPKMKAEGADVIIALAHTGIEKQAQSSGAENAVFDLATKTKGIDAIISGHQHGLFPSAEYAGVAQFNVEKGTINGIPVVMPSSWGKYLGVIDLKLEKADGSWKVADSKGSIESIAGNVTSRNETVTNTIQQTHQNTLEYVRKPVGKTEADINSFFAQVKDDPSIQIVTDAQKWYAEKEMKDTEYKNLPILSAGAPFKAGGRNGANYYTNIPAGDLAIKNVGDLYLYDNTVQIVKLTGSEVKDWLEMSAGQFNQIDPAKGGDQALLNENFRSYNFDVIDGVTYQVDVTKPAKYNENGKVINADSSRIINLSYEGKPISPSQEFLVVTNNYRASGGGGFPHLTSDKIVHGSAVENRQVLMDYIIEQKTVNPKADNNWSIAPVSGTNLTFESSLLAKPFADKADDVAYVGKSANEGYGVYKLQFDDDSNPDPPKDGLWDLTVMHTNDTHAHLDDAARRMTKINEVRSETNHNILLDAGDVFSGDLYFTKWNGLADLKMMNMMGYDAMTFGNHEFDKGPTVLSDFLSGNSATVDPANRYHFEAPEFPIVSANVDVSNEPKLKSFVKKPQTFTAGEKKEAGIHPYILLDVDGEKVAVFGLTTEDTATTSSPGKSIVFNDAFETAQNTVKAIQEEEKVNKIIALTHIGHNRDLELAKKVKGIDLIIGGHTHTLVDKMEVVNNEEPTIVAQAKEYGQFLGRVDVAFDEKGVVQTDKSNLSVLPIDEHTEENPEAKQELDQFKNELEDVKNEKVGYTDVALDGQREHVRTKETNLGNFIADGMLAKAKEAAGARIAITNGGGIRAGIDKGDITLGEVLNVMPFGNTLYVADLTGKQIKEALEQGLSNVENGGGAFPQVAGIEYTFTLNNKPGHRVLEVKIESPNGDKVAINTDDTYRVATNNFVGAGGDGYSVFTEASHGEDLGYVDYEIFTEQLKKLGNKVSPKVEGRIKEVFLPTKQKDGSWTLDEDKFAIYAKNANTPFVYYGIHEGSQEKPINLKVKKDQVKLLKERESDPSLTMFNYWYSMKMPMANLKTADTAIGIKSTGELDVSLSDVYDFTVKQKGKEIKSFKEPVQLSLRMFDIEEAHNPAIYHVDRKKKAFTKTGHGSVDDDMVTGYTNHFSEYTILNSGSNNKPPAFPSDQPTGGDDGNHGGGSDKPGGKQPTDGNGGNDTPPGTQPTNGSGGNGSGGSGTDGPAGGLLPDTATSMYSILLAGFLISALGTAMYLHQRRKQNRANQA

SEQ ID NO: 23112 - protein, 1148 aa, Bacillus subtilis
MSQQSIQKVLVANRGEIAIRIFRACTELNIRTVAVYSKEDSGSYHRYKADEAYLVGEGKKPIDAYLDIEGIIDIAKRNKVDAIHPGYGFLSENIHFARRCEEEGIVFIGPKSEHLDMFGDKVKAREQAEKAGIPVIPGSDGPAETLEAVEQFGQANGYPIIIKASLGGGGRGMRIVRSESEVKEAYERAKSEAKAAFGNDEVYVEKLIENPKHIEVQVIGDKQGNVVHLFERDCSVQRRHQKVIEVAPSVSLSPELRDQICEAAVALAKNVNYINAGTVEFLVANNEFYFIEVNPRVQVEHTITEMITGVDIVQTQILVAQGHSLHSKKVNIPEQKDIFTIGYAIQSRVTTEDPQNDFMPDTGKIMAYRSGGGFGVRLDTGNSFQGAVITPYYDSLLVKLSTWALTFEQAAAKMVRNLQEFRIRGIKTNIPFLENVAKHEKFLTGQYDTSFIDTTPELFNFPKQKDRGTKMLTYIGNVTVNGFPGIGKKEKPAFDKPLGVKVDVDQQPARGTKQILDEKGAEGLANWVKEQKSVLLTDTTFRDAHQSLLATRIRSHDLKKIANPTAALWPELFSMEMWGGATFDVAYRFLKEDPWKRLEDLRKEVPNTLFQMLLRSSNAVGYTNYPDNVIKEFVKQSAQSGIDVFRIFDSLNWVKGMTLAIDAVRDTGKVAEAAICYTGDILDKNRTKYDLAYYTSMAKELEAAGAHILGIKDMAGLLKPQAAYELVSALKETIDIPVHLHTHDTSGNGIYMYAKAVEAGVDIIDVAVSSMAGLTSQPSASGFYHAMEGNDRRPEMNVQGVELLSQYWESVRKYYSEFESGMKSPHTEIYEHEMPGGQYSNLQQQAKGVGLGDRWNEVKEMYRRVNDMFGDIVKVTPSSKVVGDMALYMVQNNLTEKDVYEKGESLDFPDSVVELFKGNIGQPHGGFPEKLQKLILKGQEPITVRPGELLEPVSFEAIKQEFKEQHNLEISDQDAVAYALYPKVFTDYVKTTESYGDISVLDTPTFFYGMTLGEEIEVEIERGKTLIVKLISIGEPQPDATRVVYFELNGQPREVVIKDESIKSSVQERLKADRTNPSHIAASMPGTVIKVLAEAGTKVNKGDHLMINEAMKMETTVQAPFSGTIKQVHVKNGEPIQTGDLLLEIEKA

SEQ ID NO: 23113 - protein, 426 aa, Bacillus subtilis
MDQQIYSLQKKVEEHKEELIQLAKTLISYQTPAPPARNTEGIQSWIAGYLNELGFSIDKWDVYPGDPNVVGRLKGTDSADYYSLIINGHVDVAEVKEDEEWKHDPFHPIEKNGLLIGRGASDMKGGMACVLFAVKLIREASIELPGDLILQSVIGEEVGEAGTLECCKRGYHADFAIVADTSDMHIQGQGGVITGWIEIKSSQTFHDGTRRNMIHAGGGTFGASAIEKMAKIIAGLGELERHWSIMKSYPGFKPGTNTINPAVIEGGRHAAFIADECRLWITVHFYPNETHDQVAAEIEDYVNRLSDSDIWLRENRPVFKWGGSSMIEDRGEIFPALEVDPGHPGVLALTASHQKVKRECPIIDVSQSVTDGGWLYDAGIPCVIYGPGDLHNAHSVNEKVSIEQLVEYTKIILDFIISWCSRKKEQ

SEQ ID NO: 23114 - protein, 181 aa, Bacillus subtilis
MNQKAVILDEQAIRRALTRIAHEMIERNKGMNNCILVGIKTRGIYLAKRLAERIEQIEGNPVTVGEIDITLYRDDLSKKTSNDEPLVKGADIPVDITDQKVILVDDVLYTGRTVRAGMDALVDVGRPSSIQLAVLVDRGHRELPIRADYIGKNIPTSKSEKVMVQLDEVDQNDLVAIYENE

SEQ ID NO: 23115 - protein, 304 aa, Bacillus subtilis
MKHLTTMSELSTEEIKDLLQTAQELKSGKTDNQLTGKFAANLFFEPSTRTRFSFEVAEKKLGMNVLNLDGTSTSVQKGETLYDTIRTLESIGVDVCVIRHSEDEYYEELVSQVNIPILNAGDGCGQHPTQSLLDLMTIYEEFNTFKGLTVSIHGDIKHSRVARSNAEVLTRLGARVLFSGPSEWQDEENTFGTYVSMDEAVESSDVVMLLRIQNERHQSAVSQEGYLNKYGLTVERAERMKRHAIIMHPAPVNRGVEIDDSLVESEKSRIFKQMKNGVFIRMAVIQCALQTNVKRGEAAYVISH

SEQ ID NO: 23116 - protein, 364 aa, Bacillus subtilis
MKRRLVLENGAVFEGEAFGSLEHNMGEVVFNTGMTGYQEILSDPSYCGQIVTLTYPLIGNYGINRDDFESITPFVKGLIIKELCELPSNWRSAYTLDEYLKMKNIPGLQGIDTRKLTRMIRTAGALKGTFASSDEDIEAVLKRLNETELPRNQVSQVSAKTAYPSPGRGKRIVLVDFGMKHGILRELNKRKCDVIVVPYNITAEEVLQLKPDGIMLSNGPGDPKDVPEAIEMIKGVLGKVPLFGICLGHQLFALACGANTEKMKFGHRGSNHPVKELATGKVALTSQNHGYTVSSISKTELEVTHIAINDDTIEGLKHKTLPAFTVQYHPEASPGPEDANHLFDRFIEMIETTEKEGEAVCQNA

SEQ ID NO: 23117 - protein, 1071 aa, Bacillus subtilis
MPKRVDINKILVIGSGPIIIGQAAEFDYAGTQACLALKEEGYEVILVNSNPATIMTDTEMADRVYIEPLTPEFLTRIIRKERPDAILPTLGGQTGLNLAVELSERGVLAECGVEVLGTKLSAIQQAEDRDLFRTLMNELNEPVPESEIIHSLEEAEKFVSQIGFPVIVRPAYTLGGTGGGICSNETELKEIVENGLKLSPVHQCLLEKSIAGYKEIEYEVMRDSQDHAIVVCNMENIDPVGIHTGDSIVVAPSQTLSDREYQLLRNVSLKLIRALGIEGGCNVQLALDPDSFQYYIIEVNPRVSRSSALASKATGYPIAKLAAKIAVGLSLDEMMNPVTGKTYAAFEPALDYVVSKIPRWPFDKFESANRKLGTQMKATGEVMAIGRTLEESLLKAVRSLEADVYHLELKDAADISDELLEKRIKKAGDERLFYLAEAYRRGYTVEDLHEFSAIDVFFLHKLFGIVQFEKELKANAGDTDVLRRAKELGFSDQYISREWKMKESELYSLRKQAGIAPVFKMVDTCAAEFESETPYFYSTYEEENESVVTDKKSVMVLGSGPIRIGQGVEFDYATVHSVWAIKQAGYEAIIVNNNPETVSTDFSISDKLYFEPLTIEDVMHIIDLEQPMGVVVQFGGQTAINLADELSARGVKILGTSLEDLDRAEDRDKFEQALGELGVPQPLGKTATSVNQAVSIASDIGYPVLVRPSYVLGGRAMEIVYHEEELLHYMKNAVKINPQHPVLIDRYLTGKEIEVDAVSDGETVVIPGIMEHIERAGVHSGDSIAVYPPQSLTEDIKKKIEQYTIALAKGLNIVGLLNIQFVLSQGEVYVLEVNPRSSRTVPFLSKITGIPMANLATKIILGQKLAAFGYTEGLQPEQQGVFVKAPVFSFAKLRRVDITLGPEMKSTGEVMGKDSTLEKALYKALIASGIQIPNYGSVLLTVADKDKEEGLAIAKRFHAIGYNILATEGTAGYLKEASIPAKVVGKIGQDGPNLLDVIRNGEAQFVINTLTKGKQPARDGFRIRRESVENGVACLTSLDTAEAILRVLESMTFRADQMPAVNTNQEAAVTI

SEQ ID NO: 23118 - protein, 233 aa, Bacillus subtilis
MLTYDNWEEPTITFPEDDPYKGALSVLKWAYGHYGDQLVYACSFGIEGIVLIDLIYKVKKDAEIVFLDTGLHFKETYETIERVKERYPGLNIILKKPDLTLEEQAEEHGDKLWEREPNQCCYLRKVVPLREALSGHPAWLSGLRRDQGPSRANTNFLNKDEKFKSVKVCPLIHWTWKDIWRYTSRNELDYNPLHDQGYPSIGCAPCTSPAFTAEDLRSGRWNGMAKTECGLHE

SEQ ID NO: 23119 - protein, 382 aa, Bacillus subtilis
MSLAPHGGTLVNRVDESYDVSGIQKEIELDLISFADLELIGIGAYSPIEGFFNEKDYVSVVENMRLSSGVVWSLPITLPVDAQKAAELSLGETVKLTYEGETYGVIQIEDLYVPDKQKEAVNVYKTDEQEHPGVKKLFSRGNTYVGGPITLIKKASKQFPEFTFEPSETRRQFAEKGWETIVGFQTRNPVHRAHEYIQKTALETVDGLFLNPLVGETKSDDIPADVRMESYQVLLDHYYPKDRVFLGVFLAAMRYAGPREAIFHALVRKNYGCTHFIVGRDHAGVGDYYGTYEAQELFDTFKPEELGITPLKFEHSFFCKKCGNMGTAKTCPHGREHHVILSGTKVRGMLRDGVLPPAEFSRKEVVEVLIKGMKKKEEVGVS

SEQ ID NO: 23120 - protein, 197 aa, Bacillus subtilis
MTNRDIVWHEASITKEEYQQKNKHKSSILWLTGLSGSGKSTIANAAARELFEQGYQVIVLDGDNIRHGLNRDLGFSDEDRKENIRRIGEVAKLFVQQGTIVITAFISPFREDRQQVRELVEAGEFNEVYIKCDLDICEQRDPKGLYKKARNGEIPFFTGIDSPYEEPEAPELVLDSGQHDREACKNQLIEFVKQKLS

SEQ ID NO: 23121 - protein, 890 aa, Bacillus subtilis
MKFHEMGQTDLLEATNTSMKQGLTEKEVKKRLDKHGPNELQEGKKTSALLLFFAQFKDFMVLVLLAATLISGFLGEYVDAVAIIAIVFVNGILGFFQERRAEQSLQALKELSTPHVMALREGSWTKIPSKELVPGDIVKFTSGDRIGADVRIVEARSLEIEESALTGESIPVVKHADKLKKPDVSLGDITNMAFMGTIVTRGSGVGVVVGTGMNTAMGKIADMLESAGTLSTPLQRRLEQLGKILIVVALLLTVLVVAVGVIQGHDLYSMFLAGVSLAVAAIPEGLPAIVTVALSLGVQRMIKQKSIVRKLPAVETLGCASIICSDKTGTMTQNKMTVTHVWSGGKTWRVAGAGYEPKGSFTLNEKEISVNEHKPLQQMLLFGALCNNSNIEKRDGEYVLDGDPTEGALLTAARKGGFSKEFVESNYRVIEEFPFDSARKMMTVIVENQDRKRYIITKGAPDVLMQRSSRIYYDGSAALFSNERKAETEAVLRHLASQALRTIAVAYRPIKAGETPSMEQAEKDLTMLGLSGIIDPPRPEVRQAIKECREAGIKTVMITGDHVETAKAIAKDLRLLPKSGKIMDGKMLNELSQEELSHVVEDVYVFARVSPEHKLKIVKAYQENGHIVAMTGDGVNDAPAIKQADIGVSMGITGTDVAKEASSLVLVDDNFATIKSAIKEGRNIYENIRKFIRYLLASNVGEILVMLFAMLLALPLPLVPIQILWVNLVTDGLPAMALGMDQPEGDVMKRKPRHPKEGVFARKLGWKVVSRGFLIGVATILAFIIVYHRNPENLAYAQTIAFATLVLAQLIHVFDCRSETSVFSRNPFQNLYLIGAVLSSILLMLVVIYYPPLQPIFHTVAITPGDWMLVIGMSAIPTFLLAGSLLTRKK

SEQ ID NO: 23122 - protein, 317 aa, Bacillus subtilis
MSKIAFLFPGQGSQFIGMGKELYEQVPAAKRLFDEADETLETKLSSLIFEGDAEELTLTYNAQPALLTTSIAVLEKFKESGITPDFTAGHSLGEYSALVAAGALSFKDAVYTVRKRGEFMNEAVPAGEGAMAAILGMDAEALKQVTDKVTEEGNLVQLANLNCPGQIVISGTAKGVELASELAKENGAKRAIPLEVSGPFHSELMKPAAEKLKEVLDACDIKDADVPVISNVSADVMTEKADIKEKLIEQLYSPVRFEESINKLIAEGVTTFIEIGPGKVLSGLVKKVNRRLKTIAVSDPETIELAIQTLKEENDNA

SEQ ID NO: 23123 - protein, 246 aa, Bacillus subtilis
MLNDKTAIVTGASRGIGRSIALDLAKSGANVVVNYSGNEAKANEVVDEIKSMGRKAIAVKADVSNPEDVQNMIKETLSVFSTIDILVNNAGITRDNLIMRMKEDEWDDVININLKGVFNCTKAVTRQMMKQRSGRIINVSSIVGVSGNPGQANYVAAKAGVIGLTKSSAKELASRNITVNAIAPGFISTDMTDKLAKDVQDEMLKQIPLARFGEPSDVSSVVTFLASEGARYMTGQTLHIDGGMVM

SEQ ID NO: 23124 - protein, 1186 aa, Bacillus subtilis
MFLKRLDVIGFKSFAERISVDFVKGVTAVVGPNGSGKSNITDAIRWVLGEQSARSLRGGKMEDIIFAGSDSRKRLNLAEVTLTLDNDDHFLPIDFHEVSVTRRVYRSGESEFLINNQPCRLKDIIDLFMDSGLGKEAFSIISQGKVEEILSSKAEDRRSIFEEAAGVLKYKTRKKKAENKLFETQDNLNRVEDILHELEGQVEPLKIQASIAKDYLEKKKELEHVEIALTAYDIEKLHGKWSTLKEKVQMAKEEELAESSAISAKEAKIEDTRDKIQALDESVNELQQVLLVTSEELEKLEGRKEVLKERKKNAVQNQEQLEEAIVQFQQKETVLKEELSKQEAVFETLQAEVKQLRAQVKEKQQALSLHNENVEEKIEQLKSDYFELLNSQASIRNELQLLDDQMSQSAVTLQRLADNNEKHLQERHDISARKAACETEFARIEQEIHSQVGAYRDMQTKYEQKKRQYEKNESALYQAYQYVQQARSKKDMLETMQGDFSGFYQGVKEVLKAKERLGGIRGAVLELISTEQKYETAIEIALGASAQHVVTDDEQSARKAIQYLKQNSFGRATFLPLSVIRDRQLQSRDAETAARHSSFLGVASELVTFDPAYRSVIQNLLGTVLITEDLKGANELAKLLGHRYRIVTLEGDVVNPGGSMTGGAVKKKNNSLLGRSRELEDVTKRLAEMEEKTALLEQEVKTLKHSIQDMEKKLADLRETGEGLRLKQQDVKGQLYELQVAEKNINTHLELYDQEKSALSESDEERKVRKRKLEEELSAVSEKMKQLEEDIDRLTKQKQTQSSTKESLSNELTELKIAAAKKEQACKGEEDNLARLKKELTETELALKEAKEDLSFLTSEMSSSTSGEEKLEEAAKHKLNDKTKTIELIALRRDQRIKLQHGLDTYERELKEMKRLYKQKTTLLKDEEVKLGRMEVELDNLLQYLREEYSLSFEGAKEKYQLETDPEEARKRVKLIKLAIEELGTVNLGSIDEFERVNERYKFLSEQKEDLTEAKNTLFQVIEEMDEEMTKRFNDTFVQIRSHFDQVFRSLFGGGRAELRLTDPNDLLHSGVEIIAQPPGKKLQNLNLLSGGERALTAIALLFSILKVRPVPFCVLDEVEAALDEANVFRFAQYLKKYSSDTQFIVITHRKGTMEEADVLYGVTMQESGVSKVISVKLEETKEFVQ

SEQ ID NO: 23125 - protein, 385 aa, Bacillus subtilis
MNIHEYQGKEVLRKYGVSVPEGKVAFTAEEAVESAKSLSSSVYVVKAQIHAGGRGKAGGVKIAKSLDEVKAYAEELLGKTLVTHQTGPDGQVIKRLLIEEGCDIKKEYYIGLVLDRATSRIVLMASEEGGTEIEEVAEKTPEKIKKAVIDPAVGLQGYQAREIAFAINIPKELVGKAAKFMLGLYKAFVEKDCSIAEINPLVVTGDGNVMALDAKLNFDSNALYRQKDIMEYRDLDEEDPKEIEASKYDLSYISLDGNIGCMVNGAGLAMSTMDIIKHYGGEPANFLDVGGGATAEKVTEAFKIILSDQNVKGIFVNIFGGIMKCDVIAEGVVEATRQVGLTLPLVVRLEGTNVDLGKKILSESGLNITSAESMADGAQKIVSLV

SEQ ID NO: 23126 - protein, 300 aa, Bacillus subtilis
MSVFINKDTRVIVQGITGSTALFHTKQMLEYGTNIVGGVTPGKGGTEAEGVPVFNTVAEAVQTTGANASVIYVPAPFAADAIMEAVDAELDLVICITEHIPVLDMVKVKRFMEGKKTRLIGPNCPGVITPEECKIGIMPGYIHKKGHVGVVSRSGTLTYEAVHQLSEAGVGQSTAVGIGGDPVNGTNFIDVLKAFNEDPDTHAVIMIGEIGGTAEEEAAEWVKANMTKPVVGFIGGKTAPPGKRMGHAGAIISGGKGTADEKIKTLNACGIEVAETPSVMGETLIKVLKEKNLFETCKTH

SEQ ID NO: 23127 - protein, 440 aa, Bacillus subtilis
MQLNEDTESDRLYRMTDSYKRYGKVKRVIGLMIESKGPASSIGDLCLIYAKGQSGKVIKAEVVGFQEENILLMPYLEAASIAPGSIVEATGESLRVKVGTGLIGQVIDAFGEPLDESFCRKVSPVSTEQSPPNPMKRPPIREKMGVGVRSIDSLLTVGKGQRIGIFAGSGVGKSTLMGMIAKQTEADLNVIALVGERGREVREFIEKDLGKEGLKRSIVVVATSDQPALMRLKAAYTATAIAEYFRDKGQNVMFMMDSVTRVAMAQREIGLAAGEPPTTKGYTPSVFAILPRLLERTGANEHGTITAFYTVLVDGDDMNEPIADTVRGILDGHIVLDRALANKGQFPAVNVLKSISRVMSNISTKQHLDAANKFRELLSTYQNSEDLINIGAYKRGSSREIDEAIQFYPQLIQFLKQGTDEPALLEESIAALTSLTGNEE

SEQ ID NO: 23128 - protein, 716 aa, Bacillus subtilis
MAKMRVYEYAKALNVSSKEILTALKNMDLEVNNHMAMLEEKAIKKLDAKYKKGGAAAKSQKPAETNKNKQPQGVNQQSAGNQPNKIRDGKKNDVQNNQFNKNKKNNNNKKNKRNNNNNKNQHQQKPVKPKKELPEKITFSGTLTVGALAEELGKEPSELIKKLMLLGVMATINQELDKDTIELIASEYGVETEEVIVLEETELEKYEEPDNEEDLEIRPPVVTIMGHVDHGKTTLLDSIRKTKVVEGEAGGITQHIGAYQIEENGKKITFLDTPGHAAFTTMRARGAEVTDITILVVAADDGVMPQTVEAINHAKAAEVPIIVAVNKIDKESANPDRVMQELTEYGLVPEAWGGETIFVPLSALTGKGIDELVEMILLVSEVEELKANPNRQAKGTVIEAELDKGRGSVATLLVQTGTLHVGDPIVVGNTFGRVRAMVNDIGRRVKTAGPSTPVEITGLNDVPQAGDQFLVFKDEKTARSVGEARASKQLEEQRSDKAKLSLDDLFEQIKQGDVKDINLIVKADVQGSAEALTAALQKIEVEGVKVKIIHTGVGAITESDIILASASNAIVIGFNVRPDGNAKSTAEAENVDIRLHRIIYKVIDEIEAAMKGMLDPEYEEKVIGQVEVRQTFKVSKIGTIAGGYVTEGTITRDSGLRLIRDGVVIFEGEVDVLKRFKDDVKEVSQGYECGITIKKYNDIREGDILEAFVMQEIERT

SEQ ID NO: 23129 - protein, 409 aa, Bacillus subtilis
MIKRYTCPNGVRIVLENNPTVRSVAIGVWIGTGSRHETPEINGISHFLEHMFFKGTSTKSAREIAESFDRIGGQVNAFTSKEYTCYYAKVLDEHANYALDVLADMFFHSTFDENELKKEKNVVYEEIKMYEDAPDDIVHDLLSKATYGNHSLGYPILGTEETLASFNGDSLRQYMHDYYTPDRVVISVAGNISDSFIKDVEKWFGSYEAKGKATGLEKPEFHTEKLTRKKETEQAHLCLGFKGLEVGHERIYDLIVLNNVLGGSMSSRLFQDVREDKGLAYSVYSYHSSYEDSGMLTIYGGTGANQLQQLSETIQETLATLKRDGITSKELENSKEQMKGSLMLSLESTNSKMSRNGKNELLLGKHKTLDEIINELNAVNLERVNGLARQLFTEDYALALISPSGNMPS

SEQ ID NO: 23130 - protein, 346 aa, Bacillus subtilis
MGRGLHVAVVGATGAVGQQMLKTLEDRNFEMDTLTLLSSKRSAGTKVTFKGQELTVQEASPESFEGVNIALFSAGGSVSQALAPEAVKRGAIVIDNTSAFRMDENTPLVVPEVNEADLHEHNGIIANPNCSTIQMVAALEPIRKAYGLNKVIVSTYQAVSGAGNEAVKELYSQTQAILNKEEIEPEIMPVKGDKKHYQIAFNAIPQIDKFQDNGYTFEEMKMINETKKIMHMPDLQVAATCVRLPIQTGHSESVYIEIDRDDATVEDIKNLLKEAPGVTLQDDPSQQLYPMPADAVGKNDVFVGRIRKDLDRANGFHLWVVSDNLLKGAAWNSVQIAESLKKLNLV

SEQ ID NO: 23131 - protein, 404 aa, Bacillus subtilis
MKIIVQKFGGTSVKDDKGRKLALGHIKEAISEGYKVVVVVSAMGRKGDPYATDSLLGLLYGDQSAISPREQDLLLSCGETISSVVFTSMLLDNGVKAAALTGAQAGFLTNDQHTNAKIIEMKPERLFSVLANHDAVVVAGFQGATEKGDTTTIGRGGSDTSAAALGAAVDAEYIDIFTDVEGVMTADPRVVENAKPLPVVTYTEICNLAYQGAKVISPRAVEIAMQAKVPIRVRSTYSNDKGTLVTSHHSSKVGSDVFERLITGIAHVKDVTQFKVPAKIGQYNVQTEVFKAMANAGISVDFFNITPSEIVYTVAGNKTETAQRILMDMGYDPMVTRNCAKVSAVGAGIMGVPGVTSKIVSALSEKEIPILQSADSHTTIWVLVHEADMVPAVNALHEEFELSK

SEQ ID NO: 23132 - protein, 290 aa, Bacillus subtilis
MNFGNVSTAMITPFDNKGNVDFQKLSTLIDYLLKNGTDSLVVAGTTGESPTLSTEEKIALFEYTVKEVNGRVPVIAGTGSNNTKDSIKLTKKAEEAGVDAVMLVTPYYNKPSQEGMYQHFKAIAAETSLPVMLYNVPGRTVASLAPETTIRLAADIPNVVAIKEASGDLEAITKIIAETPEDFYVYSGDDALTLPILSVGGRGVVSVASHIAGTDMQQMIKNYTNGQTANAALIHQKLLPIMKELFKAPNPAPVKTALQLRGLDVGSVRLPLVPLTEDERLSLSSTISEL

SEQ ID NO: 23133 - protein, 242 aa, Bacillus subtilis
MNKTALITGASCGIGKSISETLAARGYNLLLHYNTNQNAAAELAEKLSQMFGVNAEILQADLSAQDGADKLTSSIVQPIDAIVLNSGRSHFGLITDVDNATVQEMVQLHVASPYMLTRNLLPGMIRNKSGAIVAVSSIWGETGASCEVLYSMAKGAQHSFVKGLAKELAPSGIRVNAVAPGAVDTNMMNQFTPAEKEEIADEIPIGRLGRTQEIADATAFLLSEKASYITGQILSVNGGWHC

SEQ ID NO: 23134 - protein, 347 aa, Bacillus subtilis
MQSGKMKALMKKDGAFGAVLTEVPIPEIDKHEVLIKVKAASICGTDVHIYNWDQWARQRIKTPYVFGHEFSGIVEGVGENVSSVKVGEYVSAETHIVCGECVPCLTGKSHVCTNTAIIGVDTAGCFAEYVKVPADNIWRNPADMDPSIASIQEPLGNAVHTVLESQPAGGTTAVIGCGPIGLMAVAVAKAAGASQVIAIDKNEYRLRLAKQMGATCTVSIEKEDPLKIVSALTSGEGADLVCEMSGHPSAIAQGLAMAANGGRFHILSLPEHPVTIDLTNKVVFKGLTIQGITGRKMFSTWRQVSQLISSNMIDLAPVITHQFPLEEFEKGFELMRSGQCGKVILIP

SEQ ID NO: 23135 - protein, 392 aa, Bacillus subtilis
MTKEFEFLKAELNSMKENHTWQDIKQLESMQGPSVTVNHQKVIQLSSNNYLGFTSHPRLINAAQEAVQQYGAGTGSVRTIAGTFTMHQELEKKLAAFKKTEAALVFQSGFTTNQGVLSSILSKEDIVISDELNHASIIDGIRLTKADKKVYQHVNMSDLERVLRKSMNYRMRLIVTDGVFSMDGNIAPLPDIVELAEKYDAFVMVDDAHASGVLGENGRGTVNHFGLDGRVHIQVGTLSKAIGVLGGYAAGSKVLIDYLRHKGRPFLFSTSHPPAVTAACMEAIDVLLEEPEHMERLWENTAYFKAMLVKMGLTLTKSETPILPILIGDEGVAKQFSDQLLSRGVFAQSIVFPTVAKGKARIRTIITAEHTKDELDQALDVIEKTAKELQLL

SEQ ID NO: 23136 - protein, 858 aa, Bacillus subtilis
MAGYTPMIQQYLKIKAEHQDAFLFFRLGDFYEMFFEDAKKASQELEITLTSRDGGAAEKIPMCGVPYHSASAYIEQLIKKGYKVAICEQTEDPKAAKGVVKREVVQLITPGTVMDGKGIHESENNFIASVSACSNGYGLALSDLTTGENLAVLIERLEDVISEIYSVGAREIVVSGSLDADTVAQLRERCGATISIEDGETDEHVTIIEHLNNEDITKTFLRLYTYLKRTQKRSLDHLQPVQVYELEEAMKIDLYSKRNLELTETIRSKNKKGSLLWLLDETKTAMGGRLLKQWIDRPLIRVNQIEERQEMVETLMSHFFEREDLRERLKEVYDLERLAGRVAFGNVNARDLIQLKESLKQVPGIKQLVASLAHDKAKERAKRIDPCGDVLELLEEALYENPPLSVKEGNLIKDGYNQKLDEYRDASRNGKDWIARLEQQEREYTGIRSLKVGFNKVFGYYIEVTKANLHLLEEGRYERNETLTNAERYITPELKEKEALILEAENNICELEYELFTELREKVKQYIPRLQQLAKQMSELDALQCFATISENRHYTKPEFSKDEVEVIEGRHPVVEKVMDSQEYVPNNCMMGDNRQMLLITGPNMSGKSTYMRQIALISIMAQIGCFVPAKKAVLPIFDQIFTRIGAADDLISGQSTFMVEMLEAKNAIVNATKNSLILFDEIGRGTSTYDGMALAQAIIEYVHDHIGAKTLFSTHYHELTVLEDKLPQLKNVHVRAEEYNGTVVFLHQIKEGAADKSYGIHVAQLAELPGDLIARAQDILKELEHSGNKPEVPVQKPQVKEEPAQLSFFDEAEKPAETPKLSKKEKQVIDAFKSLNILDMTPLEAMNEMYKLQKKLH

SEQ ID NO: 23137 - protein, 627 aa, Bacillus subtilis
MAKVIQLSDELSNKIAAGEVVERPASVVKELVENAIDADSTVIEIDIEEAGLASIRVLDNGEGMENEDCKRAFRRHATSKIKDENDLFRVRTLGFRGEALPSIASVSHLEITTSTGEGAGTKLVLQGGNIISESRSSSRKGTEIVVSNLFFNTPARLKYMKTVHTELGNITDVVNRIALAHPEVSIRLRHHGKNLLQTNGNGDVRHVLAAIYGTAVAKKMLPLHVSSLDFEVKGYIALPEITRASRNYMSSVVNGRYIKNFPLVKAVHEGYHTLLPIGRHPITFIEITMDPILVDVNVHPSKLEVRLSKETELHDLIRDGIKDVFKQQQLIPSAQVPKKSAPAIKNEQQFITFDEKPPEKKVPEKSTAPSYSPMKLSSVVKEPVDAEEKLPPLQFDAPPIVDQEQTLEVSDVSAEQPETFEQECHEEQPQPASDRVPIMYPIGQMHGTYILAQNENGLYIIDQHAAQERIKYEYFREKVGEVEPEVQEMIVPLTFHYSTNEALIIEQHKQELESVGVFLESFGSNSYIVRCHPAWFPKGEEAELIEEIIQQVLDSKNIDIKKLREEAAIMMSCKGSIKANRHLRNDEIKALLDDLRSTSDPFTCPHGRPIIIHHSTYEMEKMFKRVM

SEQ ID NO: 23138 - protein, 225 aa, Bacillus subtilis
MNLTYKVHPIKTRYQGWTNYCYIIEDIVSRSAIVVDPSWELSKITTTLSELEAELKAVALTHSHYDHVNLVDPLTKMFNAQVYMSKKEIDYYQFRCRNLISLDDHQTISIGNTRAQCLLTPGHTAGGMCYLFSESIFTGDTVFTEGCGICEDDGSSAEEMFDSIQRIKSEVSPHVRVYPGHSFGKSPGHSIKDLYQHNIYFQIDKKEYFVKFRTRKNQKGIFDFK

SEQ ID NO: 23139 - protein, 288 aa, Bacillus subtilis
MITYVFPGQGSQKQGMGSGLFDEFKELTDQADEILGYSIKRLCLENPYSNLNKTQFTQPALYVVNALSYLKKIRDEEVKPDFVAGHSLGEYNALFAAEAFDFETGLQLVRKRGELMSLISNGGMAAVMGLNEEQVAKALKEYHLHDVDIANVNAPYQIVISGKKDEIEKAASLFETMTEVTMVLPLNVSGAFHSRYMNKAKEEFEEFLHAFYFSPPSIPVISNVYAKPYTYEFMKQTLADQINHSVKWTDSISYLMKKGHMEFEEVGPGNVLTGLIHRIKKDAEAMPR

SEQ ID NO: 23140 - protein, 416 aa, Bacillus subtilis
MTKCNLPEVVVTGVGVTASIGQGKEDFASSLLSGRHAFDVMKRSGRQKDSRFIGAEIASLSYPDRLSKKMLRKASFSSRAALVTLTEAWEEAELDDADSSRIGLVVGGSNFQQRENFEVYERYQDRSGFISPAYGLSFMDSDLCGICTDQFGITGLAYTVGGASASGQQLAVIHAIQQVLSGEVDTCIALGALMDLSYMECEALRALGAMGTDKYADEPENACRPFDQNRDGFIYGESCGALVIERKETALRRGLKPYAALSGWSIKLDGNRNPDPSLEGEIHVIQKALERARLLPEDIDYINPHGTGSFIGDEIELKALRACRLSHAYINATKSITGHGLSAAGIVEIISVLLQMKKSALHPSRNLDHPIDDSFHWVNEKSISYRIKNALSLSMGFGGMNTAVCIQNIEKCGGES

SEQ ID NO: 23141 - protein, 345 aa, Bacillus subtilis
MLITCSESGIDFGKSLSTYIHEYLGLNRNCRLFEVKQACYSGTAGFQMAVNFILSQTSPGAKALVIASDISRFLIAEGGDALSEDWSYAEPSAGAGAVAVLVGENPEVFQIDPGANGYYGYEVMDTCRPIPDSEAGDSDLSLMSYLDCCEQTFLEYQKRVPGANYQDTFQYLAYHTPFGGMVKGAHRTMMRKVAKVKTSGIETDFLTRVKPGLNYCQRVGNIMGAALFLALASTIDQGRFDTPKRIGCFSYGSGCCSEFYSGITTPQGQERQRTFGIEKHLDRRYQLSMEEYELLFKGSGMVRFGTRNVKLDFEMIPGIMQSTQEKPRLFLEEISEFHRKYRWIS

SEQ ID NO: 23142 - protein, 557 aa, Bacillus subtilis
MRNNDNIRILTNPSVSHGEPLHISEKQPATIPEVLYRTATELGDTKGIIYLQPDGTEVYQSYRRLWDDGLRIAKGLRQSGLKAKQSWILQLGDNSQLLPAFWGCVLTGVVPAPLAVPPTYAESSSGTQKLKDAWTLLDKPAVITDRGMHQEMLDWAKEQGLEGFRAIIVEDLLSAEADTDWHQSSPEDLALLLLTSGSTGTPKAVMLNHRNIMSMVKGIIQMQGFTREDITFNWMPFDHVGGIGMLHLRDVYLGCQEINVSSETILMEPLKWLDWIDHYRASVTWAPNFAFGLVTDFAEEIKDKKWDLSSMRYMLNGGEAMVAKVGRRILELLEPHGLPADAIRPAWGMSETSSGVIFSHEFTRAGTSDDDHFVEIGSPIPGFSMRIVNDHNELVEEGEIGRFQVSGLSVTSGYYQRPDLNESVFTEDGWFETGDLGFLRNGRLTITGRTKDAIIINGINYYSHAIESAVEELPEIETSYTAACAVRLGQNSTDQLAIFFVTSAKLNDEQMSQLLRNIQSHVSQVIGVTPEYLLPVQKEEIPKTAIGKIQRTQLPIG

SEQ ID NO: 23143 - protein, 4447 aa, Bacillus subtilis
MLTCLTEELHVSHDWVEPNANANIQSLGVNSIKMMKLIRSIEKNYHIKLTAREIHQYPTIERLASYLSEHEDLSSLSADKKGTDTYKTEPERSQATFQPLSEVQKGLWTLQKMSPEKSAYHVPLCFKFSSGLHHETFQQAFGLVLNQHPILKHVIQEKDGVPFLKNEPALSIEIKTENISSLKESDIPAFLRKKVKEPYVKENSPLVRVMSFSRSEQEHFLLVVIHHLIFDGVSSVTFIRSLFDTYQLLLKGQQPEKAVSPAIYHDFAAWEKNMLAGKDGVKHRTYWQKQLSGTLPNLQLPNVSASSVDSQFREDTYTRRLSSGFMNQVRTFAKEHSVNVTTVFLSCYMMLLGRYTGQKEQIVGMPAMVRPEERFDDAIGHFLNMLPIRSELNPADTFSSFISKLQLTILDGLDHAAYPFPKMVRDLNIPRSQAGSPVFQTAFFYQNFLQSGSYQSLLSRYADFFSVDFVEYIHQEGEYELVFELWETEEKMELNIKYNTGLFDAASISAMFDHFVYVTEQAMLNPSQPLKEYSLLPEAEKQMILKTWNATGKTYPYITFHELFEQQAKKTPDRAAVSYEGQTLTYRELDEKSTQLAIYLQAHGVGPDRLAGIYVDRSLDMLVGLLAILKAGGAYVPLDPSYPAERLEYMLEDSEVFITLTTSELVNTLSWNGVTTALLDQDWDEIAQTASDRKVLTRTVTPENLAYVIYTSGSTGKPKGVMIPHKALTNFLVSMGETPGLTAEDKMLAVTTYCFDIAALELFLPLIKGAHCYICQTEHTKDVEKLKRDIRAIKPTVMQATPATWKMLFYSGWENEESVKILCGGEALPETLKRYFLDTGSEAWNMFGPTETTIWSAVQRINVECSHATIGRPIANTQIYITDSQLAPVPAGVPGELCIAGDGVAKGYYKKEELTDSRFIDNPFEPGSKLYRTGDMARWLTGGRIEYIGRIDNQVKIRGFRIELGDIESRLSEHPGILECVVVADMDNLAAYYTAKHANASLTARELRHFVKNALPAYMVPSYFIQLDHMPLTPNGKIDRNSLKNIDLSGEQLKQRQTSPKNIQDTVFTIWQEVLKTSDIEWDDGFFDVGGDSLLAVTVADRIKHELSCEFSVTDLFEYSTIKNISQYITEQRMGDASDHIPTDPAAHIEDQSTEMSDLPDYYDDSVAIIGISCEFPGAKNHDEFWENLRDGKESIAFFNKEELQRFGISKEIAENADYVPAKASIDGKDRFDPSFFQISPKDAEFMDPQLRMLLTHSWKAIEDAGYAARQIPQTSVFMSASNNSYRALLPSDTTESLETPDGYVSWVLAQSGTIPTMISHKLGLRGPSYFVHANCSSSLIGLHSAYKSLLSGESDYALVGGATLHTESNIGYVHQPGLNFSSDGHIKAFDASADGMIGGEGVAVVLLKKAADAVKDGDHIYALLRGIGVNNDGADKVGFYAPSVKGQADVVQQVMNQTKVQPESICYVEAHGTGTKLGDPIELAALTNVYRQYTNKTQFCGIGSVKTNIGHLDTAAGLAGCIKVVMSLYHQELAPSVNYKEPNPNTDLASSPFYVVDQKKTLSREIKTHRAALSSFGLGGTNTHAIFEQFKRDSDKGKIDGTCIVPISAKNKERLQEYAEDILAYLERRGFENSQLPDFAYTLQVGREAMEHRVVFIADHVNELKQRLTDFINGNTAIEGCFQGSKHNAREVSWLTEDEDSAELIRKWMAKGKVNKLAEMWSKGAHIDWMQLYKGERPNRMSLPTYPFAKERYWPSQDDRKPVAQISGNQTGIGSIHPLLHQNTSDFSEQKFSSVFTGDEFFLRDHVVRGKPVLPGVAYLEMAYAAINQAAGSEIGQDVRIRLNHTVWVQPVVVDRHSAQVDISLFPEEDGKITFDIYSTQEDGDDPVIHSQGSAELASAAETPVADLTEMSRRCGKGKMSPDQFYEEGRSRGMFHGPAFQGIKNVNIGNREVLAQLQLPEIVSGTNEQFVLHPSIMDSALQTATICIMQELTDQKLILPFALEELEVIKGCSSSMWAYARLSDSDHSGGVVQKADIDVIDESGTVCVRIKGFSTRVLEGEVHTSKPSTRHERLMLEPVWEKQNEEREDEDLSYTEHIIVLFETERSVTDSIASHMKDARVITLNEAVGHIAERYQCYMQNIFELLQSKVRKLSAGRIIIQAIVPLEKEKQLFAGVSGLFKTAEIEFSKLTAQVIEIEKPEEMIDLHLKLKDDSRRPFDKQIRYEAGYRFVKGWREMVLPSADTLHMPWRDEGVYLITGGAGSLGLLFAKEIANRTGRSTIVLTGRSVLSEDKENELEALRSIGAEVVYREADVSDQHAVRHLLEEIKERYGTLNGIIHGAGSSKDRFIIHKTNEEFQEVLQPKVSGLLHVDECSKDFPLDFFIFFSSVSGCLGNAGQADYAAANSFMDAFAEYRRSLAASKKRFGSTISFNWPLWEEGGMQVGAEDEKRMLKTTGMVPMPTDSGLKAFYQGIVSDKPQVFVMEGQLQKMKQKLLSAGSKAKRNDQRKADQDQGQTRKLEAALIQMVGAILKVNTDDIDVNTELSEYGFDSVTFTVFTNKINEKFQLELTPTIFFEYGSVQSLAEYVVAAYQGEWNQDATAKGKDERTNLVHSLSSLEASLSNMVSAILKVNSEDIDVNTELSEYGFDSVTFTVFTNKINEEFQLELTPTIFFEYGSLHSLAEYLTVEHGDTLVQEREKPEGQEELQTKSSEAPKITSRRKRRFTQPIIAKAERNKKQAADFEPVAIVGISGRFPGAMDIDEFWKNLEEGKDSITEVPKDRWDWREHYGNPDTDVNKTDIKWGGFIDGVAEFDPLFFGISPREADYVDPQQRLLMTYVWKALEDAGCSPQSLSGTGTGIFIGTGNTGYKDLFHRANLPIEGHAATGHMIPSVGPNRMSYFLNIHGPSEPVETACSSSLVAIHRAVTAMQNGDCEMAIAGGVNTILTEEAHISYSKAGMLSTDGRCKTFSADANGYVRGEGVGMVMLKKLEDAERDGNHIYGVIRGTAENHGGRANTLTSPNPKAQADLLVRAYRQADIDPSTVTYIEAHGTGTELGDPIEINGLKAAFKELSNMRGESQPDVPDHRCGIGSVKSNIGHLELAAGISGLIKVLLQMKHKTLVKSLHCETLNPYLQLTDSPFYIVQEKQEWKSVTDRDGNELPRRAGISSFGIGGVNAHIVIEEYMPKANSEHTATEQPNVIVLSAKNKSRLIDRASQLLEVIRNKKYTDQDLHRIAYTLQVGREEMDERLACVAGTMQELEEKLQAFVDGKEETDEFFRGQSHRNKETQTIFTADEDMALALDAWIRKRKYAKLADLWVKGVSIQWNTLYGETKPRLISLPSYPFAKDHYWVPAKEHSERDKKELVNAIEDRAACFLTKQWSLSPIGSAVPGTRTVAILCCQETADLAAEVSSYFPNHLLIDVSRIENDQSDIDWKEFDGLVDVIGCGWDDEGRLDWIEWVQRLVEFGHKEGLRLLCVTKGLESFQNTSVRMAGASRAGLYRMLQCEYSHLISRHMDAEEVTDHRRLAKLIADEFYSDSYDAEVCYRDGLRYQAFLKAHPETGKATEQSAVFPKDHVLLITGGTRGIGLLCARHFAECYGVKKLVLTGREQLPPREEWARFKTSNTSLAEKIQAVRELEAKGVQVEMLSLTLSDDAQVEQTLQHIKRTLGPIGGVIHCAGLTDMDTLAFIRKTSDDIQRVLEPKVSGLTTLYRHVCNEPLQFFVLFSSVSAIIPELSAGQADYAMANSYMDYFAEAHQKHAPIISVQWPNWKETGMGEVTNQAYRDSGLLSITNSEGLRFLDQIVSKKFGPVVLPAMANQTNWEPELLMKRRKPHEGGLQEAALQSPPARDIEEADEVSKCDGLLSETQSWLIDLFTEELRIDREDFEIDGLFQDYGVDSIILAQVLQRINRKLEAALDPSILYEYPTIQRFADWLIGSYSERLSALFGGRISDASAPLENKIEAEASVPGKDRALTPQIQAPAILSPDSHAEGIAVVGLSCRFPGAETLESYWSLLSEGRSSIGPIPAERWGCKTPYYAGVIDGVSYFDPDFFLLHEEDVRAMDPQALLVLEECLKLLYHAGYTPEEIKGKPVGVYIGGRSQHKPDEDSLDHAKNPIVTVGQNYLAANLSQFFDVRGPSVVVDTACSSALVGMNMAIQALRGGDIQSAIVGGVSLLSSDASHRLFDRRGILSKHSSFHVFDERADGVVLGEGVGMVMLKTVKQALEDGDIIYAVVKAASVNNDGRTAGPATPNLEAQKEVMKDALFKSGKKPEDISYLEANGSGSIVTDLLELKAIQSVYRSGHSSPLSLGSIKPNIGHPLCAEGIASFIKVVLMLKERRFVPFLSGEKEMAHFDQQKANITFSRALEKWTDSQPTAAINCFAGGGTNAHVIVEAWEKDEKHAIKRSPISPPQLKKRMLSPGEPKLEAETSKMTAANIWDTYEVEV

SEQ ID NO: 23144 - protein, 4273 aa, Bacillus subtilis
MITEQLHISLNNPIMSNHKVYGQALLPGLAYIDLIYQVFQEHGYAYQELELKNLTIFYPLIADESYDIALTIHVSEREEGTWSIIIDGQKQHGESLSDKRQYETADMHRKEQTAFAESIDLNQWKSTADRILNLDEIYEQCRSQELVHTGMMKAEGQIYEAKEGAVIDLAVGQEALRHSDAFLFHPTLIDGSGIGSSCLISDQTMYLPLYYESFSASERLQKGCTARILSSSVRQKKELTYMTIEYFNSAGQKVAELKQFAGKSVRNMSAFHSAKQIQEERAAVSQNITRDYPAFEMYLRQLLAKQLERPAEQMDIHAGYYELGLDSSSLLTVVQEIGDKVGADLAPTLLFEFTTIAELAAHLADHYSIGEADDAVRQSPSPIDGVTSSPEIGEDIAIIGMAGRYPKAKNIQEFWEQLKAGTDCITEIPNSRWEWKESDGLDSPAGKPLSKWGGFIEEADCFDPQFFRISPREAEMMDPQERLFLETCWEAIEDAGYTPETIASPQGENKRQHVGVFAGVMHKDYSLIGAEALSEHNPFPLSLNYAQIANRVSYYCNFHGPSMAVDTVCSSSLTAVHLAIESIRNGECEAALAGGVNLSLHPAKYISYGSVGMHSSDGYCHTFGKGGDGYVSGEGVGTVLLKPLRKAEQDGDRIYAVIKGSAINHVGKVSGITVPSPVAQADVIEACLEKTGIDPRTISYVEPMALAPHWEIRLKVQGLVKAFSRNTQDKQFCSIGSVKSNIGHAEAAAGISGLTKTVLQLHHKTLVPSLHSEELNPYLKLDQTPFFVQHETKEWEQPSFTENGVDVTYPRRAGLSSFGASGSNAHLILEEYIPAESHSETILTKNEEIVIPLSARNKDRLQAYALKLLDFLSEDVNLLALAYTMQAGRVEMEERAAFIVKDIKDLTAKLRAFANGEEEIEGCWTGRAKENQEAAGLASVNALNNNLIRDSEMMEMAKAWVQGKRVTWDDLYGDRKPLKISVPTYPFARERYWISVPEMKTSTVNHILHPLVHRNTSDFTEQRFSSVFTGTEFFLSDHVVQGQKILPGVAYLEMAREAAEKAAGDLDGEQRVVSLKDIVWVRPITIESEPKEIHIGLFPEDNGDISFDIYSSSEHKEEALTIHCQGRAVISDEAETSILNLSSIQTECSLDTVTSEQCYAAFRKIGLDYGEGYQGIEKVYVGKDQLLAKISLPAFLKNDKQHFALHPSLMDSAFHATVGFIVSSVNAAGQAQTLSLPFALQEVDIFSPCPEKIWSYIRYSSDSKAENKVRKYDIDLCDENGRVCVRMKGASMRALDGEQHSKPQLLTDSQLTGHTVMIPVWEPVSLEAEDNASFAGKRAVLCGAAEADRTFIKHHYPQISFVDIRPADDIEAIADKLQAYGSIDHVLWIAPSHRGSIGSDGQEEAVLHLFKLVKACLQLGYGEKQLEWSLVTVQAQPVTQHEAVQPAHASIHGLAGTMAKEYPHWKIRLLDLEKGCTWPVNHMFALPADRLGHAWAYRNQQWHQQQLIPYRSSLSGDTLYRKGGVYVVIGGAGYIGEAWSEYMIRRYQAQIVWIGRSQLNAAIQSKIDRLSALGPEPFYIAADAADKHSLQQAYEQVKKRHPHIHGIVHSAMVLFEQSLEKMKPEEFTAGLAAKIDVSIRMAQVFRQENVDFVLFFSSLVAHIKNVKQSHYASGCTFADAFAHQLSQSWACPVKVMNWGYWGNSEAAEDEHYVQLMNQIGLGLIEPAEAMKALEALLSGPVSQTAFIHTTKPVAVEGVNQNEFITLYPEQPSADAESLMERLPTTGRFQRVTHEELDDLLYRLLLGQLQTAELFDGYTLSVERLQQYKTREFYGKWIRQTSEFLLQHGYLKKVGDSLVRKDQAEDIELLWLEWNAKKEKWLKDSETKAMVVLAEAMLQALPDILTGKVPATDIMFPHSSMELVEGIYKHNQVADYFNKVLADTLLAYLDERLKHDPEASIRIMEIGAGTGGTSAGIFEKLKPYQKHINEYCYTDLSKAFLLHAEKEYGAENPYLTYQLFDVEKPIDQQEFEAGGYDVVIAANVLHATKNIRQTLRHTKAVMKNNGMLLLNEMAGNSLFPHITFGLLEGWWLYEDPAVRIPGCPGLHPDSWKAALESEGFESVFFPAEAAHDLSHQIVAASSNGLVRRMMKNVILPEKVVSQASNQEPAYIHTIDSEEAGQSKHALLREKSTEYMKKLIGETLKIPAGKIESSEPLEKYGIDSIVVVQLTNTLRKEFDHVSSTLFFEYQTIDALVEHFIKTKTEALMKLTGLDRQVQQHTPAESRTQSSQKPDQAAKRTRRFRKLGFSGEKETPTNTLASRDVAVIGISGRYPQAETAEDFWNNLKEGRNCIEEIPKDRWDWKAYYDKEKGKEGSIYTKWGGFIKDMDKFDPLFFQISPLEAERMDPQERLFLQTAYASIEDAGYTPDSLCSSRKIGVFAGVMNKNYPTGYGYWSIANRISYLLNFQGPSLAVDTACSSSLTAIHLALESIYSGSSDCAIAGGVNLVVDPVHYQNLSVMNMLSASDTCKSFGDDADGFVDGEGVGAIVLKPLQQAIADGDHIYGVIKASAINSGGKTNGYTVPNPHAQAQVIKEAIERADIPARTISYLEAHGTGTALGDPIEIAGLTKAFEKDTQEKQFCAIGSSKSNIGHCESAAGIAGLTKILFQFKYGQIAPSLHAQRLNPNIEFSHTPFVVQQQLGEWKRPVIGGQEVPRRAGLSSFGAGGSNAHIILEEYIPRTGAQTPKDHPPALIVLSAKNMERLQEKAEQLLTAIKQKRYCETDLIRIAYTLQTGREAMEERLAFIAESLEDLERKLNDFIENKADSLYLDRIDDNKKALAVLSADEDTEKIIEAWMSKGKYTKLLDLWVKGLSFDWGMLYGTQTPVRISLPAYPFAKERYWAPGAAKAPVSIEQDHDQQTEEPFKVMTFQEVWKEEPATLTSKRIKTLICFLTEREKQNAFASALKNVDQDTKVIFISQGEVYSKQSEYSYQIVRQEPVTFEKAFQSIKEELGEPDAILYMWPMEDKRCIKDHSCIVYLLQGMSAAKLHPSRLLLAGCFEDSLDRSYLESWIGFERSLGLVLPHTKVTGIFQPAEQGSMDDWTRKVWAELQASTEQTVLYQNLKRYVNHIEQTTIQPDNSKLKSGGTYLITGGVGGLGYLFAKHLAKNYAANLILTGRSPFNDEKQKQIKELKDLGGERMYAEADVSDPIAMGDCVKRGKDRFGAINGVIHAAGIESDSAIFDKKIESFQRIIEPKINGTIALDEWLKNEDLDFMCYFSSSSAVLGDFGCCDYAIGNRFQMAYAQYRNELHNGKTFVINWPVWKDGGMKIGDEETTDMYLKSSGQRFLEAEEGIRMFEHILAQQDAQHLVIAGQPSRVSRFLGMTEPAIPEPATQAPLAQENKDEVKTLSIEKRLEHDLKEHIHTLLKISKDRLNLNKNWADFGFDSIYLAKFSNVLSKHFNIEVTPALFFGYSTLQELISFFLTDHKELIEAFYRDDASEAQKPPEAYAVIPVALEPEASKKSIRQVHDEPIAIIGMSGRFPQADSVHELWDNLKNGKSCISDIPGERRDWGRANRDPEKAVPRWGAFLKDIDRFDPLFFQISPKEAESMDPRQPIFLEEAWHTFEDAGYMGDRIKGKSCGVYVGVEEGEYAHLTGDTDYINGTQNATLSARIAYALDLKGPNMALTAACSSGLVAIHQACSALRQGDCEMALAAGVTLNISHMSFEALTRAEMLSPNGQCKVFDQDANGLVPGEAVAAVLLKPLSKAIEDKDHIYGCIKASGVNYDGKTNGITAPNPFSQAELIENIYEKNEINPLDIQYVMAHSTGSNLGDPLEVQALTSVFSKYTKQKQFCMISSIKPLIGHTFAASGTVALISMLMAMKNQIIPATHHCESENPYIPFKESPFVLCKENRSWIKKNQKPRMGTISTTGISGTNAHAVIEEYIPDDQPSTQRHQGSPQIFVISAQNDDRLQDAACRMIAYLEQNHNLSLPDVAYTLQVGRKAMEARLAIVANNQEQLVRKLKEYVEAMKNGGVSGQQRSLYTGYTEGILEEQDEAVLQALAKERNLENIAECWVKGYQIPWELLHDGDDVRMVSLPGYPFARERYWISSGTQQSEAVKQHSQDMKTEIDEPNGKTHIQKIIVQFLARELGISEDRINFKRNFLDYGMDSILGRKLMRHIEKTTQLKMAGREILECQTVQALSDHLALKAEKQNHSAAAHHIKGTYTDEQIIGLMQEVALGKLDFKSVQNIIEGRNRMIIKKFSMPSDQEN

SEQ ID NO: 23145 - protein, 700 aa, Bacillus subtilis
MSQNQVPKWIQLNNEIMIQKDGKFQFDKDKEAVHSYFVDYINQNTVFFHNLKEKLDYLVENQYYEEEFLSLYSFEDIKEVFKTAYAKKFRFPSFMSAFKFYNDYALKTNDKKKILERYEDRISIVALFFANGDTEKAKEYVNLMINQEYQPSTPTFLNAGRKRRGELVSCFLLEVNDSLNDISRAIDISMQLSKLGGGVSLNLSKLRAKGEAIKDVENATKGVVGVMKLLDNAFRYADQMGQRQGSGAAYLNIFHRDINDFLDTKKISADEDVRVKTLSIGVVIPDKFVELAREDKAAYVFYPHTIYKEYGQHMDEMDMNEMYDKFVDNPRVKKEKINPRKLLEKLAMLRSESGYPYIMFQDNVNKVHANNHISKVKFSNLCSEVLQASQVSSYTDYDEEDEIGLDISCNLGSLNILNVMEHKSIEKTVKLATDSLTHVSETTDIRNAPAVRRANKAMKSIGLGAMNLHGYLAQNGIAYESPEARDFANTFFMMVNFYSIQRSAEIAKEKGETFDQYEGSTYATGEYFDKYVSTDFSPKYEKIANLFEGMHIPTTEDWKKLKAFVAEHGMYHSYRLCIAPTGSISYVQSSTASVMPIMERIEERTYGNSKTYYPMPGLASNNWFFYKEAYDMDMFKVVDMIATIQQHIDQGISFTLFLKDTMTTRDLNRIDLYAHHRGIKTIYYARTKDTGQDSCLSCVV

SEQ ID NO: 23146 - protein, 329 aa, Bacillus subtilis
MTKIYDAANWSKHEDDFTQMFYNQNVKQFWLPEEIALNGDLLTWKYLGKNEQDTYMKVLAGLTLLDTEQGNTGMPIVAEHVDGHQRKAVLNFMAMMENAVHAKSYSNIFMTLAPTETINEVFEWVKQNKYLQKKAQMIVGLYKAIQKDDEISLFKAMVASVYLESFLFYSGFYYPLYFYGQGKLMQSGEIINLILRDEAIHGVYVGLLAQEIYNKQTEEKKAELREFAIDLLNQLYENELEYTEDLYDQVGLSHDVKKFIRYNANKALMNLGFDPYFEEEDINPIVLNGLNTKTKSHDFFSMKGNGYKKATVEPLKDDDFYFEDEKEQI

SEQ ID NO: 23147 - protein, 499 aa, Bacillus subtilis
MKYVIGIDLGTSAVKTILVNQNGKVCAETSKRYPLIQEKAGYSEQNPEDWVQQTIEALAELVSISNVQAKDIDGISYSGQMHGLVLLDQDRQVLRNAILWNDTRTTPQCIRMTEKFGDHLLDITKNRVLEGFTLPKMLWVKEHEPELFKKTAVFLLPKDYVRFRMTGVIHTEYSDAAGTLLLHITRKEWSNDICNQIGISADICPPLVESHDCVGSLLPHVAAKTGLLEKTKVYAGGADNACGAIGAGILSSGKTLCSIGTSGVILSYEEEKERDFKGKVHFFNHGKKDSFYTMGVTLAAGYSLDWFKRTFAPNESFEQLLQGVEAIPIGANGLLYTPYLVGERTPHADSSIRGSLIGMDGAHNRKHFLRAIMEGITFSLHESIELFREAGKSVHTVVSIGGGAKNDTWLQMQADIFNTRVIKLENEQGPAMGAAMLAAFGSGWFESLEECAEQFIREAAAFYPKAQNVQKYKTLFDLYKNIYTHTKDLNTALKSFRKN

SEQ ID NO: 23148 - protein, 419 aa, Bacillus subtilis
MDMNEHRNRRLKLIMISATFGGLLFGYDTGVINGALPFMARPDQLDLTPVTEGLVTSILLLGAAFGALLCGRLADRDRRRKMILNLSFLFFLASLGTALAPNVFIMAVFRFLLGLAVGGASAMVPAFLAEMAPHEKRGRMVTQNELMIVGGQFLAYVFNAILGVTMANTGHVWRYMLVICAVPAIMLFASMLKVPESPRWLISKGKNSEALRVLKQIREDKRAEAECREIQEAVEKDTALEKASLKDFSTPWLRRLLWIGIGVAIVNQITGVNSIMYYGTQILKESGFGTKAALIANIGNGLISVIAVIFGIWLVGKVRRRPILLIGLAGTTTALLLIAIFSIVLDGSMALPYVVLSLTVLFLAFMQGCVGPVTWLVIAEIFPQRLRGLGSGISVFFLWILNFVIGFAFPILLSSVGLS

SEQ ID NO: 23149 - protein, 667 aa, Bacillus subtilis
MDTIEKKSVATIRTLSIDAIEKANSGHPGMPMGAAPMAYTLWTKFMNVSPANPGWFNRDRFVLSAGHGSALLYSMLHLSGFDLSIEDLKGFRQWGSKTPGHPEFGHTAGVDATTGPLGQGIAMAVGMAIAERHLAETYNRDSFNVVDHYTYSICGDGDLMEGISSEAASLAGHLQLGRLIVLYDSNDISLDGDLDRSFSENVKQRFEAMNWEVLYVEDGNNIEELTAAIEKARQNEKKPTLIEVKTTIGFGSPNRAGTSGVHGAPLGKEESKLTKEAYAWTYEEDFYVPSEVYEHFAVAVKESGEKKEQEWNAQFAKYKEVYPELAEQLELAIKGELPKDWDQEVPVYEKGSSLASRASSGEVLNGLAKKIPFFVGGSADLAGSNKTTIKNAGDFTAVDYSGKNFWFGVREFAMGAALNGMALHGGLRVFGGTFFVFSDYLRPAIRLAALMGLPVTYVFTHDSIAVGEDGPTHEPVEQLASLRAMPNLSLIRPADGNETAAAWKLAVQSTDHPTALVLTRQNLPTIDQTSEEALAGVEKGAYVVSKSKNETPDALLIASGSEVGLAIEAQAELAKENIDVSVVSMPSMDRFEKQSDEYKNEVLPADVKKRLAIEMGSSFGWGKYTGLEGDVLGIDRFGASAPGETIINEYGFSVPNVVNRVKALINK

SEQ ID NO: 23150 - protein, 909 aa, Bacillus subtilis
MANEQKTAAKDVFQARKTFTTNGKTYHYYSLKALEDSGIGKVSKLPYSIKVLLESVLRQVDGFVIKKEHVENLAKWGTAELKDIDVPFKPSRVILQDFTGVPAVVDLASLRKAMAAVGGDPDKINPEIPVDLVIDHSVQVDKAGTEDALAVNMDLEFERNAERYKFLSWAKKAFNNYQAVPPATGIVHQVNLEFLASVVHAIEEDGELVTYPDTLVGTDSHTTMINGIGVLGWGVGGIEAEAGMLGQPSYFPVPEVIGAKLVGKLPNGTTATDLALKVTQVLREKGVVGKFVEFFGPGIAELPLADRATIANMAPEYGATCGFFPVDEEALNYLRLTGRDPEHIDVVEAYCRSNGLFYTPDAEDPQFTDVVEIDLSQIEANLSGPKRPQDLIPLSAMQETFKKQLVSPAGNQGFGLNAEEENKEIKFKLLNGEETVMKTGAIAIAAITSCTNTSNPYVLIGAGLVAKKAVELGLKVPNYVKTSLAPGSKVVTGYLVNSGLLPYMKELGFNLVGYGCTTCIGNSGPLSPEIEEAVAKNDLLITSVLSGNRNFEGRIHPLVKGNYLASPPLVVAYALAGTVNINLKTDPIGVGKDGQNVYFNDIWPSMDEINALVKQTVTPELFRKEYETVFDDNKRWNEIETTDEALYKWDNDSTYIQNPPFFEEMSVEPGKVEPLKGLRVVGKFGDSVTTDHISPAGAIGKDTPAGKYLQEKGVSPRDFNSYGSRRGNHEVMMRGTFANIRIKNQIAPGTEGGFTTYWPTGEVTSIYDACMKYKEDKTGLVVLAGKDYGMGSSRDWAAKGTNLLGIRTVIAESFERIHRSNLVFMGVLPLQFKQGENADTLGLTGKEVIEVDVDETVRPRDLVTVRAINEDGNVTTFEAVVRFDSEVEIDYYRHGGILQMVLREKMKQS

SEQ ID NO: 23151 - protein, 508 aa, Bacillus subtilis
MMRRRKRSDMKRSISIFITCLLITLLTMGGMIASPASAAGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYKAKNKGQNFDCDYAQIGCGNVTHKFVTLHKPKQGADTYLELGFKNGTLAPGASTGNIQLRLHNDDWSNYAQSGDYSFFKSNTFKTTKKITLYDQGKLIWGTEPN

SEQ ID NO: 23152 - protein, 297 aa, Bacillus subtilis
MRKKVRKAVIPAAGLGTRFLPATKAQPKEMLPIVDKPAIQYIVEEAAESGIEDILIITGRNKRSIEDHFDRSAELEFNLREKGKTETLKEMQQIADLANIHYIRQKEPLGLGHAVLCAEHFIGDEPFAVLLGDDIMVSETPALRQLMDVYDVYGTEVVGVQSVLPEDVSKYGIINTSGSQGHVYEVNDLVEKPSPEEAPSEIAVMGRYVLNSSIFSVLKTIGRGAGNEIQLTDALREVCRKEPIHARLLEGNRYDIGDKLGCFKASTEIGLMRPEMRSQLLAYLEDVIKRETKEMLR

SEQ ID NO: 23153 - protein, 299 aa, Bacillus subtilis
MPYPKKVTIKEVGPRDGLQNEPVWIATEDKITWINQLSRTGLSYIEITSFVHPKWIPALRDAIDVAKGIDREKGVTYAALVPNQRGLENALEGGINEACVFMSASETHNRKNINKSTSESLHILKQVNNDAQKANLTTRAYLSTVFGCPYEKDVPIEQVIRLSEALFEFGISELSLGDTIGAANPAQVETVLEALLARFPANQIALHFHDTRGTALANMVTALQMGITVFDGSAGGLGGCPYAPGSSGNAATEDIVYMLEQMDIKTNVKLEKLLSAAKWIEEKMGKPLPSRNLQVFKSS

SEQ ID NO: 23154 - protein, 444 aa, Bacillus subtilis
MFTKVLIANRGEIAMRIIRTCSRLGIKTVAVYSEADKDAPHTKAATEAYLIGESRVSESYLNIERIIKTAKKAKADAIHPGYGLLSENSRFAERCKQENIVFIGPSPDIIAKMGSKIEARKAMEAAGVPVVPGVSESLGDIEAACRTASQIGYPVMLKASAGGGGIGMQRVENEEALKKAYEGNKKRAADFFGDGSMYIEKVIEHARHIEVQLLADQHGHTVHLFERDCSVQRRHQKVIEEAPSPFVDDELRMKIGQTAVKAAKAIGYTNAGTIEFIVDQKQNFYFLEMNTRLQVEHPVTEEITGLDLVEQQLRIAAGHTLTFSQKDIQRNGHAIEVRIYAEDPKTFFPSPGTITAFSLPDQKGVRHECAVAKDSTVTPFYDPMIAKMIVKGQTRTEAIEKLETALRDYRVEGIKTNLPLLIQAAATKAFKEGDVTTDFLKQHL

SEQ ID NO: 23155 - protein, 549 aa, Bacillus subtilis
MAELIHSTIGRLLEQTADAYPDRDAVVYPDRNIRYTYAQFDSLCRQTAKGLMRMGIGKGDHVAIWASNISEWLAVQFATAKIGAVLVTVNTNYQAHELDYLLKQSDAAALIIMDSYRGTSYPDIVNSLIPELQEAKPGQLKSERYPFLKTLIYIGNKRLSGMYHWDDTEILAKTVTDAELEERMNSLDKDNVINMQYTSGTTGFPKGVMLTHFNVINNAANIAECMALTSQDRMCIPVPFFHCFGCVLGVLACVSVGAAMIPVQEFDPVTVLKTVEKEKCTVLHGVPTMFIAELHHPDFDAYDLSTLRTGIMAGSPCPSEVMKAVIERMGMKDITIAYGQTEASPVITQTRANDSFIRRVETTGRALPHTEVKIVEPGTCQEVQRGMQGELCTRGYHVMKGYYKDKDATRKAINHDGWLFTGDLAVMDEDGYCRITGRLKDMLIRGGENIYPREIEEFLYQHPAVLDVQVVGVPDAKFGEEAAAWIKLKDGKSVSPDELKAYCKGKIARHKIPRYVIFTDDYPMTASGKIQKYKLREKTIEMFNLSSSQ

SEQ ID NO: 23156 - protein, 380 aa, Bacillus subtilis
MNFELTKEQQMVREMVKDFAKKEIAPHAEHVDQTGEFPMQTFKKMGELGLMGIPFPEEYGGSGGDTISYALAVEEVGKACGSTGLSYAAAVSLGASPLYYFGTEEQKQTHLTPLASGTALGSFGLTEPNAGSDAGGTQTKAISNGDEYVINGEKCWITNASYARTVIVTAVTGKNKDGKNIISALIVPTDTPGLTITSPYDKMGVRGSNTAEILLEDVRVPAANLLGDPTKGFKQFLYTLDGGRISIAALAVGIAQAALDASLAYAKERKQFGQPISSFQAIQFKLADMAMEIDLARQMVLKAAWLKDHNRPFTKEAAYAKLFASEMATRACNQAIQIHGGSGYMKEYGVERMLRDAKLMEIGEGTSEIQRLVIARQLLK

SEQ ID NO: 23157 - protein, 270 aa, Bacillus subtilis
MRTKKRTKEMLPIFDQKKVAFIGAGSMAEGMISGIVRANKIPKQNICVTNRSNTERLTELELQYGIKGALPNQLCIEDMDVLILAMKPKDAENALSSLKSRIQPHQLILSVLAGITTSFIEQSLLNEQPVVRVMPNTSSMIGASATAIALGKYVSEDLKKLAEALLGCMGEVYTIQENQMDIFTGIAGSGPAYFYYLMEFIEKTGEEAGLDKQLSRSIGAQTLLGAAKMLMETGEHPEILRDNITSPNGTTAAGLQALKKSGGEKRFLKQ

SEQ ID NO: 23158 - protein, 487 aa, Bacillus subtilis
MKKQKGYLVFDIGTGNARVAVVSVTGSVLTVEREDIEYSTETLYPDSRYFSPQVLWKQVMNLAKRALSRSCDIDIIGLTSTSQRQGIVLIDQNGNPFLGLPNIDNRGREWEAGIPDWEEIYSSTGRLPTALFSALKLYGLKQRQPSLWEKTASFTSISDWVTYQLSGILTYEPSQATETLLFDVKQNTWSEEMCDIFGFSPSILPPLVRAGTAIGTIANEYASELGLSINAKVIAGGGDTQLAVKSTGAGLEDIVIVSGTTTPITKITEDHGDTKHKAWLNCHTDQGHWLVETNPGITGLNYQKLKQIFYPNETYEVMEEEISALAKEDHACVAALGSYLSAEKNALTRGGFLFDAPLSAHLKRAHFVRAALEEIAFSIKWNFDILTEVTPFERDYVWVCGGGFQSKALTQYIADLLQKKVYVQEGYHQASVVGAAVICNETFQLTEEMSANVRVIEPKDCQIELALYEEWKQTQRFFSGSESKVLI

SEQ ID NO: 23159 - protein, 677 aa, Bacillus subtilis
MRSFATQQNGIFKSVCSLDCPDQCGLLIHKKDGKIVKVQGDPDHPVTAGNICNKVRNMTERIYDEKRLTTPLKRTGAKGQAIFEPISWKEAIDTITSRWKQLIDEEGAESILPYSFYGNMGKLTAEGMDRRFFYRMGSSQLERTICSKAGSEGYKYTMGISAGIDPEETVHTKLFIFWGINAVSTNMHQITIAQKARKKGAKIVVIDVHKNQTGRLADWFIPIKPGTDSALALGIMHILFKENLHDEAFLSEYTVGYEELREHVKQYDPEKVSTITGVSTEDIYRLAKMYGETSPSFIRIGNGPQHHDNGGMIVRTIACLPAITGQWLHTGGGAIKHNSGILEYNTNALQRPDLLKGRTPRSFNMNQLGRVLLETDPPIRSLFIYGTNPAVVAPEANKVRQGLLREDLFTVVHDLFLTETAAYADIVLPATSAFENTDFYTSYWHHYIQLQQPVIERYGESKSNTEVFRLLAEAMGFTDQELKDSDEVLIRQALDHPDNPHLAEIDYDSLTKHSFMKAKREKPLFPGELPTPSGKIELYSEKMKQDGFPALPTYTPLVTDNEHPFMYVPGPNHNFLNSTFSNNEKHIKLEKTPKLFINTKDAEKHGIVDGAPVRIWNSRGECELTAAVGEQVLPGVVVSQGLWADEQGKKTACKRANPRSLVRYGRRRHLFFRPCTD

SEQ ID NO: 23160 - protein, 446 aa, Bacillus subtilis
MSGLVSASLLKNAGHRVTILEASGRAGGRVCTLRSPFSDDLYFNAGPMRIPNNHSLTLEYIKKFKLPTNVFINRTPMDIIYANGIKTRLQVFERAPGILRYPVAPNEQGKTSEELMLSLLQPILNFINQNPARNWRIVEEQYKNHSLSSFLNTYFSYGAIDMIGVLLDMEAYMGMSLVEVLRESIFFSSPAHFYEITGGMDLLPHAFLPQLKTNILYHQKMMKMSQGENRVTIHCQHQQTAEFTSFTADLAIVTIPFSTLRFVKVEPYHSFSYYKRRAIRELNYISATKIGIEFKSRFWEKAGQHGGKSITDLPIRFSYYPSRNIGANGHAVILASYTWADEALIWDSLSEGERIQYTLLNLSEIYGDIVWSEFVSGTSFSWSQYPYSAGGFTAFEPGQELELYPYIPVPEGRVHFAGEHASLTHAWMQGAIESGIRVAYEVNRLP

SEQ ID NO: 23161 - protein, 352 aa, Bacillus subtilis
MTEQTIAHKQKQLTKQVAAFAQPETKNSLIQLLNTFIPFFGLWFLAYLSLDVSYLLTLALTVIAAGFLTRIFIIFHDCCHQSFFKQKRYNHILGFLTGVLTLFPYLQWQHSHSIHHATSSNLDKRGTGDIWMLTVNEYKAASRRTKLAYRLYRNPFIMFILGPIYVFLITNRFNKKGARRKERVNTYLTNLAIVALAAACCLIFGWQSFLLVQGPIFLISGSIGVWLFYVQHTFEDSYFEADENWSYVQAAVEGSSFYKLPKLLQWLTGNIGYHHVHHLSPKVPNYKLEVAHEHHEPLKNVPTITLKTSLQSLAFRLWDEDNKQFVSFRAIKHIPVSLPPDSPEKQKLRKNA

SEQ ID NO: 23162 - protein, 495 aa, Bacillus subtilis
MSSLTMQVTKRLETFLQGTKKLYIDGKFVPSASGATFDTPNPATGETLMTLYEAQAADVDKAVKAARKAFDQGEWRTMSPASRSRLMYKLADLMEEHKTELAQLETLDNGKPINETTNGDIPLAIEHMRYYAGWCTKITGQTIPVSGAYFNYTRHEPVGVVGQIIPWNFPLLMAMWKMGAALATGCTIVLKPAEQTPLSALYLAELIDQAGFPAGVINIIPGFGEDAGEALTNHEAVDKIAFTGSTEIGKKIMSTAAKSIKRVTLELGGKSPNILLPDANLKKAIPGALNGVMFNQGQVCCAGSRVFIHKDQYDEVVDEMASYAESLRQGAGLHKDTQIGPLVSKEQHERVLSYIQKGKDEGAKAVTGGSCPFEAGYFVAPTVFANVEDEMTIAKEEIFGPVLTAIPYETVDEVIERANHSEYGLAAGLWTENVKQAHYIADRLQAGTVWVNCYNVFDAASPFGGYKQSGLGREMGSYALDNYTEVKSVWVNLED

SEQ ID NO: 23163 - protein, 556 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGLTESIPVYKRLCVGSNPYKMMTEAGENPAKAPKSKHMYRFIEEPLYKRPGL

SEQ ID NO: 23164 - protein, 417 aa, Bacillus subtilis
MAEIKVPELAESISEGTIAQWLKQPGDYVEQGEYLLELETDKVNVELTAEESGVLQEVLKDSGDTVQVGEIIGTISEGAGESSAPAPTEKTESKESVKEEKQAEPAAQEVSEEAQSEAKSRTIASPSARKLAREKGIDLSQVPTGDPLGRVRKQDVEAYEKPASKPAPQQKQQPQAQKAQQSFDKPVEVQKMSRRRQTIAKRLVEVQQTSAMLTTFNEVDMTAVMNLRKRRKDQFFEQNEVKLGFMSFFTKAVVAALKKYPLLNAEIQGDELIVKKFYDIGIAVAAVEGLVVPVVRDADRLTFAGIEKEIGELAKKARNNKLTLSELEGGSFTITNGGTFGSLMSTPILNSPQVGILGMHKIQLRPVAIDEERFENRPMMYIALSYDHRIVDGKEAVGFLVTIKNLLEDPEQLLLEG

SEQ ID NO: 23165 - protein, 937 aa, Bacillus subtilis
MFQNSMKQRMNWEDFYGPNLGYALELYDQYTQDPYSIDPDLKEMFDELGAPPSDIKEASGTKEKGRVTADLIQKIASAVRLAEDIRTYGHLNASVNPLRKDEKKSELFPLSDYGLTEEEIKAIPASVICKDAPKNISNGLEAIQYLRNTYKRTISFEFDHVHDFKEREWLTRKIESGELFQKNSAEKLSAVLERLTEVEGFEQFLHRTFVGQKRFSIEGLDALVPVLDDIIAQSVKSGTTSVNIGMAHRGRLNVLAHVLGKPYEIIFSEFQHAPRSLVPSEDPLESATDGRGMSNTIWGRIGSFKTLKQNQPALPLANNPSHLEFINPIVEGSTRAAQETRTQSGYPVQDETKSLAILIHGDAAFPGEGIVAETLNLSSLKGYQVGGAIHIIANNMIGFTTESAESRSTKYASDLAKGYEIPIVHVNADDPEACLSAVKFAVEYRKTFNKDFLIDLIGYRRYGHNEMDEPSTTQPMLYDAVRKHPTSNKFSLKKLVKEGVVTEEVVQNIEKSVTKRIEVAIQKVPSKKEHTACEIELPEPVSNGFPDVDTSIHFHVLRKLNGELITGESFMFSQAKAHFRKTAKAFDDDRKVEWSLAESLAFASILKDGTPIRLTGQDSERGTFAQRNLVLHDSETGKEFVPLHHLSDCSTSFAVHNSPLSEGSVLGFEYGYNVHSPETLVLWEAQYGDFANAAQVYFDQFISAGRAKWGQKSGLVMLLPHGYEGQGPEHSSGRIERFLQLAAENNWTVANLTSAAQYFHILRRQAKMLLREEIRPLVIMTPKSLLRNPNTVSEVQELSESRFQPVYEQSGLSHDYEKVTRLVLSSGKVSIDISVHFNKLEDGKEWLHIARIEQLYPFPAKGVKELFAKLPNLKEIVWVQEEPQNMGAWGYISPYLTEIAPEGVSVQYIGRRRRSSPAEGDPTEFIKKNRNVLYLIA

SEQ ID NO: 23166 - protein, 444 aa, Bacillus subtilis
MSSYLIKPELSSAYPVVSYAKGSYVYDQTGKKYLDGSSGAVTCNIGHGVRDVTEKLKEQLDQVSFAYRSQFTSEPAEQLAALLAQELPGDVNWSFFVNSGSEAIETAMKIAIQYWQEKKQTQKSIFLSRWSSYHGITLGALSLSGFYERRYRFTHLIERYPAISAPHIYRLNHETEEDFVQTAADELDTMIKRIGSQFIAGFVAEPIIGAAGAAITPPPGYYERLSEVCRTHDVLFIADEVMTGLGRTGRMLATEHWDTVPDIAVLGKGLGAGYAPIAAAVVSDSIIETIKQGSGVIMSGHTYSAHPYSAKAALEVLRYVLKHGLIKQSEKKGAVLKKKLDEAASQSGIIGEVRGKGLLLGIEFVADQKTKKVFPPEQAITQLIVSEAKKRGLIVYPSKAGIDSGEGDAVIIAPPFTISDGEMEELISIFSETVAAVEKNLKKD

SEQ ID NO: 23167 - protein, 365 aa, Bacillus subtilis
MAFILSIGTSLPAYNVNQEKAAEFARYMFQHSFKDIDRLLSSFKNGQIHSRQFVKPIEWYKEGHSFEEKNQIYIEETLKHSRAAVRECLSHPEFFQEAIPYEKVEAVFFVSSTGLSTPSIEARLMNELPFSPYTKRIPIWGLGCAGGASGLARAAEYCKAYPEAFVLVISAELCSLTFQPEDKTKSNLIGTSLFGDGIAAALLCGEKADRRVSKLKLAPKIMDAQSVLMKQSEDVMGWDFTDQGFKVIFSRDIPTLVEKWLKTNVQIFLDKHKLSFHDISVFLAHPGGKKVIDAYIKSLGLSSEKLSSAQSILQKHGNMSSATILYVIKDHLQNGHKKEAERGLIGALGPGFSSELLLFSWEKGA

SEQ ID NO: 23168 - protein, 194 aa, Bacillus subtilis
MEALKRKIEEEGVVLSDQVLKVDSFLNHQIDPLLMQRIGDEFASRFAKDGITKIVTIESSGIAPAVMTGLKLGVPVVFARKHKSLTLTDNLLTASVYSFTKQTESQIAVSGTHLSDQDHVLIIDDFLANGQAAHGLVSIVKQAGASIAGIGIVIEKSFQPGRDELVKLGYRVESLARIQSLEEGKVSFVQEVHS

SEQ ID NO: 23169 - protein, 324 aa, Bacillus subtilis
MKLDAVTFGESMAMFYANEYGGLHEVSTFSKGLAGAESNVACGLARLGFRMGWMSKVGNDQLGTFILQELKKEGVDVSRVIRSQDENPTGLLLKSKVKEGDPQVTYYRKNSAASTLTTAEYPRDYFQCAGHLHVTGIPPALSAEMKDFTYHVMNDMRNAGKTISFDPNVRPSLWPDQATMVHTINDLAGLADWFFPGIAEGELLTGEKTPEGIADYYLKKGASFVAIKLGKEGAYFKTGTSEGFLEGCRVDRVVDTVGAGDGFAVGVISGILDGLSYKDAVQRGNAIGALQVQAPGDMDGLPTREKLASFLSAQRTVHQKKGDY

SEQ ID NO: 23170 - protein, 254 aa, Bacillus subtilis
MGYLHDAFSLKGKTALVTGPGTGIGQGIAKALAGAGADIIGTSHTSSLSETQQLVEQEGRIFTSFTLDMSKPEAIKDSAAELFENRQIDILVNNAGIIHREKAEDFPEENWQHVLNVNLNSLFILTQLAGRHMLKRGHGKIINIASLLSFQGGILVPAYTASKHAVAGLTKSFANEWAASGIQVNAIAPGYISTANTKPIRDDEKRNEDILKRIPAGRWGQADDIGGTAVFLASRASDYVNGHILAVDGGWLSR

SEQ ID NO: 23171 - protein, 393 aa, Bacillus subtilis
MKLAKRVSALTPSTTLAITAKAKELKAAGHDVIGLGAGEPDFNTPQHIIDAAVRSMNEGHTKYTPSGGLAELKNSIAEKFKRDQNIEYKPSQIIVCTGAKHALYTLFQVILDEEDEVIIPTPYWVSYPEQVKLAGGKPVYVEGLEENHFKISPEQLKNAITEKTKAIVINSPSNPTGVMYTEEELSALGEVCLEHDILIVSDEIYEKLTYGGKKHVSIAQLSDRLKEQTVIINGVSKSHSMTGWRIGYAAGSEDIIKAMTNLASHSTSNPTSIAQYGAIAAYNGPSEPLEEMREAFEHRLNTIYAKLIEIPGFSCVKPEGAFYLFPNAKEAAQSCGFKDVDEFVKALLEEEKVAIVPGSGFGSPENVRLSYATSLDLLEEAIERIKRFVEKHS

SEQ ID NO: 23172 - protein, 377 aa, Bacillus subtilis
MRKLKIGITCYPSVGGSGIIATELGKQLAEKGHEIHFITSSIPFRLNTYHPNIHFHEVEVNQYAVFKYPPYDLTLASKIAEVAERENLDIIHAHYALPHAVCAYLAKQMLKRNIGIVTTLHGTDITVLGYDPSLKDLIRFAIESSDRVTAVSSALAAETYDLIKPEKKIETIYNFIDERVYLKKNTAAIKEKHGILPDEKVVIHVSNFRKVKRVQDVIRVFRNIAGKTKAKLLLVGDGPEKSTACELIRKYGLEDQVLMLGNQDRVEDLYSISDLKLLLSEKESFGLVLLEAMACGVPCIGTNIGGIPEVIKNNVSGFLVDVGDVTAATARAMSILEDEQLSNRFTKAAIEMLENEFSSKKIVSQYEQIYADLAEPE

SEQ ID NO: 23173 - protein, 267 aa, Bacillus subtilis
MSNETIKLVIAGPRGRMGQEAVKLAERTPHFDLVGAIDHTYDQQKLSDVMPVESDAFIYTDIHACFTETQPDVLIDLTTPEIGKVHTKIALEHGVRPVVGTTGFSEADLKELTSLTEEKGIGAIIAPNFALGAILMMKFSKMAANYFEDVEIIELHHDQKLDAPSGTALKTAEMISEVRKEKQQGHPDEKEILPGARGAEQNGIRLHSVRLPGLIAHQEVMFGMDGQTLQIRHDSYNRASFMSGVKLSVEQVMKIDQLVYGLENIID

SEQ ID NO: 23174 - protein, 428 aa, Bacillus subtilis
MKRDKVQTLHGEIHIPGDKSISHRSVMFGALAAGTTTVKNFLPGADCLSTIDCFRKMGVHIEQSSSDVVIHGKGIDALKEPESLLDVGNSGTTIRLMLGILAGRPFYSAVAGDESIAKRPMKRVTEPLKKMGAKIDGRAGGEFTPLSVSGASLKGIDYVSPVASAQIKSAVLLAGLQAEGTTTVTEPHKSRDHTERMLSAFGVKLSEDQTSVSIAGGQKLTAADIFVPGDISSAAFFLAAGAMVPNSRIVLKNVGLNPTRTGIIDVLQNMGAKLEIKPSADSGAEPYGDLIIETSSLKAVEIGGDIIPRLIDEIPIIALLATQAEGTTVIKDAAELKVKETNRIDTVVSELRKLGAEIEPTADGMKVYGKQTLKGGAAVSSHGDHRIGMMLGIASCITEEPIEIEHTDAIHVSYPTFFEHLNKLSKKS

SEQ ID NO: 23175 - protein, 360 aa, Bacillus subtilis
MRIKEHLKQLKPYQPGKPIEAVKSEYGLDKVVKLASNENPYGCSEAAKEALHHEIQQLALYPDGYSAALRTRLSKHLNVSETSLIFGNGSDEIIQIICRAFLNDKTNTVTAAPTFPQYKHNAVIEGAEVREIALRPDGSHDLDAMLEAIDEQTQVVWICSPNNPTGTYTSEGELLAFLERVPSRVLVVLDEAYYEYVTAEDYPETVPLLSKYSNLMILRTFSKAYGLAALRVGYGIADENLIRQIEPAREPFNTSRLGQAAAIAALYDQAFIASCVEQNNAGLQQYYDFAKTHGLKCYPSQTNFVLIDFKRPADELFQALLEKGYIVRSGNALGFPTSLRITIGTKEQNEEILAILAEIL

SEQ ID NO: 23176 - protein, 215 aa, Bacillus subtilis
MKKPALKYCGIRSLQDLQLAADSQADYLGFIFAESYRKVSPQDVKKWLSQVCVEKQVAGVFVNESIETMSRIAEDLNLDVIQLHGDEEPADADALRMLTDCEIWKALHHHENTTQEIARFKDDVDGFVIDSSVKGARGGTGVAFSWDCVPEYQQAAIGKRCFIAGGVNPDTITDLMKYQPAGIDLASGIEKNGQKDQNLMRLLEERMNRYVSISE

SEQ ID NO: 23177 - protein, 362 aa, Bacillus subtilis
MKTLHVQTASSSYPVFIGQGIRKKACELLTSLNRPLTRIMFVTDEEVDRLYGDEMLHLLQEKWPVKKVTVPSGEQAKSMDMYTKLQSEAIRFHMDRSSCIIAFGGGVVGDLAGFVAATFMRGIDFIQMPTTLLAHDSAVGGKVAVNHPLGKNLIGAFYQPKAVLYDTDFLRSLPEKELRSGMAEVIKHAFIYDRAFLEELLNIHSLRDITNDQLNDMIFKGISIKASVVQQDEKEEGIRAYLNFGHTLGHAVEAEYGYGQITHGDAVALGMQFALYISEKTVGCEMDRKRLVSWLKSLGYPSQIRKETETSVLLNRMMNDKKTRGGKIQFIVLNELGKVADHTFSRNELESWLNKWRLEETS

SEQ ID NO: 23178 - protein, 368 aa, Bacillus subtilis
MRYLTAGESHGPQLTTIIEGVPAGLYITEEDINFELARRQKGHGRGRRMQIEKDQAKIMSGVRHARTLGSPIALVVENNDWKHWTKIMGAAPITEDEEKEMKRQISRPRPGHADLNGAIKYNHRDMRNVLERSSARETTVRVAAGAVAKKILSELGIKVAGHVLQIGAVKAEKTGYTSIEDLQRVTEESPVRCYDEEAGKKMMAAIDEAKANGDSIGGIVEVIVEGMPVGVGSYVHYDRKLDSKLAAAVLSINAFKGVEFGIGFEAAGRNGSEVHDEIIWDEEKGYTRATNRLGGLEGGMTTGMPIVVRGVMKPIPTLYKPLKSVDIETKEPFSASIERSDSCAVPAASVVAEALSLGKLQPSLNNSD

SEQ ID NO: 23179 - protein, 149 aa, Bacillus subtilis
MMEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 23180 - protein, 348 aa, Bacillus subtilis
MLNIIRLLAESLPRISDGNENTDVWVNDMKFKMAYSFLNDDIDVIERELEQTVRSDYPLLSEAGLHLLQAGGKRIRPVFVLLSGMFGDYDINKIKYVAVTLEMIHMASLVHDDVIDDAELRRGKPTIKAKWDNRIAMYTGDYMLAGSLEMMTRINEPKAHRILSQTIVEVCLGEIEQIKDKYNMEQNLRTYLRRIKRKTALLIAVSCQLGAIASGADEKIHKALYWFGYYVGMSYQIIDDILDFTSTEEELGKPVGGDLLQGNVTLPVLYALKNPALKNQLKLINSETTQEQLEPIIEEIKKTDAIEASMAVSEMYLQKAFQKLNTLPRGRARSSLAAIAKYIGKRKF

SEQ ID NO: 23181 - protein, 190 aa, Bacillus subtilis
MKEVNKEQIEQAVRQILEAIGEDPNREGLLDTPKRVAKMYAEVFSGLNEDPKEHFQTIFGENHEELVLVKDIAFHSMCEHHLVPFYGKAHVAYIPRGGKVTGLSKLARAVEAVAKRPQLQERITSTIAESIVETLDPHGVMVVVEAEHMCMTMRGVRKPGAKTVTSAVRGVFKDDAAARAEVLEHIKRQD

SEQ ID NO: 23182 - protein, 345 aa, Bacillus subtilis
MKKVTMLGAGSWGTALALVLTDNGNEVCVWAHRADLIHQINELHENKDYLPNVKLSTSIKGTTDMKEAVSDADVIIVAVPTKAIREVLRQAVPFITKKAVFVHVSKGIEPDSLLRISEIMEIELPSDVRKDIVVLSGPSHAEEVGLRHPTTVTASSKSMRAAEEVQDLFINHNFRVYTNPDIIGVEIGGALKNIIALAAGITDGLGYGDNAKAALITRGLAEIARLGTKMGGNPLTFSGLTGVGDLIVTCTSVHSRNWRAGNLLGKGYKLEDVLEEMGMVVEGVRTTKAAYQLSKKYDVKMPITEALHQVLFNGQKVETAVESLMARGKTHEMEDLVNTFENQVK

SEQ ID NO: 23183 - protein, 426 aa, Bacillus subtilis
MAADRNTGHTEEDKLDVLKSTQTVIHKALEKLGYPEEVYELLKEPMRLLTVKIPVRMDDGSVKIFTGYRAHNDSVGPTKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNRRIDMRLAAYMVGVRKMAEASRFRGWI

SEQ ID NO: 23184 - protein, 255 aa, Bacillus subtilis
MNVLTIKGVSIGEGMPKIIIPLMGKTEKQILNEAEAVKLLNPDIVEWRVDVFEKANDREAVTKLISKLRKSLEDKLFLFTFRTHKEGGSMEMDESSYLALLESAIQTKDIDLIDIELFSGDANVKALVSLAEENNVYVVMSNHDFEKTPVKDEIISRLRKMQDLGAHIPKMAVMPNDTGDLLTLLDATYTMKTIYADRPIITMSMAATGLISRLSGEVFGSACTFGAGEEASAPGQIPVSELRSVLDILHKNTRG

SEQ ID NO: 23185 - protein, 439 aa, Bacillus subtilis
MFLHGTSRQNQHGHLEIGGVDALYLAEKYGTPLYVYDVALIRERAKSFKQAFISAGLKAQVAYASKAFSSVAMIQLAEEEGLSLDVVSGGELYTAVAAGFPAERIHFHGNNKSREELRMALEHRIGCIVVDNFYEIALLEDLCKETGHSIDVLLRITPGVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVPGVRQYVAVDGGMNDNIRPALYQAKYEAAAANRIGEAHDKTVSIAGKCCESGDMLIWDIDLPEVKEGDLLAVFCTGAYGYSMANNYNRIPRPAVVFVENGEAHLVVKRETYEDIVKLDLPFKTGVKQ

SEQ ID NO: 23186 - protein, 475 aa, Bacillus subtilis
MLNGQKEYRVEKDFLGEKQIEADVYYGIQTLRASENFPITGYKIHEEMINALAIVKKAAALANMDVKRLYEGIGQAIVQAADEILEGKWHDQFIVDPIQGGAGTSMNMNANEVIGNRALEIMGHKKGDYIHLSPNTHVNMSQSQNDVFPTAIHISTLKLLEKLLKTMEDMHSVFKQKAQEFHSVIKMGRTHLQDAVPIRLGQEFEAYSRVLERDIKRIKQSRQHLYEVNMGATAVGTGLNADPEYIKQVVKHLADISGLPLVGADHLVDATQNTDAYTEVSASLKVCMMNMSKIANDLRLMASGPRAGLAEISLPARQPGSSIMPGKVNPVMAELINQIAFQVIGNDNTICLASEAGQLELNVMEPVLVFNLLQSISIMNNGFRSFTDNCLKGIEANEKRMKQYVEKSAGVITAVNPHLGYEAAARIAREAIMTGQSVRDLCLQHDVLTEEELDIILNPYEMTKPGIAGKELLEK

SEQ ID NO: 23187 - protein, 306 aa, Bacillus subtilis
MRKRKLGTSDLDISEVGLGCMSLGTEKNKALSILDEAIELGINYLDTADLYDRGRNEEIVGDAIQNRRHDIILATKAGNRWDDGSEGWYWDPSKAYIKEAVKKSLTRLKTDYIDLYQLHGGTIEDNIDETIEAFEELKQEGVIRYYGISSIRPNVIKEYVKKSNIVSIMMQFSLFDRRPEEWLPLLEEHQISVVARGPVAKGLLTEKPLDQASESMKQNGYLSYSFEELTNARKAMEEVAPDLSMTEKSLQYLLAQPAVASVITGASKIEQLRENIQAANARRLTEEEIKALQSHTKQDIYKAHRS

SEQ ID NO: 23188 - protein, 278 aa, Bacillus subtilis
MKKIGFVGAGSMAEAMINGILQSGITKPEHIYITNRSNDERLIELKETYSVRPCRDKNEFFTHTDIIILAFKPKDAAESIDSIRPYIKDQLVISVLAGLTIETIQHYFGRKLAVIRVMPNTSAAIRKSATGFSVSTEASKNDIIAAKALLETIGDATLVEERHLDAVTAIAGSGPAYVYRYIEAMEKAAQKVGLDKETAKALILQTMAGATDMLLQSGKQPEKLRKEITSPGGTTEAGLRALQDSRFEEAIIHCIEETAKRSAEIKEQFAGAALERHS

SEQ ID NO: 23189 - protein, 489 aa, Bacillus subtilis
MKTNQQPKAVIVIFGATGDLAKRKLYPSIHRLYQNGQIGEEFAVVGVGRRPWSNEDLRQTVKTSISSSADKHIDDFTSHFYYHPFDVTNPGSYQELNVLLNQLEDTYQIPNNRMFYLAMAPEFFGTIAKTLKSEGVTATTGWSRLVIEKPFGHDLPSAQALNKEIREAFTEDQIYRIDHYLGKQMVQNIEVIRFANAIFEPLWTNRYISNIQITSSESLGVEDRARYYEKSGALRDMVQNHIMQMVALLAMEPPIKLNTEEIRSEKVKVLRALRPIAKDEVDEYFVRGQYHAGEIDGVPVPAYTDEDNVAPDSNTETFVAGKLLIDNFRWAGVPFYIRTGKRMREKSTKIVVQFKDIPMNLYYGNENNMNPNLLVIHIQPDEGITLYLNAKKLGGAAHAQPIKLDYCSNCNDELNTPEAYEKLIHDCLLGDATNFAHWDEVALSWSFVDSISETWAANKTLSPNYESGSMGPKESDDLLVKDGLHWWNI

SEQ ID NO: 23190 - protein, 406 aa, Bacillus subtilis
METPRKILLMVKAGTATDATIQSLLPHLEKDDILIDGGNTYYKDTQRRNKELAESGIHFIGTGVSGGEEGALKGPSIMPGGQKEAHELVKPILEAISAKVDGEPCTTYIGPDGAGHYVKMVHNGIEYGDMQLISESYFILKQVLGLSADELHEVFAEWNKGELDSYLIEITADIFTKKDEETGKPLVDVILDKAGQKGTGKWTSQSALDLGVPLPIITESVFARFISAMKEERVKASGLLSGPEVKPVTENKEELIEAVRKALFMSKICSYAQGFAQMKAASEEYNWDLKYGEIAMIFRGGCIIRAAFLQKIKEAYDREPELDNLLLDSYFKNIVESYQGALRQVISLAVAQGVPVPSFSSALAYYDSYRTAVLPANLIQAQRDYFGAHTYERTDKEGIFHTEWMK

SEQ ID NO: 23191 - protein, 424 aa, Bacillus subtilis
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 23192 - protein, 327 aa, Bacillus subtilis
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 23193 - protein, 330 aa, Bacillus subtilis
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 23194 - protein, 457 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTISPASNAF

SEQ ID NO: 23195 - protein, 372 aa, Bacillus subtilis
MEEKQHYSPGLDGVIAAETHISYLDTQSSQILIRGYDLIELSETKSYLELVHLLLEGRLPEESEMETLERKINSASSLPADHLRLLELLPEDTHPMDGLRTGLSALAGYDRQIDDRSPSANKERAYQLLGKMPALTAASYRIINKKEPILPLQTLSYSANFLYMMTGKLPSSLEEQIFDRSLVLYSEHEMPNSTFAARVIASTHSDLYGALTGAVASLKGNLHGGANEAVMYLLLEAKTTSDFEQLLQTKLKRKEKIMGFGHRVYMKKMDPRALMMKEALQQLCDKAGDHRLYEMCEAGERLMEKEKGLYPNLDYYAAPVYWMLGIPIPLYTPIFFSARTSGLCAHVIEQHANNRLFRPRVSYMGPRYQTKS

SEQ ID NO: 23196 - protein, 378 aa, Bacillus subtilis
MHVTQEQVMMRKMVRDFARKEIAPAAEIMEKTDEFPFQLIKKMGKHGLMGIPVPEQYGGAGADVVSYILAIHEISRISAAVGVILSVHTSVGTNPILYFGNEEQKMKYIPNLASGDHLGAFALTEPHSGSDAGSLRTTAIKKNGKYLLNGSKIFITNGGAADIYITFALTAPDQGRHGISAFIVEKNTPGFTVGKKERKLGLYGSNTTELIFDNAEVPEANLLGKEGDGFHIAMANLNVGRIGIAAQALGIAEAALEHAVDYAKQRVQFGRPIAANQGISFKLADMATRAEAARHLVYHAADLHNRGLNCGKEASMAKQFASDAAVKALDAVQIYGGYGYMKDYPVERLLRDAKVTQIYEGTNEIQRLIISKYLLGGT

SEQ ID NO: 23197 - protein, 244 aa, Bacillus subtilis
MKRLKKQLARDAEKGKRTETEVKSVINRISISQTLEEAEHADIVIEAIAENMAAKTEMFKTLDRICPPHTILASNTSSLPITEIAAVTNRPQRVIGMHFMNPVPVMKLVEVIRGLATSEETALDVMALAEKMGKTAVEVNDFPGFVSNRVLLPMINEAIYCVYEGVRTEAIDEVMKLGMNHPMGPLALADFIGLDTCLSIMEVLHSGLGDSKYRPCPLLRKYVKAGWLGKKSGRGFYDYEEKTS

SEQ ID NO: 23198 - protein, 393 aa, Bacillus subtilis
MRKTVIVSAARTPFGKFGGVLKEVKAAELGGIVMKEALQQAGVSGDDVEGNVMGMVVQAGSGQIPSRQAARLAGMPWSVPSETLNKVCASGLRAVTLCDQMIRAQDADILVAGGMESMSNIPYAVPAGRWGARMGDGELRDLMVYDGLTCAFDEVHMAVHGNTAAKEYAISRREQDEWALRSHARAAKAADEGKFQDEIVPVNWIGRKGKPNVVDKDEAIRRDTSLDQLAKLAPIYASDGSITAGNAPGVNDGAGAFVLMSEEKAAELGKRPLATILGFSTTGMPAHELAAAPGFAINKLLKKNGLTVQDIDLFEVNEAFASVVLTCEKIVGFDLEKVNVNGGAIALGHPIGASGARILMTLVYELKRRGGGLGVAAICSGAAQGDAVLVQVH

SEQ ID NO: 23199 - protein, 576 aa, Bacillus subtilis
MLAELSIKNFAIIEELTVSFERGLTVLTGETGAGKSIIIDAISLLVGGRGSSEFVRYGEAKAELEGLFLLESGHPVLGVCAEQGIDVSDEMIVMRRDISTSGKSVCRVNGKLVTIASLREIGRLLLDIHGQHDNQLLMEDENHLQLLDKFAGAEVESALKTYQEGYQRYVKLLKKLKQLSESEQEMAHCLDLIQFQLEEIESAKLELNEDEQLQEERQQISNFEKIYESLQNAYNALRSEQGGLDWVGMASAQLEDISDINEPLKKMSESVSNSYYLLEDATFQMRNMLDELEFDPERLNYIETRLNEIKQLKRKYGATVEDILEYASKIEEEIDQIENRDSHLQSLKKELDSVGKDVAVEAANVSQIRKTWAKKLADEIHRELKSLYMEKSTFDTEFKVRTASRNEEAPLVNGQPVQLTEQGIDLVKFLISTNTGEPLKSLSKVASGGELSRVMLAIKSIFSSQQDVTSIIFDEVDTGVSGRVAQAIAEKIHKVSIGSQVLCITHLPQVAAMADTHLYIAKELKDGRTTTRVKPLSKQEKVAEIERSIAGVEVTDLTKRHAKELLKQADQVKTTG

SEQ ID NO: 23200 - protein, 633 aa, Bacillus subtilis
MDLLSIQDPSFLKNMSIDELEKLSDEIRQFLITSLSASGGHIGPNLGVVELTVALHKEFNSPKDKFLWDVGHQSYVHKLLTGRGKEFATLRQYKGLCGFPKRSESEHDVWETGHSSTSLSGAMGMAAARDIKGTDEYIIPIIGDGALTGGMALEALNHIGDEKKDMIVILNDNEMSIAPNVGAIHSMLGRLRTAGKYQWVKDELEYLFKKIPAVGGKLAATAERVKDSLKYMLVSGMFFEELGFTYLGPVDGHSYHELIENLQYAKKTKGPVLLHVITKKGKGYKPAETDTIGTWHGTGPYKINTGDFVKPKAAAPSWSGLVSGTVQRMAREDGRIVAITPAMPVGSKLEGFAKEFPDRMFDVGIAEQHAATMAAAMAMQGMKPFLAIYSTFLQRAYDQVVHDICRQNANVFIGIDRAGLVGADGETHQGVFDIAFMRHIPNMVLMMPKDENEGQHMVHTALSYDEGPIAMRFPRGNGLGVKMDEQLKTIPIGTWEVLRPGNDAVILTFGTTIEMAIEAAEELQKEGLSVRVVNARFIKPIDEKMMKSILKEGLPILTIEEAVLEGGFGSSILEFAHDQGEYHTPIDRMGIPDRFIEHGSVTALLEEIGLTKQQVANRIRLLMPPKTHKGIGS

SEQ ID NO: 23201 - protein, 272 aa, Bacillus subtilis
MTNKLTSFLADRKKTIENQLSVYTEKLDMPDSLKKSMLYSLQAGGKRLRPLIVLAVLNAYGKSEKDGIPVGCAVEMIHTYSLIHDDLPCMDDDDLRRGKPTNHKVFGEATAVLAGDGLLTESFKLITSHVSDEVSAEKRLRLVNELISAAGTEGMVGGQVADMEAGNRQVTLEELESIHERKTSKLLGFCVIAGAILADAPEEDIETLRTFSSHIGIGFQIRDDILDLEGSEEKIGKRVGSDTTNDKSTYPSLLSLEGAKHKLDVHIKEAND

SEQ ID NO: 23202 - protein, 283 aa, Bacillus subtilis
MTATIIDGKETAREKREQLAKEVEELKKQGVTPGLAVILIGDDPASHSYVRGKKKAAETMGMNFKLDQFDSSLTEAELLSIIDQYNQDPEFHGILVQLPLPDHISEKAVIERISPDKDVDGFHPLNVGKMLLGEDTFLPCTPHGIVELLKKTNIDLSGKEVVVVGRSNIVGKPVGQLLLNENATVTYCHSRTENITEHTKKADILVVAVGRANFISADQIKEGAVVIDVGVNRLENGKLCGDVEFEGAKEKASFITPVPGGVGPMTITMLAHNTVKSAKRTLS

SEQ ID NO: 23203 - protein, 450 aa, Bacillus subtilis
MIKKLLIANRGEIAVRIIRACRELGIETVAVYSEADKDALHVQMADEAFCIGPKASKDSYLNVTNIVSVAKLTGTDAIHPGYGFLAENADFAELCEEVNVTFVGPSPDAISKMGTKDVARETMKQAGVPIVPGSQGIIENVEEAVSLANEIGYPVIIKATAGGGGKGIRVARTEEELINGIKITQQEAATAFRNPGVYIEKYIEDFRHVEIQVLADNYGNTIHLGERDCSIQRRLQKLLEESPSPALDSEIREQMGDAAVKAAKAVGYTGAGTVEFIYDYNEQRYYFMEMNTRIQVEHPVTEMVTGTDLIKEQIKVASGMELSLKQEDVEFEGWAIECRINAENPSKNFMPSPGEIKMYLPPGGLGVRVDSAAYPGYSIPPYYDSMIAKVITYGKTRDEAIARMKRALSEFVIEGIETTIPFHLKLLEHETFVSGEFNTKFLETYDVMGS

SEQ ID NO: 23204 - protein, 148 aa, Bacillus subtilis
MPHFLILNGPNVNRLGSREPEVFGRQTLTDIETDLFQFAEALHIQLTFFQSNHEGDLIDAIHEAEEQYSGIVLNPGALSHYSYAIRDAVSSISLPVVEVHLSNLYAREEFRHQSVIAPVAKGQIVGLGAEGYKLAVRYLLSQQGGESR

SEQ ID NO: 23205 - protein, 438 aa, Bacillus subtilis
MKETKFELYELKPFIIDAVHRLGFYEPTDIQKRLIPAVLKKESVIGQSQTGTGKTHAYLLPLLNKIDPAKDVVQVVITAPTRELANQIYQEALKITQGEEGSQIRSKCFIGGTDKQKSIDKLKIQPHLVVGTPGRIADLIKEQALSVHKAESLVIDEADLMLDMGFLADVDYIGSRMPEDLQMLVFSATIPEKLKPFLKKYMENPKYAHVEPKQVTAAKIEHILIPSKHRDKDKLLFDIMSHLNPYLGIVFANTKNTADHIAQYLTGKGMKIGLLHGGLTPRERKKVMKQINDLEFTYIIATDLAARGIDIKGVSHVINYELPDDLDFYVHRVGRTARAGSSGQAMTIYELTDEDALVRLEKMGIEFEYLELEKGEWKKGDDRQRRKKRKKTPNEADEIAHRLVKKPKKVKPGYKKKMSYEMEKIKKKQRRNQSKKRK

SEQ ID NO: 23206 - protein, 372 aa, Bacillus subtilis
MSKRDYYEVLGVSKSASKDEIKKAYRKLSKKYHPDINKEAGSDEKFKEVKEAYETLSDDQKRAHYDQFGHTDPNQGFGGGGFGGGDFGGFGFDDIFSSIFGGGTRRRDPKLRARGADLQYTMTLSFEDAAFGKETTIEIPREETCETCKGSGAKPGTNPETCSHCGGSGQLNVEQNTPFGKVVNRRVCHHCEGTGKIIKNKCADCGGKGKIKKRKKINVTIPAGVDDGQQLRLSGQGEPGINGGLPDLFVVFHVRAHEFFERDGDDIYCEMPLTFAQAALGDEVEVPTLHGKVKIPAGTQTGTKFRLRGKGVQNVRGYGQGDQHIVVRVVTPTNLTDKQKDIIREFAEVSGNLPDEQEMSFFDKVKRAFKGD

SEQ ID NO: 23207 - protein, 273 aa, Bacillus subtilis
MKIGFIGTGNMGTILIESFIESKAADPSNMTITNRTIEKALHIKNRYNSINVTESLEKLVSENEMIFICVKPLDIYPLLARALPYLRKDHILISITSPVQTEQLEQYVPCQVARVIPSITNRALAGVSLVTFGTSCGESAKAKINELMQHISHPLQIESDITRVASDIVSCGPAFMSYLIQRFIDAAVSETSVSKQDAILMCKEMLVGMGKLLETELYTLPALQEKVCVKGGVTGEGIKALESGVQDMFHRVFQNTHMKYEEDISAVKKQFHV

SEQ ID NO: 23208 - protein, 280 aa, Bacillus subtilis
MKKLYGVIGNPIGHSMSPDIHNASLKDLGLDGHYHAFKVEENDLEDAVKGIRALGVQGINVTVPHKVSIMDYLDHIDESAKVLGAVNTVRREGDKLVGYNTDGEGFVKSLMKVLDKPISELSFLMIGAGGAARAIFTTFVRNTPKKFDICNRTLEKAKRLTEATPSFHNKEVLSIKEAEERLEQYDVIIHTTSVGMYPNVDDVPLSLQRAASSAVVCDIVYNPIQTALLKEASQKGLKTLDGVGMFVEQAALSFQLWTGQEPNIEKMRSIVIGKLGGTEC

SEQ ID NO: 23209 - protein, 297 aa, Bacillus subtilis
MKIGLIGLGKMGINIGKQFIDRNHQVVGYDVNQAAVDELKAYGAEGTTNLKEFISLLHPPRILWVMVPHGIVDAVLRDVSPLLSKGDMIIEAGNSHYKESIRRYNQMKEAGIHYLDAGTSGGMEGARHGACFMVGGDHEAWEIVEPLFRDTAVENGYLYAGEAGSGHFLKMIHNGIEYGMMAAIGEGFEVLENSQFDFDYEKVARVWNHGSVIRSWLMGLTERAFAKDAKLDQIKGIMHSSGEGKWTVETALDLQTATPVIAMSLMMRYRSLTDDTFTGKVVAALRNEFGGHATEKK

SEQ ID NO: 23210 - protein, 277 aa, Bacillus subtilis
MKISMQKADFWKKAAISLLVFTMFFTLMMSETVFAAGLNKDQKRRAEQLTSIFENGTTEIQYGYVERLDDGRGYTCGRAGFTTATGDALEVVEVYTKAVPNNKLKKYLPELRRLAKEESDDTSNLKGFASAWKSLANDKEFRAAQDKVNDHLYYQPAMKRSDNAGLKTALARAVMYDTVIQHGDGDDPDSFYALIKRTNKKAGGSPKDGIDEKKWLNKFLDVRYDDLMNPANHDTRDEWRESVARVDVLRSIAKENNYNLNGPIHVRSNEYGNFVIK

SEQ ID NO: 23211 - protein, 349 aa, Bacillus subtilis
MCNQHQTRVLSVSHAKAKFEQTTIERRGLRPHDVLIDIKFSGICHSDIHSAFDEWGGGIFPMVPGHEIAGVVTAVGTKVTKLAVGDRVGVGCFVDSCGECEYCLNAEEQFCTKGVVQTYNSVDYDGNPTYGGYSQKIVVTDRFVVRIPDRLEMDVASPLLCAGITTYSPLKHWNVGPGKKVAIVGVGGLGHLAIQFAHAMGAEVTVLSRSMNKKEEALELGANHYYATSDPATFTALAGRFDVILNTVSANLDVDAYLSMLRIDGTLVSVGAPAKPDTYSVFSLIMGRRSIAGSLVGGIQETQEMLDFAAEHGIEPKIEVIGADQVDEAYERILRSDVRYRFVIDISTL

SEQ ID NO: 23212 - protein, 677 aa, Bacillus subtilis
MKKRLIQVMIMFTLLLTMAFSADAADSSYYDEDYRPQYHFTPEANWMNDPNGMVYYAGEYHLFYQYHPYGLQWGPMHWGHAVSKDLVTWEHLPVALYPDEKGTIFSGSAVVDKNNTSGFQTGKEKPLVAIYTQDREGHQVQSIAYSNDKGRTWTKYAGNPVIPNPGKKDFRDPKVFWYEKEKKWVMVLAAGDRILIYTSKNLKQWTYASEFGQDQGSHGGVWECPDLFELPVDGNPNQKKWVMQVSVGNGAVSGGSGMQYFVGDFDGTHFKNENPPNKVLWTDYGRDFYAAVSWSDIPSTDSRRLWLGWMSNWQYANDVPTSPWRSATSIPRELKLKAFTEGVRVVQTPVKELETIRGTSKKWKNLTISPASHNVLAGQSGDAYEINAEFKVSPGSAAEFGFKVRTGENQFTKVGYDRRNAKLFVDRSESGNDTFNPAFNTGKETAPLKPVNGKVKLRIFVDRSSVEVFGNDGKQVITDIILPDRSSKGLELYAANGGVKVKSLTIHPLKKVWGTTPFMSNMTGWTTVNGTWADTIEGKQGRSDGDSFILSSASGSDFTYESDITIKDGNGRGAGALMFRSDKDAKNGYLANVDAKHDLVKFFKFENGAASVIAEYKTPIDVNKKYHLKTEAEGDRFKIYLDDRLVIDAHDSVFSEGQFGLNVWDATAVFQNVTKES

SEQ ID NO: 23213 - protein, 459 aa, Bacillus subtilis
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 23214 - protein, 980 aa, Bacillus subtilis
MMDVKSISVRVDGTEIQARAGATILDILNENGIEYPQICHVPEVDPIQTCDTCIVEANGKLVRSCATVAENGMSIDLSGNRVKEAQTEAMDRLLENHLLYCTVCDNNNGNCTLHNTAEMMGIEHQKYPYTPKEDPSCAVDMSHPFYRYDPNQCIACGQCVEVCQNLQVNETLSIDWERERPRVIWDEGVPINESSCVSCGQCVTVCPCNALMEKSMLGQAGFMTGIKEDVMEPMIDLVKNVEPGYGSIFAISEVEAAMRETRTKKTKTVCTFCGVGCSFEVWTKGRDILKIQPVSDAPVNAISTCVKGKFGWDFVNSKERITKPLIRKNGAFVESSWEEALDLVASRLGSIKEQYGKGSVGFISSSKITNEENYVIQKLARQVFETNNVDNCSRYCQSPATDGLFRTVGMGGDAGTIKDIAKAGLVIIVGANPAEGHPVLATRVKRAHKLHGQKLIVADLRKNEMAERSDLFISPKQGTDQVWLMAVTKYMIDQGWHDQAFIDENVNYFEDYKETLKTYTLDYAERITGLSKENIIQIAEMIRDADGTCVLWGMGVTQNTGGSDTSAAISNLLLATGNYRRPGAGAYPLRGHNNVQGACDMGTLPGWLPGYQHITDDKARAKFEEAYGVEIDGKPGLDNIQMLHAIEEGKMKAMYLVGEDMALVDSNANHVHDILSSLDFFVVQDIFLSRTAQYADVVLPATPSLEKDGTFTNTERRVQRLYQALPTLGDAKPDWWIIQEVANRLGANWNYSHPSDIFSEMASLSPLFAKASYEVLEGWNSFLWGSFTGESTPLLYEDGFNFPDKKARFALSDWTEPAAFPEEYDLHINNGRMLEHFHEGNMTNKSKGIQAKVPNVFVEISPELAQERGVCDGSLVRLVSPFGAVKLNALITDRVRKNELYLPMNSTDKESAINFLTGPAADKRTNTPAYKQTKVRMEVLGGCETAPLPKTNPRNKKRHPQNGVEAERKWNRPGYVHLTD

SEQ ID NO: 23215 - protein, 379 aa, Bacillus subtilis
MKKKTLMIHGGITGDEKTGAVSVPIYQVSTYKQPKAGQHTGYEYSRTANPTRTALEALVTELESGEAGYAFSSGMAAITAVMMLFNSGDHVVLTDDVYGGTYRVMTKVLNRLGIESTFVDTSSREEVEKAIRPNTKAIYIETPTNPLLKITDLTLMADIAKKAGVLLIVDNTFNTPYFQQPLTLGADIVLHSATKYLGGHSDVVGGLVVTASKELGEELHFVQNSTGGVLGPQDSWLLMRGIKTLGLRMEAIDQNARKIASFLENHPAVQTLYYPGSSNHPGHELAKTQGAGFGGMISFDIGSEERVDAFLGNLKLFTIAESLGAVESLISVPARMTHASIPRERRLELGITDGLIRISVGIEDAEDLLEDIGQALENI

SEQ ID NO: 23216 - protein, 170 aa, Bacillus subtilis
MDLKQYVTIVPDYPKEGVQFKDITTLMDKGDVYRYATDQIVEYAKEKQIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELSYLDGRNKLEDYDILTLMKY

SEQ ID NO: 23217 - protein, 531 aa, Bacillus subtilis
MSKKTIAVIGSGAAALSLAAAFPPSYEVTVITKKSVKNSNSVYAQGGIAAAYAKDDSIEAHLEDTLYAGCGHNNLAIVADVLHDGKMMVQSLLERGFPFDRNERGGVCLGREGAHSYNRIFHAGGDATGRLLIDYLLKRINSKIKLIENETAADLLIEDGRCIGVMTKDSKGRLKVRHADEVVLAAGGCGNLFLHHTNDLTVTGDGLSLAYRAGAELTDLEFTQFHPTLLVKNGVSYGLVSEAVRGEGGCLVDENGRRIMAERHPLGDLAPRDIVSRVIHEEMAKGNRVYIDFSAISDFETRFPTITAICEKAGIDIHSGKIPVAPGMHFLMGGVSVNRWGETTVPGLYAIGETACSGLHGANRLASNSLLEALVFGKRAAEHIIQKPVYNRQYQSGLETSVFYEVPDIEGHELQSKMTSHMSILREQSSLIELSIWLHTLPFQEVNVKDITIRQMELSHLWQTAKLMTFSALLREESRGAHFRTDFPHAEVSWQGRQIVHTKKGTKIRKNEGIWNNESFTAEKITESLFS

SEQ ID NO: 23218 - protein, 430 aa, Bacillus subtilis
MFTAYQDARSWIHGRLKFGVKPGLGRMKQLMARLGHPEKKIRAFHVAGTNGKGSTVAFIRSMLQEAGYTVGTFTSPYIITFNERISVNGIPISDEEWTALVNQMKPHVEALDQTEYGQPTEFEIMTACAFLYFAEFHKVDFVIFETGLGGRFDSTNVVEPLLTVITSIGHDHMNILGNTIEEIAGEKAGIIKEGIPIVTAVTQPEALQVIRHEAERHAAPFQSLHDACVIFNEEALPAGEQFSFKTEEKCYEDIRTSLIGTHQRQNAALSILAAEWLNKENIAHISDEALRSGLVKAAWPGRLELVQEHPPVYLDGAHNEEGVEKLAETMKQRFANSRISVVFSALKDKPYQNMIKRLETIAHAIHFASFDFPRASLAKDLYDASEISNKSWSEDPDDVIKFIESKKGSNEIVLITGSLYFISDIRKRLK

SEQ ID NO: 23219 - protein, 430 aa, Bacillus subtilis
MRSYEKSKTAFKEAQKLMPGGVNSPVRAFKSVDMDPIFMERGKGSKIFDIDGNEYIDYVLSWGPLILGHTNDRVVESLKKVAEYGTSFGAPTEVENELAKLVIDRVPSVEIVRMVSSGTEATMSALRLARGYTGRNKILKFEGCYHGHGDSLLIKAGSGVATLGLPDSPGVPEGIAKNTITVPYNDLESVKLAFQQFGEDIAGVIVEPVAGNMGVVPPQEGFLQGLRDITEQYGSLLIFDEVMTGFRVDYNCAQGYFGVTPDLTCLGKVIGGGLPVGAYGGKAEIMEQIAPSGPIYQAGTLSGNPLAMTAGLETLKQLTPESYKNFIKKGDRLEEGISKTAGAHGIPHTFNRAGSMIGFFFTNEPVINYETAKSSDLKLFASYYKGMANEGVFLPPSQFEGLFLSTAHTDEDIENTIQAAEKVFAEISRR

SEQ ID NO: 23220 - protein, 324 aa, Bacillus subtilis
MSQSFNRHRRLRTSKAMREMVKETRLHPSDFIYPIFVVEGLEGKKAVPSMPDVHHVSLDLLKDEVAELVKLGIQSVIVFGIPEEKDDCGTQAYHDHGIVQKAITEIKEHFPEMVVVADTCLCEYTDHGHCGLVKDGVILNDESLELLAQTAVSQAKAGADIIAPSNMMDGFVTVIREALDKEGFVNIPIMSYAVKYSSEFYGPFRDAANSTPQFGDRKTYQMDPANRMEALREAQSDVEEGADFLIVKPSLSYMDIMRDVKNEFTLPLVAYNVSGEYSMVKAAAQNGWIKEKEIVLEILTSMKRAGADLIITYHAKDAAKWLAE

SEQ ID NO: 23221 - protein, 262 aa, Bacillus subtilis
MENDFPLKGKTVLVTRNKAQAASFQQKVEALGGKAVLTSLITFRRALPNDVAEQVREDLAAPGWLVFTSVNGADFFFSYLKENQLILPAHKKIAAVGEKTARRLKMHNVSVDVMPQEYIAEQLADALKQHAEPGETITVMKGNLSRDVIKQELVPLGFEVKEWVLYETIPDEEGIEALKDAAGQYSFDYVTFTSSSTVHTFMHVLGEELKKWKANGTACISIGPLTNDALLTYGITSHTPDTFTIDGMLELMCSMSREEERI

SEQ ID NO: 23222 - protein, 314 aa, Bacillus subtilis
MMRTIKVGSRRSKLAMTQTKWVIQKLKEINPSFAFEIKEIVTKGDRIVDVTLSKVGGKGLFVKEIEQALLNEEIDMAVHSMKDMPAVLPEGLVIGCIPEREDPRDALISKNRVKLSEMKKGAVIGTSSLRRSAQLLIERPDLTIKWIRGNIDTRLQKLETEDYDAIILAAAGLSRMGWKQDVVTEFLEPERCLPAVGQGALAIECRESDEELLALFSQFTDEYTKRTVLAERAFLNAMEGGCQVPIAGYSVLNGQDEIEMTGLVASPDGKIIFKETVTGNDPEEVGKRCAALMADKGAKDLIDRVKRELDEDGK

SEQ ID NO: 23223 - protein, 455 aa, Bacillus subtilis
MHILVVGVDYKSAPIEIREKVSFQPNELAEAMVQLKEEKSILENIIVSTCNRTEIYAVVDQLHTGRYYIKKFLADWFQLSKEELSPFLTFYESDAAVEHLFRVACGLDSMVIGETQILGQVRDSFKTAQQEKTIGTIFNELFKQAVTVGKRTHAETDIGSNAVSVSYAAVELAKKIFGNLSSKHILILGAGKMGELAAENLHGQGIGKVTVINRTYLKAKELADRFSGEARSLNQLESALAEADILISSTGASEFVVSKEMMENANKLRKGRPLFMVDIAVPRDLDPALNDLEGVFLYDIDDLEGIVEANMKERRETAEKVELLIEETIVEFKQWMNTLGVVPVISALREKALAIQSETMDSIERKLPHLSTREKKLLNKHTKSIINQMLRDPILKVKELAADADSEEKLALFMQIFDIEEAAGRQMMKTVESSQKVHSFKKAESKAGFSPLVSE

SEQ ID NO: 23224 - protein, 774 aa, Bacillus subtilis
MAEELKRSIPLLPLRGLLVYPTMVLHLDVGRDKSVQALEQAMMHDHMIFLATQQDISIDEPGEDEIFTVGTYTKIKQMLKLPNGTIRVLVEGLKRAHIVKYNEHEDYTSVDIQLIHEDDSKDTEDEALMRTLLDHFDQYIKISKKISAETYAAVTDIEEPGRMADIVASHLPLKLKDKQDILETADVKDRLNKVIDFINNEKEVLEIEKKIGQRVKRSMERTQKEYYLREQMKAIQKELGDKEGKTGEVQTLTEKIEEAGMPDHVKETALKELNRYEKIPSSSAESSVIRNYIDWLVALPWTDETDDKLDLKEAGRLLDEEHHGLEKVKERILEYLAVQKLTKSLKGPILCLAGPPGVGKTSLAKSIAKSLGRKFVRISLGGVRDESEIRGHRRTYVGAMPGRIIQGMKKAGKLNPVFLLDEIDKMSSDFRGDPSSAMLEVLDPEQNSSFSDHYIEETFDLSKVLFIATANNLATIPGPLRDRMEIINIAGYTEIEKLEIVKDHLLPKQIKEHGLKKSNLQLRDQAILDIIRYYTREAGVRSLERQLAAICRKAAKAIVAEERKRITVTEKNLQDFIGKRIFRYGQAETEDQVGVVTGLAYTTVGGDTLSIEVSLSPGKGKLILTGKLGDVMRESAQAAFSYVRSKTEELGIEPDFHEKYDIHIHVPEGAVPKDGPSAGITMATALVSALTGRAVSREVGMTGEITLRGRVLPIGGLKEKALGAHRAGLTTIIAPKDNEKDIEDIPESVREGLTFILASHLDEVLEHALVGEKK

SEQ ID NO: 23225 - protein, 365 aa, Bacillus subtilis
MKKRIALLPGDGIGPEVLESATDVLKSVAERFNHEFEFEYGLIGGAAIDEHHNPLPEETVAACKNADAILLGAVGGPKWDQNLSELRPEKGLLSIRKQLDLFANLRPVKVFESLSDRSPLKKEYIDNVDFVIVRELTGGLYFGQPSKRYVNTEGEQEAVDTLFYKRTEIERVIREGFKMAAARKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 23226 - protein, 253 aa, Bacillus subtilis
MSEQKTIRFIITRQDTADSTPYDEEFEIPYRPNLNVISALMEIRRNPVNVKGEKTTPVTWDMNCLEEVCGACSMVINGKPRQSCTALIDQLEQPIRLKPMKTFPVVRDLQVDRSRMFDSLKKVKAWIPIDGTYDLGPGPRMPEKRRQWAYELSKCMTCGVCLEACPNVNSKSKFMGPAPMSQVRLFNAHPTGAMNKSERLEALMDEGGLADCGNSQNCVQSCPKGIPLTTSIAALNRDTNLQAFRNFFGSDRV

SEQ ID NO: 23227 - protein, 586 aa, Bacillus subtilis
MSQSSIIVVGGGLAGLMATIKAAESGMAVKLFSIVPVKRSHSVCAQGGINGAVNTKGEGDSPWEHFDDTVYGGDFLANQPPLKAMCEAAPSIIHLLDRMAVMFNRTPEGLLDFRRFGGTQHHRTAYAGATTGQQLLYALDEQVRRYEVAGLVTKYEGWEFLGAVLDDDRTCRGIVAQNLTNMQIESFRSDAVIMATGGPGIIFGKSTNSMINTGSAASIVYQQGAYYANGEFIQIHPTAIPGDDKLRLMSESARGEGGRVWTYKDGKPWYFLEEKYPAYGNLVPRDIATREIFDVCVNQKLGINGENMVYLDLSHKDPKELDIKLGGIIEIYEKFMGDDPRKLPMKIFPAVHYSMGGLWVDYDQMTNIPGLFAAGECDYSMHGGNRLERTSLLSAIYGGMVAGPNAVKYVNGLESSAEDMSSSLFDAHVKKEEEKWADIMIMDGTENAYVLHKELGEWMTANVTVVRHNDKLLKTDDKIQELMERFKKININDTTKWSNQGAMFTRQFSNMLQLARVITLGAYNRNESRGAHYKPDYPERNDDEWLKTTMAKHVSPYEAPEFEYQDVDVSLITPRKRDYSKKKVAK

SEQ ID NO: 23228 - protein, 408 aa, Bacillus subtilis
MGLIVQKFGGTSVGSVEKIQNAANRAIAEKQKGHQVVVVVSAMGKSTDELVSLAKAISDQPSKREMDMLLATGEQVTISLLSMALQEKGYDAVSYTGWQAGIRTEAIHGNARITDIDTSVLADQLEKGKIVIVAGFQGMTEDCEITTLGRGGSDTTAVALAAALKADKCDIYTDVPGVFTTDPRYVKSARKLEGISYDEMLELANLGAGVLHPRAVEFAKNYQVPLEVRSSTETEAGTLIEEESSMEQNLIVRGIAFEDQITRVTIYGLTSGLTTLSTIFTTLAKRNINVDIIIQTQAEDKTGISFSVKTEDADQTVAVLEEYKDALEFEKIETESKLAKVSIVGSGMVSNPGVAAEMFAVLAQKNILIKMVSTSEIKVSTVVSENDMVKAVESLHDAFELSKHPSAV

SEQ ID NO: 23229 - protein, 495 aa, Bacillus subtilis
MSEHQAVIQTDIAKGTINKNIYGHFAEHLGRGIYEGIWVGTDSDIPNINGIRKDVLEALKQLHIPVLRWPGGCFADEYHWANGVGDRKTMLNTHWGGTIESNEFGTHEFMMLCELLECEPYICGNVGSGTVQEMSEWIEYMTFEEGTPMSDWRKQNGREEPWKLKYFGVGNENWGCGGNMHPEYYADLYRRFQTYVRNYSGNDIYKIAGGANVDDFNWTDVLMKKAAGLMDGLSLHYYTIPGDFWKGKGSATEFTEDEWFITMKKAKYIDELIQKHGTIMDRYDPEQRVGLIIDEWGTWFDPEPGTNPGFLYQQNTIRDALVAASHFHIFHQHCRRVQMANIAQTVNVLQAMILTEGERMLLTPTYHVFNMFKVHQDASLLATETMSADYEWNGETFPQISISASKQAEGDINITICNIDHQNKAEAEIELRGLHKAADHSGVILTAEKMNAHNTFDDPHHVKPESFRQYTLSKNKLKVKLPPMSVVLLTLRADS

SEQ ID NO: 23230 - protein, 560 aa, Bacillus subtilis
MQSQKPWLAEYPNDIPHELPLPNKTLQSILTDSAARFPDKTAISFYGKKLTFHDILTDALKLAAFLQCNGLQKGDRVAVMLPNCPQTVISYYGVLFAGGIVVQTNPLYTEHELEYQLRDAQVSVIITLDLLFPKAIKMKTLSIVDQILITSVKDYLPFPKNILYPLTQKQKVHIDFDKTANIHTFASCMKQEKTELLTIPKIDPEHDIAVLQYTGGTTGAPKGVMLTHQNILANTEMCAAWMYDVKEGAEKVLGIVPFFHVYGLTAVMNYSIKLGFEMILLPKFDPLETLKIIDKHKPTLFPGAPTIYIGLLHHPELQHYDLSSIKSCLSGSAALPVEVKQKFEKVTGGKLVEGYGLSEASPVTHANFIWGKNKPGSIGCPWPSTDAAIYSEETGELAAPYEHGEIIVKGPQVMKGYWNKPEETAAVLRDGWLFTGDMGYMDEEGFFYIADRKKDIIIAGGYNIYPREVEEALYEHEAIQEIVVAGVPDSYRGETVKAFVVLKKGAKADTEELDAFARSRLAPYKVPKAYEFRKELPKTAVGKILRRRLLEEETENHHIK

SEQ ID NO: 23231 - protein, 470 aa, Bacillus subtilis
MITKDVKEQLIQVSGPENFDDSNAGRLVYSYDATPQYQSMPDAVIAPRNTDEISRILTICSEHRVPIVPRGSGTNLCGGTCPTEGGLVLLFKHMNQILEIDEENLTATVQPGVITLDMIRAVESKGLFYPPDPSSMKISTIGGNINENSGGLRGLKYGVTRDYVIGLEVVLANGDIIRTGGKLAKDVAGYDLTRLFVGSEGTLGIVTEAIVKLVPKPETKKTLLALYENIDAAAQTVSDIIAAKIIPATLEFLDQPTLLVIEDYAKIGLPTSAKAVLLIEQDGPFETVERDMEKIEAICKKGDAVSVQTAQTEEEAFALTEARRSALSALARLKPTTILEDATVPRSEIANMVKAINDIAAKYDISICTFGHAGDGNLHPTCTTDIRNKDEMERVEQAFAEIFEKAIELGGTITGEHGVGEMKAPYLEMKLKKEGIDAMKALKAAFDPRNILNPGKMFAKDARKRVVAER

SEQ ID NO: 23232 - protein, 500 aa, Bacillus subtilis
MKKARMIVDKEYKIGEVDKRIYGSFIEHMGRAVYEGIYEPDHPEADEDGFRKDVQSLIKELQVPIIRYPGGNFLSGYNWEDGVGPVENRPRRLDLAWQTTETNEVGTNEFLSWPKKVNTEVNMAVNLGTRGIDAARNLVEYCNHPKGSYWSDLRRSHGYEQPYGIKTWCLGNEMDGPWQIGHKTADEYGRLAAETAKVMKWVDPSIELVACGSSNSGMPTFIDWEAKVLEHTYEHVDYISLHTYYGNRDNNLPNYLARSMDLDHFIKSVAATCDYVKAKTRSKKTINLSLDEWNVWYHSNEADKKVEPWITARPILEDIYNFEDALLVGSLLITMLQHADRVKIACLAQLVNVIAPIMTEKGGEAWRQPIFYPYMHASVYGRGESLKPLISSPKYDCSDFTDVPYVDAAVVYSEEEETLTIFAVNKAEDQMETEISLRGFESYQIAEHIVLEHQDIKATNQHNRKNVVPHSNGSSSVSENGLTAHFTPLSWNVIRLKKQS

SEQ ID NO: 23233 - protein, 560 aa, Bacillus subtilis
MAYTIGVDFGTLSGRAVLVHVQTGEELAAAVKEYRHAVIDTVLPKTGQKLPRDWALQHPADYLEVLETTIPSLLEQTGVDPKDIIGIGIDFTACTILPIDSSGQPLCMLPEYEEEPHSYVKLWKHHAAQKHADRLNQIAEEEGEAFLQRYGGKISSEWMIPKVMQIAEEAPHIYEAADRIIEAADWIVYQLCGSLKRSNCTAGYKAMWSEKAGYPSDDFFEKLNPSMKTITKDKLSGSIHSVGEKAGSLTEKMAKLTGLLPGTAVAVANVDAHVSVPAVGITEPGKMLMIMGTSTCHVLLGEEVHIVPGMCGVVDNGILPGYAGYEAGQSCVGDHFDWFVKTCVPPAYQEEAKEKNIGVHELLSEKANHQAPGESGLLALDWWNGNRSTLVDADLTGMLLGMTLLTKPEEIYRALVEATAYGTRMIIETFKESGVPIEELFAAGGIAEKNPFVMQIYADVTNMDIKISGSPQAPALGSAIFGALAAGKEKGGYDDIKKAAANMGKLKDITYTPNAENAAVYEKLYAEYKELVHYFGKENHVMKRLKTIKNLQFSSAAKKN

SEQ ID NO: 23234 - protein, 498 aa, Bacillus subtilis
MLQTKDYEFWFVTGSQHLYGEETLELVDQHAKSICEGLSGISSRYKITHKPVVTSPETIRELLREAEYSETCAGIITWMHTFSPSQKLWKRRPFPPYQKPLMHLHTQYNRDIPWGTIDMDFMNSNQSAHGDREYGYINSRMGLSRKVIAGYWDDEEVKKEMSQWMDTAAALNESRHIKVARFGDNMRHVAVTDGDKVGAHIQFGWQVDGYGIGDLVEVMDRITDDEVDTLYAEYDRLYVISEETKRDEAKVASIKEQAKIELGLTAFLEQGGYTAFTTSFEVLHGMKQLPGLAVQRLMEKGYGFAGEGDWKTAALVRMMKIMAKGKRTSFMEDYTYHFEPGNEMILGSHMLEVCPTVALDQPKIEVHSLSIGGKEDPARLVFNGISGSAIQASIVDIGGRFRLVLNEVNGQEIEKDMPNLPVARVLWKPEPSLKTAAEAWILAGGAHHTCLSYELTAEQMLDWAEMAGIESVLISRDTTIHKLKHELKWNEALYRLQK

SEQ ID NO: 23235 - protein, 340 aa, Bacillus subtilis
MKVKVAINGFGRIGRMVFRKAMLDDQIQVVAINASYSAETLAHLIKYDTIHGRYDKEVVAGEDSLIVNGKKVLLLNSRDPKQLPWREYDIDIVVEATGKFNAKDKAMGHIEAGAKKVILTAPGKNEDVTIVMGVNEDQFDAERHVIISNASCTTNCLAPVVKVLDEEFGIESGLMTTVHAYTNDQKNIDNPHKDLRRARACGESIIPTTTGAAKALSLVLPHLKGKLHGLALRVPVPNVSLVDLVVDLKTDVTAEEVNEAFKRAAKTSMYGVLDYSDEPLVSTDYNTNPHSAVIDGLTTMVMEDRKVKVLAWYDNEWGYSCRVVDLIRHVAARMKHPSAV

SEQ ID NO: 23236 - protein, 280 aa, Bacillus subtilis
MTTHLQAKATLHNGVEMPWFGLGVFQVEEGSELVNAVKTAIVHGYRSIDTAAIYGNEAGVGEGIREGIEEAGISREDLFITSKVWNADLGYEETLAAFETSLSKLGLDYLDLYLIHWPVEGKYKEAWRALETLYKEGRIKAIGVSNFQIHHLEDLMTAAEIKPMINQVEFHPRLTQKELIRYCQNQGIQMEAWSPLMQGQLLDHPVLADIAQTYNKSVAQIILRWDLQHGIITIPKSTKEHRIKENASVFDFELTQDDMNRIDALNENLRVGPDPDNFDF

SEQ ID NO: 23237 - protein, 312 aa, Bacillus subtilis
MGNTRKKVSVIGAGFTGATTAFLIAQKELADVVLVDIPQLENPTKGKALDMLEASPVQGFDAKITGTSNYEDTAGSDIVVITAGIARKPGMSRDDLVSTNEKIMRSVTQEIVKYSPDSIIVVLTNPVDAMTYAVYKESGFPKERVIGQSGVLDTARFRTFVAEELNLSVKDVTGFVLGGHGDDMVPLVRYSYAGGIPLETLIPKERIDAIVERTRKGGGEIVNLLGNGSAYYAPAASLTEMVEAILKDQRRVLPTIAYLEGEYGYEGIYLGVPTIVGGNGLEQIIELELTDYERAQLNKSVESVKNVMKVLS

SEQ ID NO: 23238 - protein, 423 aa, Bacillus subtilis
MAQGEKITVSNGVLNVPNNPIIPFIEGDGTGPDIWNAASKVLEAAVEKAYKGEKKITWKEVYAGEKAYNKTGEWLPAETLDVIREYFIAIKGPLTTPVGGGIRSLNVALRQELDLFVCLRPVRYFTGVPSPVKRPEDTDMVIFRENTEDIYAGIEYAKGSEEVQKLISFLQNELNVNKIRFPETSGIGIKPVSEEGTSRLVRAAIDYAIEHGRKSVTLVHKGNIMKFTEGAFKNWGYELAEKEYGDKVFTWAQYDRIAEEQGKDAANKAQSEAEAAGKIIIKDSIADIFLQQILTRPNEFDVVATMNLNGDYISDALAAQVGGIGIAPGANINYETGHAIFEATHGTAPKYAGLDKVNPSSVILSGVLLLEHLGWNEAADLVIKSMEKTIASKVVTYDFARLMDGATEVKCSEFGEELIKNMD

SEQ ID NO: 23239 - protein, 372 aa, Bacillus subtilis
MTATRGLEGVVATTSSVSSIIDDTLTYVGYDIDDLTENASFEEIIYLLWHLRLPNKKELEELKQQLAKEAAVPQEIIEHFKSYSLENVHPMAALRTAISLLGLLDSEADTMNPEANYRKAIRLQAKVPGLVAAFSRIRKGLEPVEPREDYGIAENFLYTLNGEEPSPIEVEAFNKALILHADHELNASTFTARVCVATLSDIYSGITAAIGALKGPLHGGANEGVMKMLTEIGEVENAEPYIRAKLEKKEKIMGFGHRVYKHGDPRAKHLKEMSKRLTNLTGESKWYEMSIRIEDIVTSEKKLPPNVDFYSASVYHSLGIDHDLFTPIFAVSRMSGWLAHILEQYDNNRLIRPRADYTGPDKQKFVPIEERA

SEQ ID NO: 23240 - protein, 585 aa, Bacillus subtilis
MRKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 23241 - protein, 319 aa, Bacillus subtilis
MKRIGVLTSGGDSPGMNAAVRAVVRKAIYHDVEVYGIYNGYAGLISGKIEKLELGSVGDIIHRGGTKLYTARCPEFKTVEGREKGIANLKKLGIEGLVVIGGDGSYMGAKKLTEHGFPCVGVPGTIDNDIPGTDFTIGFDTALNTVIDAIDKIRDTATSHERTYVIEVMGRHAGDIALWAGLAGGAESILIPEADYDMHEIIARLKRGHERGKKHSIIIVAEGVGSGVEFGKRIEEETNLETRVSVLGHIQRGGSPSAADRVLASRLGAYAVELLLEGKGGRCVGIQNNKLVDHDIIEILETKHTVEQNMYQLSKELSI

SEQ ID NO: 23242 - protein, 410 aa, Bacillus subtilis
MSLREEALHLHKVNQGKLESKSKVEVRNAKDLSLAYSPGVAEPCKDIHEDINKVYDYTMKGNMVAVVTDGTAVLGLGNIGPEAALPVMEGKAVLFKSFAGVDAFPIALNTNDVDKIVETVKLLEPTFGGVNLEDIAAPNCFIIEERLKKETNIPVFHDDQHGTAIVTVAGLVNALKLSGKSMSSIKVVANGAGAAGIAIIKLLHHYGVRDIVMCDSKGAIYEGRPNGMNDVKNEVAKFTNQDRKDGSLKDVIVDADVFIGVSVAGALTKEMVQSMAKDPIIFAMANPNPEIMPEDAREAGASVVGTGRSDFPNQVNNVLAFPGIFRGALDVRATHINEEMKIAAVEAIASLVSEDELSADYVIPAPFDKRVAPAVAKAVAKAAMETGVARITVDPEEVAEKTRKLTIIGE

SEQ ID NO: 23243 - protein, 259 aa, Bacillus subtilis
MIEIKNIHKQFGIHHVLKGINLTVRKGEVVTIIGPSGSGKTTFLRCLNLLERPDEGIISIHDKVINCRFPSKKEVHWLRKQTAMVFQQYHLFAHKTVIENVMEGLTIARKMRKQDAYAVAENELRKVGLQDKLNAYPSQLSGGQKQRVGIARALAIHPDVLLFDEPTAALDPELVGEVLEVMLEIVKTGATMIVVTHEMEFARRVSDQVVFMDEGVIVEQGTPEEVFRHTKKDRTRQFLRRVSPEYLFEPKEHIKEPVI

SEQ ID NO: 23244 - protein, 255 aa, Bacillus subtilis
MRHALITAGSKGLGRKVTETLLAKGYSVTVNYRQDEEAVSRLKEACPDCLDRLQFVKGDVTKKEDLLRIAEAALNRFGRIDFLINNAGPYIFERKKLADYTDDEWYGMLEGNLSAVFHLFKAVIPIMRKQQFGRIITYGFQGAAHAPGWLHRSAFGAAKVGLASLTKTIAIEEAEFGITANMVCPGDIVGDMKEASIEEARMRIGKEKTPIGRSGTGEDIARIIAFLCEENSDLVTGTVIEATGGLNVINKNQTT

SEQ ID NO: 23245 - protein, 461 aa, Bacillus subtilis
MKKLWGGRFQKTPEKWVDEFGASISFDQNLVAEDITGSLAHAAMLKKCGILTAEEELKIREGLNTLLQKAEEGALEFSVDYEDIHLNIEKMLIDEIGPLGGKLHTGRSRNDQVATDMHLYLKNHVGHIIELIEAFQSALIEKAEANVETILPGYTHLQRAQPISFAHHLLAYFWMLERDKERFQDSMKRINKSPLGCGALAGTTFPIDRDYSAELLGFDAIYENSLDGVSDRDFILEFLSNSSMLMMHLSRFSEEIILWCSQEFKFIELDDTYATGSSMMPQKKNPDMAELIRGKTGRVYGDMMGLFTIMKGLPLAYNKDLQEDKEGMFDTVKTVEGSLQIFTGMIQTMTVNKDVMKQATKQDFSNATELADYLAKKGMPFREAHEVVGKLVYTCIERGIYLSDMPFGEFQQASTLFEEDIYTVLDPYYAVEKRMSAGGTGFKQVEQALEKAKACVAAGVC

SEQ ID NO: 23246 - protein, 403 aa, Bacillus subtilis
MSEQKKVVLAYSGGLDTSVAIKWLQEQGYNVIACCLDVGEGKDLAFVQQKALEVGATNSYVIDAKEEFAQDYALISLQAHTMYEGKYPLVSALSRPLIAKKLVEIAEKEDAQAIAHGCTGKGNDQVRFEVSIKSLNPDLEVIAPVREWQWSREEEIEYAASRGIPIPINLDSPYSIDQNLWGRANECGILEDPWAAPPEGAYDLTAPLEKTPDTPEVIEIAFEQGVPVSIDGVSYSLSELILKLNEMAGAHGVGRIDHVENRLVGIKSREVYECPGAMTLIKAHKELEDLTLVKEVAHFKPIIEQKMSEIIYNGLWFSPLKDALHAFLKETQKHVTGIVRVKLFKGHAIVEGRKSEYSLYDEKLATYTKDDAFDHHAAIGFIELWGLPTKVNSIVKKKEQIKA

SEQ ID NO: 23247 - protein, 531 aa, Bacillus subtilis
MFVLKREDLIAPVQYNLVNEMEKFSAAGQKTALLWEDESGKQESWSYEKLMEETNKIGAALADLGFKKGDKLIVMVPRVLEAYAVYLAILKSGMVVIPCSEMLRAKDLEYRIEHAEVKGAIVYSEFIGAFRDVSTADKLITLSIGENDAGWKNLLSIEADGSQFKTADTTRDDMAFLSYTSGTTGQPKGVVHTHGWAFAHLKTSAGAWLDISEKDIVWATAAPGWQKWVWSPFLAVLGSGATGFVYHGRFKAEKYLELLNRYKINVFCCTPTEYRLMAKVEGLKRFDLSALHSAVSAGEPLNREVIDVFQKHFGIKVRDGYGQTESTLLVGVLKDTPIKPGSMGKPTPGNQVEIINEDGEICKPGEVGDIAVHLSTPALFKEYFKDPERMKTQIRGDYFLTGDRARKDEEGYFWFESRNDDIIISSGYTIGPFEVEDALVKHPEVKECAVVASPDEIRGSIVKAYVVLQNHEKRSDELVKMLQNHVKTITAPYKYPREIEFVESLPKTASAKIRRVELRKREEQLKANKKA

SEQ ID NO: 23248 - protein, 268 aa, Bacillus subtilis
MQKRDGHIHTPFCPHGSNDTLRQYAEEALKKGFESITFTEHAPLPPSFTDPTPLKDSAMAQASLERYIHEISGLKKEYRGQLSIRTGLEVDYIAEFEDEITLFLDTYGPYLDDSILSVHFLRTDSSYLCLDYDEHTFKELISACGSIEAVYEQYYRSIYSSIVASLGVYKPKRVGHITLVQKFIKLFPYSMSEHIRGLVSLCLNAIEENGMELDFNTSGLRKTYAGGIYIEDWMLNEAKQKKIPLVFGSDAHQAGDVGYAYEAFLERC

SEQ ID NO: 23249 - protein, 572 aa, Bacillus subtilis
MNLKALPAIEGDHNLKNYEETYRHFDWAEAEKHFSWHETGKLNAAYEAIDRHAESFRKNKVALYYKDAKRDEKYTFKEMKEESNRAGNVLRRYGNVEKGDRVFIFMPRSPELYFIMLGAIKIGAIAGPLFEAFMEGAVKDRLENSEAKVVVTTPELLERIPVDKLPHLQHVFVVGGEAESGTNIINYDEAAKQESTRLDIEWMDKKDGFLLHYTSGSTGTPKGVLHVHEAMIQQYQTGKWVLDLKEEDIYWCTADPGWVTGTVYGIFAPWLNGATNVIVGGRFSPESWYGTIEQLGVNVWYSAPTAFRMLMGAGDEMAAKYDLTSLRHVLSVGEPLNPEVIRWGHKVFNKRIHDTWWMTETGSQLICNYPCMDIKPGSMGKPIPGVEAAIVDNQGNELPPYRMGNLAIKKGWPSMMHTIWNNPEKYESYFMPGGWYVSGDSAYMDEEGYFWFQGRVDDVIMTSGERVGPFEVESKLVEHPAIAEAGVIGKPDPVRGEIIKAFIALREGFEPSDKLKEEIRLFVKQGLAAHAAPREIEFKDKLPKTRSGKIMRRVLKAWELNLPAGDLSTMED

SEQ ID NO: 23250 - protein, 387 aa, Bacillus subtilis
MRDSVFIYSPSYQTYMFHQEHPFNQQRVLLTYDLLKTINAFDDGDIVTPRLASEEELSLVHTDDYIQAVKLAGAGKLPAEEGESYGLGTEDTPVFAGMHEAASLLVGGTLTAADWVMSGQALHAANLGGGLHHGFRGRASGFCIYNDSAVAIQYIQKKYSARVLYIDTDAHHGDGVQFTFYDNPDVCTLSIHETGRYLFPGTGQIQEKGSGKGYGYSFNIPLDAFTEDDSFLEAYRTAASEVAAYFEPDVIISQNGADAHYYDPLTHLSATINIYEEIPRLAHTLAHQYCGGKWIAVGGGGYDIWRVVPRAWARIWLEMKGIDPGHEIPPEWIVKWQKQCPVALPSSWSDPADLYPPIPRKPEITEKNAQTVSKALYAIRSEQQRTK

SEQ ID NO: 23251 - protein, 358 aa, Bacillus subtilis
MSNTELELLRQKADELNLQILKLINERGNVVKEIGKAKEAQGVNRFDPVRERTMLNNIIENNDGPFENSTIQHIFKEIFKAGLELQEEDHSKALLVSRKKKPEDTIVDIKGEKIGDGQQRFIVGPCAVESYEQVAEVAAAAKKQGIKILRGGAFKPRTSPYDFQGLGVEGLQILKRVADEFDLAVISEIVTPAHIEEALDYIDVIQIGARNMQNFELLKAAGAVKKPVLLKRGLAATISEFINAAEYIMSQGNDQIILCERGIRTYETATRNTLDISAVPILKQETHLPVFVDVTHSTGRRDLLLPTAKAALAIGADGVMAEVHPDPSVALSDSAQQMAIPEFEKWLNELKPMVKVNA

SEQ ID NO: 23252 - protein, 566 aa, Bacillus subtilis
MKQFRVTNEGDIQTTLRGLEVLSVPFLNKGVAFTEEERKELGLKGFLPPKVLTIDDQAKRAYEQYSAQPDDLSKNVYLTALHDRNETLFYRLLNDHLGEMLPIVYTPTVGTAIQRYSHEYRKPRGLYLSIDDPDGMKEAFKQYKDQSDTIDLIVATDAEGILGIGDWGVGGIAISIGKLAVYTAAAGIDPSRVLAVVLDAGTNQESLLNDPLYVGNQHSRVRGERYDQFIDDYVALARETFPNALLHWEDFGAKNARSILKRYKDKVCTFNDDIQGTGAVSLAAVLSCAKASKVPLRDHRVVIFGAGTAGIGIAEQLREALVREGLSEEESYKRFWCIDRNGLLTDDMDQLLDFQKPYARSADEVKDYQRNGDGGGIDLLEVVRQAKPTILIGTSTVSGAFTEEIVKEMASHVKRPAILPMSNPTTLSEAKPEDLIEWTEGRALITTGSPFPPVEYNGVTYHIGQANNALVFPGLGLGTIVTKSKLITDGMFEACARAIAGMVNVGVPGAPMLPKVEDLRTVSATVAVEVAKTAMKEGVATEEPEDIIQAVQDAMWYPVYKPIRAI

SEQ ID NO: 23253 - protein, 718 aa, Bacillus subtilis
MVSIRRSFEAYVDDMNIITVLIPAEQKEIMTPPFRLETEITDFPLAVREEYSLEAKYKYVCVSDHPVTFGKIHCVRASSGHKTDLQIGAVIRTAAFDDEFYYDGELGAVYTADHTVFKVWAPAATSAAVKLSHPNKSGRTFQMTRLEKGVYAVTVTGDLHGYEYLFCICNNSEWMETVDQYAKAVTVNGEKGVVLRPDQMKWTAPLKPFSHPVDAVIYETHLRDFSIHENSGMINKGKYLALTETDTQTANGSSSGLAYVKELGVTHVELLPVNDFAGVDEEKPLDAYNWGYNPLHFFAPEGSYASNPHDPQTRKTELKQMINTLHQHGLRVILDVVFNHVYKRENSPFEKTVPGYFFRHDECGMPSNGTGVGNDIASERRMARKFIADCVVYWLEEYNVDGFRFDLLGILDIDTVLYMKEKATKAKPGILLFGEGWDLATPLPHEQKAALANAPRMPGIGFFNDMFRDAVKGNTFHLKATGFALGNGESAQAVMHGIAGSSGWKALAPIVPEPSQSINYVESHDNHTFWDKMSFALPQENDSRKRSRQRLAVAIILLAQGVPFIHSGQEFFRTKQGVENSYQSSDSINQLDWDRRETFKEDVHYIRRLISLRKAHPAFRLRSAADIQRHLECLTLKEHLIAYRLYDLDEVDEWKDIIVIHHASPDSVEWRLPNDIPYRLLCDPSGFQEDPTEIKKTVAVNGIGTVILYLASDLKSFA

SEQ ID NO: 23254 - protein, 236 aa, Bacillus subtilis
MTNLLEASIEQAGYTSRKKVLTDVFLEVRKGELVGLIGANGAGKSTAIKAILGLSEDFKGHIAWNDCSFAYIPEHPSFYEELTLWEHLDLISTLHGIEESEFAHRAQSLLQTFSLDHVKHELPVTFSKGMQQKLMLIQAFLSKPDMYVIDEPFIGLDPISTKRFVDMLKAEKERGAGILMCTHVLDTAEKICDRFYMIEKGSLFLQGTLKDVQDKTGLEGQSLLDCFYKAVQGDRL

SEQ ID NO: 23255 - protein, 389 aa, Bacillus subtilis
MKIDSWLNERLDRMKEAGVHRNLRSMDGAPVPERNIDGENQTVWSSNNYLGLASDRRLIDAAQTALQQFGTGSSGSRLTTGNSVWHEKLEKKIASFKLTEAALLFSSGYLANVGVLSSLPEKEDVILSDQLNHASMIDGCRLSKADTVVYRHIDMNDLENKLNETQRYQRRFIVTDGVFSMDGTIAPLDQIISLAKRYHAFVVVDDAHATGVLGDSGQGTSEYFGVCPDIVIGTLSKAVGAEGGFAAGSAVFIDFLLNHARTFIFQTAIPPASCAAAHEAFNIIEASREKRQLLFSYISMIRTSLKNMGYVVKGDHTPIIPVVIGDAHKTVLFAEKLQGKGIYAPAIRPPTVAPGESRIRITITSDHSMGDIDHLLQTFHSIGKELHII

SEQ ID NO: 23256 - protein, 448 aa, Bacillus subtilis
MTHDLIEKSKKHLWLPFTQMKDYDENPLIIESGTGIKVKDINGKEYYDGFSSVWLNVHGHRKKELDDAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECRDQCLRELAQLLEEHHEEIAALSIESMVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELSEMVAIMKQAIHEVTSLED

SEQ ID NO: 23257 - protein, 432 aa, Bacillus subtilis
MKKITFIGAGSTIFAKNVLGDCLLTEALNGFEFALYDIDPKRLQESQLMLENLRDRYNPSVAINSYDDRKLALQNAGYVINAIQVGGYKPSTVIDFEIPKRYGLRQTIADTVGIGGIFRSLRTIPVLFDIAKDMEEMCPDAWFLNYTNPMATLTGAMLRYTNIKTIGLCHSVQVCTKDLFKALGMEHDGIEERIAGINHMAWLLEVKKDGTDLYPEIKRRAKEKQKTKHHDMVRFELMDKFGYYVTESSEHNAEYHPYFIKRNYPELISELQIPLDEYPRRCVKQIENWEKMRDDIVNNKNLTHERSKEYGSRIIEAMETNEPFTFGGNVLNTGLITNLPSKAVVEVTCVADRKKITPCFAGELPEQLAALNRTNINTQLMTIEAAVTRKKEAVYQAAMLDPHTSAELSMKDIISMCDDLFAAHGDWLPEYK

SEQ ID NO: 23258 - protein, 463 aa, Bacillus subtilis
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 23259 - protein, 400 aa, Bacillus subtilis
MSKNRRLFTSESVTEGHPDKICDQISDSILDEILKKDPNARVACETSVTTGLVLVSGEITTSTYVDIPKTVRQTIKEIGYTRAKYGFDAETCAVLTSIDEQSADIAMGVDQALEAREGTMSDEEIEAIGAGDQGLMFGYACNETKELMPLPISLAHKLARRLSEVRKEDILPYLRPDGKTQVTVEYDENNKPVRIDAIVISTQHHPEITLEQIQRNIKEHVINPVVPEELIDEETKYFINPTGRFVIGGPQGDAGLTGRKIIVDTYGGYARHGGGAFSGKDATKVDRSAAYAARYVAKNIVAAELADSCEVQLAYAIGVAQPVSISINTFGSGKASEEKLIEVVRNNFDLRPAGIIKMLDLRRPIYKQTAAYGHFGRHDVDLPWERTDKAEQLRKEALGE

SEQ ID NO: 23260 - protein, 527 aa, Bacillus subtilis
MNSVDLTADLQALLTCPNVRHNLSAAQLTEKVLSRNEGILTSTGAVRATTGAYTGRSPKDKFIVEEESTKNKIDWGPVNQPISEEAFERLYTKVVSYLKERDELFVFEGFAGADEKYRLPITVVNEFAWHNLFARQLFIRPEGNDKKTVEQPFTILSAPHFKADPKTDGTHSETFIIVSFEKRTILIGGTEYAGEMKKSIFSIMNFLLPERDILSMHCSANVGEKGDVALFFGLSGTGKTTLSADADRKLIGDDEHGWSDTGVFNIEGGCYAKCIHLSEEKEPQIFNAIRFGSVLENVVVDEDTREANYDDSFYTENTRAAYPIHMINNIVTPSMAGHPSAIVFLTADAFGVLPPISKLTKEQVMYHFLSGYTSKLAGTERGVTSPETTFSTCFGSPFLPLPAHVYAEMLGKKIDEHGADVFLVNTGWTGGGYGTGERMKLSYTRAMVKAAIEGKLEDAEMITDDIFGLHIPAHVPGVPDHILQPENTWTNKEEYKEKAVYLANEFKENFKKFAHTDAIAQAGGPLV

SEQ ID NO: 23261 - protein, 486 aa, Bacillus subtilis
MLTEQPNWLMQRAQLTPERIALIYEDQTVTFAELFAASKRMAEQLAAHSVRKGDTAAILLQNRAEMVYAVHACFLLGVKAVLLNTKLSTHERLFQLEDSGSGFLLTDSSFEKKEYEHIVQTIDVDELMKEAAEEIEIEAYMQMDATATLMYTSGTTGKPKGVQQTFGNHYFSAVSSALNLGITEQDRWLIALPLFHISGLSALFKSVIYGMTVVLHQRFSVSDVLHSINRHEVTMISAVQTMLASLLEETNRCPESIRCILLGGGPAPLPLLEECREKGFPVFQSYGMTETCSQIVTLSPEFSMEKLGSAGKPLFSCEIKIERDGQVCEPYEHGEIMVKGPNVMKSYFNRESANEASFQNGWLKTGDLGYLDNEGFLYVLDRRSDLIISGGENIYPAEVESVLLSHPAVAEAGVSGAEDKKWGKVPHAYLVLHKPVSAGELTDYCKERLAKYKIPAKFFVLDRLPRNASNKLLRNQLKDARKGELL

SEQ ID NO: 23262 - protein, 272 aa, Bacillus subtilis
MIKKAIIPAGGFGTRNLPVTKVIPKEMFPVGSKPVIHYLVEELKESGIEDILMVVSSHKNLIVDYFDSSLALEAFLASKNKLHLLREHPIPDIRIHYVRQPYAKGLGDAISFGKQFAGGEPFAVVLPDDLIFSANQPALGQLIEAYTKYQSSVIGLKETKTEDLHHYGVIKGEPVEKGLYRIQDIVEKPKQNPPSHFAAAGRYIFTPDIFNELEALEADSGGEVQVTDAIKASLGACTVYGKLLEGERYDIGLQKDYLKLIYDMLKTEKNPQ

SEQ ID NO: 23263 - protein, 428 aa, Bacillus subtilis
MKICVVGAGYVGLTLSAALASIGHDMICTDKDVKKIGQLKKGVIPFYEPGLSDAILRCGNLSFSSEVKSSMEECPVIFIAVGTPPRSDGSADTKALQSVIGDLSEAIRSYKTIITKSTVPPGTNENIAKQLIASGVSKNLFNIVSNPEFLREGNALYDMLHPDKTVIGVQEEDHVSAAIVKSIYKHIDTPFIVTSLAGAELIKYANNFFLAAKISFINEMARICEAYQSDISDISRAIGLDPRIGKHFLQAGIGYGGSCFPKDLQALQFAAQEKNTETFLLRAVQHINDTQLGLYIKKIQSFFETLQGKKAAVLGISFKPNTDDIRNSQAVRLMERLAELGCDVHAYDPEAVLPEHLRQHVTQHSQAFDAIEESDFLFLATEWSEFLAFDWKKAADIMKGRLVIDGRNVLKKELIEACGLICTGVGRP

SEQ ID NO: 23264 - protein, 316 aa, Bacillus subtilis
MKILVTGAAGFIGSHLCEELLKDKKHNVIGIDDFIGPTPFSLKLKNLKNLLPEKRFTFIKENLLTADLASLLEGVDVIFHLAAIPGVRSSWGNHFHPYAAHNIQALQRLLEACREHSIQTFVFASTSSVYGEKQGKVSENTSLSPLSPYGVTKLTGEKLCHVYKQSFGIPIVILRFFTVYGPRQRPDMAFHRLIKQHLQQKPLTIFGDGQQSRDFTYISDCVKGITAVLGKPHLIGETVNIGGAERASVLKVVSLIEDISGRKATLHFSDKIAGEPSNTWADISKAKQLLHYDPATSLKDGLTNEIAYLSSLYQGE

SEQ ID NO: 23265 - protein, 798 aa, Bacillus subtilis
MFSSKERFADLFLKRLEMTCGKSFKDSAKLDQYKTLGNMVREYISADWIETNEKSRSNSGKQTYYLSIEFLLGQLLEQNLMNLGVRDVVEAGLKEIGINLEEILQIENDAGLGNGGLGRLAACFLDSLASLNLPGHGMGIRYKHGLFEQKIVDGHQVELPEQWLKNGNVWEVRNADQAVDVPFWGEVHMTEKSGRLHFRHEQATIVTAVPYDIPIIGYETGTVNTLRLWNAEPYAHYHGGNILSYKRETEAVSEFLYPDDTHDEGKILRLKQQYFLVCASLKSIVNNYRKTHKSLSGLHKKVSIHINDTHPALAVPELMRILLDEENMSWEEAWHITVHTISYTNHTTLSEALEKWPIHLFKPLLPRMYMIIEEINERFCRAVWEKYPGDWKRIENMAITAHGVVKMAHLAIVGSYSVNGVAKIHSDILKEREMRDFHLLFPNRFNNKTNGIAHRRWLLKANPGLSAIITEAIGDEWVKQPESLIRLEPYATDPAFIEQFQNNKSKKKQELADLIFCTAGVVVNPESIFDVQVKRLHAYKRQLLNVLHIMYLYNRLKEDSGFSIYPQTFIFGAKASPSYYYAKKIIKLIHSVAEKVNYDPAVKQLIKVVFLENYRVSMAERIFPASDVSEQISTASKEASGTGNMKFMMNGALTIGTHDGANIEILERVGPDCIYTFGLKADEVLSYQENGGYRSREYYQHDRRIRQVADQLINGFFEGEADEFESIFDSLLPHNDEYFVLKDFSSYADAQERIQADYRERRKWSEHSIVNIAHSGYFSSDRTIREYAKDIWGIKPMM

SEQ ID NO: 23266 - protein, 484 aa, Bacillus subtilis
MKILFAVSECTPFVKSGGLADVAGALPKALARLGNEVAVMLPKYSQIPEPWKKRMKKQAECTVAVGWRQQYCGIEHMAENDVNYYFIDNEYYFNRDSLYGHYDDGERFAFFSRAVLEAAKVVNVQADIVHTHDWHTAMVNYLLKEEYRKHPFYERMKSVLTIHNLQFQGIFPPDVTHDLLGLEMDHFHYERLECNGFVNFMKAGIIAADHVTTVSPTYRNEIMTPYYGEQLEQVLQYREDDVTGILNGIDDTFYQPKSDPYIEAQYDSGDLACKLENKTKLQQRMGLPEKNDIPLISMVTRLTKQKGLDLVRRIMHELLEEQDIQLVVLGTGEREFEDYFRYAEFAFHEKCRAYIGFDEPLAHQIYAGSDMFLMPSKFEPCGLGQLIALQYGAIPIVRETGGLYDTVRAYQEEEGTGNGFTFSAFNAHDLKFTIERALSFYCQQDVWKSIVKTAMNADYSWGKSAKEYQRIFEQVTRSGRDVLE

SEQ ID NO: 23267 - protein, 380 aa, Bacillus subtilis
MKKQCVAMLLAGGKGSRLSGLTKNMAKPAVSFGGKYRIIDFTLSNCSNSGIDTVGILTQYQPLELNSYIGIGSAWDLDRYNGGVTVLPPYAESSEVKWYKGTASSIYENLNYLNQYDPEYVLILSGDHIYKMDYGKMLDYHIEKKADVTISVIEVGWEEASRFGIMKANPDGTITHFDEKPKFPKSNLASMGIYIFNWPLLKQYLEMDDQNPYSSHDFGKDIIPLLLEEKKKLSAYPFKGYWKDVGTVQSLWEANMDLLKEDSELKLFERKWKIYSVNPNQPPQFISSDAQVQDSLVNEGCVVYGNVSHSVLFQGVTVGKHTTVTSSVIMPDVTIGEHVVIENAIVPNGMVLPDGAVIRSEKDIEEVLLVSEEFVEKELI

SEQ ID NO: 23268 - protein, 627 aa, Bacillus subtilis
MAAASPTAHDVYLFHEGSLFKSYQLFGSHYRELNGKSGYEFCVWAPHASEVRVAGDFNSWSGEEHVMHRVNDNGIWTLFIPGIGEKERYKYEIVTNNGEIRLKADPYAIYSEVRPNTASLTYDLEGYSWQDQKWQKKQKAKTLYEKPVFIYELHLGSWKKHSDGRHYSYKELSQTLIPYIKKHGFTHIELLPVYEHPYDRSWGYQGTGYYSPTSRFGPPHDLMKFVDECHQQNIGVILDWVPGHFCKDAHGLYMFDGEPLYEYKEERDRENWLWGTANFDLGKPEVHSFLISNALYWAEFYHIDGFRVDAVANILYWPNQDERHTNPYAVDFLKKLNQTMREAYPHVMMIAEDSTEWPQVTGAVEEGGLGFHYKWNMGWMNDVLKYMETPPEERRHCHQLISFSLLYAFSEHFVLPFSHDEVVYGKKSLLNKMPGDYWQKFAQYRLLLGYMTVHPGKKLIFMGSEFAQFDEWKDTEQLDWFLDSFPMHQKASVFTQDLLRFYQKSKILYEHDHRAQSFEWIDVHNDEQSIFSFIRYGQKHGEALVIICNFTPVVYHQYDVGVPFFTQYIEVLNSDSETYGGSGQINKKPLSAKKGALHHKPCYITMTIPPYGISILRAVKKRGEIKR

SEQ ID NO: 23269 - protein, 403 aa, Bacillus subtilis
MMTLNMKVESMQKFHTFEIPTVIKHGIGAIKHTGEEVAALGVSKALLVTDPGIYKAGVADPVIESLKEAGIEVVLFNKVEPNPPVRLVNEGSELYKKENCNGLVAVGGGSSMDTAKAIGVEATHEGSVLDYEAADGKKPLENRIPPLTTIPTTAGTGSEVTQWAVITDEEREFKFNTGGPLIAAHLTIIDPELHVSMPPHVTAMTGIDALAHAIECYTMKFAQPITDAVALMAIEYAAHYIKRAFADGEDLEARYGMAQAAMLAGLSYGSESAGAAHAMSQTLGGIIPVAHGQCVAAMMGPVMEYNWKGYPEKFARIAKAFGIDTSKMTTEEAAKASVNWMYDLVEDLEVPTLEEQGVSPDMIERLSKEAMKDPQTFGNPRDLNEKAYNWIYKRCFNLTPKTV

SEQ ID NO: 23270 - protein, 490 aa, Bacillus subtilis
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGNTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAGQVCSAGSRLLVEDAIHDQFLAELVKRAKRIKLGNGFHAETESGPLISAEHRAKVEKYVEIGIEEGAKLETGGKRPEDPELQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 23271 - protein, 485 aa, Bacillus subtilis
MIYTAIDVGASSGRIMVGELNEGKLDIQEIHRFANGFSQRDGHCLWDIDHLLKQILQGLQKVKTLGYEHCTVGIDTWAVDYVLLDEKGDRLREAISYRDRRTDHTIDKLEHTLSKAAIYQKTGIQFQPFNTIYQLFEEDRELLKKTDKIMMIPDYLGYCLTGKAVTEITNVSTTQLLNVSTGNLDPELLEAVSVLEQQFAPLTEPGCELGKLRNEWFPDYDLPACKVMTVATHDTASAVIAAPGVNDGWAYISSGTWSLIGVENKTPIITDLALENNYTNERGANNTIRFLKNIIGMWVIQEVKQQLQADYSFQQLAEEAKKTEPFQQFINLNDKRFLNPENMIKEIQHYCRQTRQKIPRTAGELACCIYSNLAIIYAIAIKELETITEKPIEQFHIIGGGARNDFLNQLTADMSGKAVYAGPIEATATGNLLMQMIAAKEVKDIKEARQVVRNSFPIKVFTPKDIDRSTIIQSFQQTVLKALSK

SEQ ID NO: 23272 - protein, 554 aa, Bacillus subtilis
MKKAWWKEAVVYQIYPRSFKDSNGDGIGDIQGIRTKLSYIKELGADVIWICPLYDSPNADNGYDIRDYQNILSEFGTMEDFDELLGDIHDLDMKLIMDLVVNHTSDEHPWFIESRSSIHSEKRDWYIWKDGKNGKTPNNWESIFGGPAWEYDQKTSQYYLHLFDKKQPDLNWENEKVRNAVYDMINWWLDKGIDGFRVDAITHIKKKEGFPDMPNPKGLDYVPSFPYHMNADGIMDLLTELKENTFSRYPIMTVGEANGVAPKEAADWAGEKNGIFSMIFQFEHLGLWDVEINESIDIVAFKRILTDWQDSLEGIGWNALFMENHDQPRSVSVWGDDGVYLKESAKALSAVYFLMKGTPFIYQGQELGMTNVAFPSIEDYDDVALKRLYETKTAKGTSHEDVMKIVWKKGRDNSRTPMQWNAGPYAGFSEAKPWIGINENYKWLNAEAQKNDKTSVYHFYKSLIKLRQTYDVFINGTYELILPEDQQIFAYLRKNESHTALIAANLTGTPALFRHSGLPLSSDALVLSNIETEPHKHMTSVLLKPYEARIYLWC

SEQ ID NO: 23273 - protein, 390 aa, Bacillus subtilis
MENFTYYNPTKLIFGKGQLEQLRKEFKRYGKNVLLVYGGGSIKRNGLYDQVTGILKEEGAVVHELSGVEPNPRLATVEKGIGLCREHDIDFLLAVGGGSVIDCTKAIAAGVKYDGDAWDIFSKKVTAEDALPFGTVLTLAATGSEMNPDSVITNWETNEKFVWGSNVTHPRFSILDPENTFTVPENQTVYGMVDMMSHVFEQYFHNVENTPLQDRMCFAVLQTVIETAPKLLEDLENYELRETILYAGTIALNGTLQMGYFGDWASHTMEHAVSAVYDIPHAGGLAILFPNWMRYTLDTNVGRFKNLMLNMFDIDTEGKTDKEIALEGIDKLSAFWTSLGAPSRLADYNIGEEKLELIADIAAKEMEHGGFGNFQKLNKDDVLAILRASL

SEQ ID NO: 23274 - protein, 387 aa, Bacillus subtilis
MQNFTYWNPTKLIFGRGEVERLPEELKPYGKNVLLVYGGGSIKRSGLYDQVIEQLNKAGATVHELAGVEPNPRVSTVNKGVAICKEQNIDFLLAVGGGSVIDCTKAIAAGAKYDGDAWDIVTKKHQPKDALPFGTVLTLAATGSEMNSGSVITNWETKEKYGWGSPLVFPKFSILDPVNTFTVPKNHTIYGMVDMMSHVFEQYFHHVSNTPYQDRMCESLLRTVIETAPKLINDLENYELRETILYTGTIALNGMLSMGARGDWATHNIEHAVSAVYDIPHAGGLAILFPNWMRHTLSENPARMKQLAVRVFDVEEAGKTDEEIALEGIDKLSAFWTSLGAPNRLADYDINDEQLDTIADKAMANGTFGQFKSLNKEDVLSILKASL

SEQ ID NO: 23275 - protein, 243 aa, Bacillus subtilis
MELYIITGASKGLGQAIALQALEKGHEVHALSRTKTDVSHKKLTQHQIDLINLEEAEQQFETLLSSIDSDRYSGITLINNAGMVTPIKRAGEASLDELQRHYQLNLTAPVLLSQLFTKRFASYSGKKTVVNITSGAAKNPYKGWSAYCSSKAGLDMFTRTFGFEQEDEELPVNMISFSPGVMDTEMQAVIRSSSKKDFHHIERFRKLNETGSLRSPDFIAGTLLSLLEKGTENGRIYDIKEFL

SEQ ID NO: 23276 - protein, 539 aa, Bacillus subtilis
MLKGFTPWPDELAETYRKNGCWAGETFGDLLRDRAAKYGDRIAITCGNTHWSYRELDTRADRLAAGFQKLGIQQMDRVVVQLPNIKEFFEVIFALFRLGALPVFALPSHRSSEITYFCEFAEAAAYIIPDAYSGFDYRSLARQVQSKLPTLKNIIVAGEAEEFLPLEDLHAEPVKLPEVKSSDVAFLQLSGGSTGLSKLIPRTHDDYIYSLKRSVEVCWLDHSTVYLAALPMAHNYPLSSPGVLGVLYAGGRVVLSPSPSPDDAFPLIEREKVTITALVPPLAMVWMDAASSRRDDLSSLQVLQVGGAKFSAEAARRVKAVFGCTLQQVFGMAEGLVNYTRLDDPEEIIVNTQGKPMSPYDEMRVWDDHDRDVKPGETGHLLTRGPYTIRGYYKAEEHNAASFTEDGFYRTGDIVRLTRDGYIVVEGRAKDQINRGGEKVAAEEVENHLLAHPAVHDAAMVSMPDQFLGERSCVFIIPRDEAPKAAELKAFLRERGLAAYKIPDRVEFVESFPQTGVGKVSKKALREAISEKLLAGFKK

SEQ ID NO: 23277 - protein, 261 aa, Bacillus subtilis
MNAKGIEGKIAFITGAAQGIGEAVARTLASQGAHIAAVDYNPEKLEKVVSSLKAEARHAEAFPADVRDSAAIDEITARIEREMGPIDILVNVAGVLRPGLIHSLSDEEWEATFSVNSTGVFNASRSVSKYMMDRRSGSIVTVGSNPAGVPRTSMAAYASSKAAAVMFTKCLGLELAEYNIRCNIVSPGSTETDMQWSLWADENGAEQVIKGSLETFKTGIPLKKLAKPSDIADAVLFLVSGQAGHITMHNLCVDGGATLGV

SEQ ID NO: 23278 - protein, 284 aa, Bacillus subtilis
MNSFRFTKMHGLGNSYIYVNQFEEQLPEEKLSEIAIQVSSVYTGIGSDGMILICPSDQAPVKMRIFNNDGSEGKNCGNGLRCVAKYAYEHKLVEETSFLIETLSGLVKAEVQVENGKVNVVTVDMGEPRLTKSELPMLDGGEEHTINETMAFGEVELTGTAVSMGNPHIVFPIADIEQAPLTTLGPVIEKDPRFPEGINVEFVETVNEQELHFRVWERGSGITQACGTGACAAAVASVLNGVSKRNQDITVHLAGGDLVINWKDNGHVMMTGPAETVCEGVYFL

SEQ ID NO: 23279 - protein, 352 aa, Bacillus subtilis
MWKGLIHQYKEFLPVTDQTPALTLHEGNTPLIHLPKLSEQLGIELHVKTEGVNPTGSFKDRGMVMAVAKAKEEGNDTIMCASTGNTSAAAAAYAARANMKCIVIIPNGKIAFGKLAQAVMYGAEIIAIDGNFDDALKIVRSICEKSPIALVNSVNPYRIEGQKTAAFEVCEQLGEAPDVLAIPVGNAGNITAYWKGFKEYHEKNGTGLPKMRGFEAEGAAAIVRNEVIENPETIATAIRIGNPASWDKAVKAAEESNGKIDEVTDDEILHAYQLIARVEGVFAEPGSCASIAGVLKQVKSGEIPKGSKVVAVLTGNGLKDPNTAVDISEIKPVTLPTDEDSILEYVKGAARV

SEQ ID NO: 23280 - protein, 433 aa, Bacillus subtilis
MKAIRVGLLGLGTVGSGVVKIIQDHQDKLMHQVGCPVTIKKVLVKDLEKKREVDLPKEVLTTEVYDVIDDPDVDVVIEVIGGVEQTKQYLVDALRSKKHVVTANKDLMAVYGSELLAEAKENGCDIYFEASVAGGIPILRTLEEGLSSDRITKMMGIVNGTTNFILTKMIKEKSPYEEVLKEAQDLGFAEADPTSDVEGLDAARKMAILARLGFSMNVDLEDVKVKGISQITDEDISFSKRLGYTMKLIGIAQRDGSKIEVSVQPTLLPDHHPLSAVHNEFNAVYVYGEAVGETMFYGPGAGSMPTATSVVSDLVAVMKNMRLGVTGNSFVGPQYEKNMKSPSDIYAQQFLRIHVKDEVGSFSKITSVFSERGVSFEKILQLPIKGHDELAEIVIVTHHTSEADFSDILQNLNDLEVVQEVKSTYRVEGNGWS

SEQ ID NO: 23281 - protein, 462 aa, Bacillus subtilis
MKEKLRLYHTNDLHSHFENWPKIVDYIEQKRKEHQSDGEETLVFDIGDHLDRFQFVTEATFGKANVDLLNRLHIDGAAIGNNEGITLPHEELAALYDHAEFPVIVSNLFDKNGNRPSWAVPYHIKSLKNGMSIAFLGVTVPYYPVYDKLGWTVTDALESIKETILEVKGQADIIVLLSHLGILDDQAVAEAVPEIDVILESHTHHLLEDGQVVNGVLLASAEKYGHYVGCVEITVDSVQRSINSKTASVQNMAEWTGESAETKAFLNEKEREAEEKLSDAVAELAQDAEVKWFEESELPLLLAYALKEWCETDISMVNSGVILGPLKAGPVTKLDLHRICPHPINPVAVRLTGEELKETIVHAASEQMEQLRIKGLGFRGEVMGKMVYAGVEVETKRLDDGITHVTRITLNGEDIEKHKQYSVAVLDMFTLGKLFPLIRDAAEKEYFMPEFLRDLLAWKLAQ

SEQ ID NO: 23282 - protein, 284 aa, Bacillus subtilis
MKLIAVGDNVVDYYQDQETFYPGGNALNVAVLAKRLGHESSYIGIVGNDEAAAHLLNVLKLEQVNADYIRQAHGENGMAIVTLDEQGDRIFVRSNKGGIQSRLRLAFQEKDVSFISGHDLLHTSVYSRLENDLPQLCGLVPVSFDFSTNREDDYLRRVCPYVTYAFFSGSDLSESECGELAKTAHGYGAKMVCMTRGGQGAILSAGDRVYHQPIVEADIIDTLGAGDSFIAGFLTAFCVKQDITYALRQAAETAAKTCGVYGAFGYGYPYRLEDGGSSEKTRIL

SEQ ID NO: 23283 - protein, 341 aa, Bacillus subtilis
MINLQDVSKVYKSKHGDVNAVQNVSLSIKKGEIFGIIGYSGAGKSSLIRLLNGLEKPTSGTVEVAGTKINEVNGRGLRKARHEISMIFQHFNLLWSRTVRDNIMFPLEIAGVKKSERIKRANELIKLVGLEGKEKSYPSQLSGGQKQRVGIARALANNPKVLLCDEATSALDPQTTDSILDLLSDINERLGLTIVLITHEMHVIRKICNRVAVMENGKVVEEGEVLDVFKNPKEQMTKRFVQQVTEPEETKETLQHLLDDTASGKMVQLTFVGESAEQPLITEMIRNFNVSVNILQGKISQTKDGAYGSLFIHIDGDEEEVQNVIRFINDKQVKAEVITNV

SEQ ID NO: 23284 - protein, 127 aa, Bacillus subtilis
MSIPKDLRYSGEHEWVKVEGEKARIGITHFAQSELGDIVFVELPEVGAEIKADEPFGSVESVKTVSELYAPINGTVVEVNEDLDDSPEFVNESPYEKAWMIVVEPSDASEIEKLMTAEQYEEMTQED

SEQ ID NO: 23285 - protein, 594 aa, Bacillus subtilis
MAKKAADVQKGGGFLIEDVTYDQMYTPEDFTDEHKMIAKTTEDYIEQDVLPHIDDIENHQFEHSVRLLKKAGELGLLGADVPEEYGGLGLDKISSALITEKFSRAGSFSLSYGAHVGIGSLPIVFFGSEEQKKKYLPGLASGEKIAAYALTEPGSGSDALGAKTTAVLNEAGTHYVLTGEKQWITNSAFADVFVVYAKVDGDKFSAFIVEKEFPGVSTGPEEKKMGIKGSSTRTLILDQAEVPKENLLGEIGKGHVIAFNILNIGRYKLAVGTIGASKRVIELSAAYANQRRQFKTPIAGFSLTQEKIGTMASRLYAMESSVYRTVGLFEDNMSQFTAEDLKDGRQIAKSIAEYAIECSLNKVFGSETLDYIVDEGVQIHGGYGFMQEYEVERAYRDSRINRIFEGTNEINRLIVPSTFLKKALKGELPLFEKAQSLQEELMMLMPEEPGSGVLEQEKYIVKQAKKIALFAAGLAAQKYGKAIDREQEILVNVADIVSNVYAMESAVLRTEKAIAAQGAEKAAQKVLYTEIFVQEAFNEIEAHAKESLIAMEEGDSLRMMLSALRKLTRVTPKNVIQKKREAAAGIFEAEKYTV

SEQ ID NO: 23286 - protein, 391 aa, Bacillus subtilis
MKEAVIVSGARTPVGKAKKGSLATVRPDDLGAICVKETLKRAGGYEGNIDDLIIGCATPEAEQGLNMARNIGALAGLPYTVPAITVNRYCSSGLQSIAYAAEKIMLGAYDTAIAGGAESMSQVPMMGHVTRPNLALAEKAPEYYMSMGHTAEQVAKKYGVSREDQDAFAVRSHQNAAKALAEGKFKDEIVPVEVTVTEIGEDHKPMEKQFVFSQDEGVRPQTTADILSTLRPAFSVDGTVTAGNSSQTSDGAAAVMLMDREKADALGLAPLVKFRSFAVGGVPPEVMGIGPVEAIPRALKLAGLQLQDIGLFELNEAFASQAIQVIRELGIDEEKVNVNGGAIALGHPLGCTGTKLTLSLIHEMKRRNEQFGVVTMCIGGGMGAAGVFELC

SEQ ID NO: 23287 - protein, 280 aa, Bacillus subtilis
MNKKIAIVTGASSGFGLLAAVKLARSFFVIATSRQPEKAEQLRELAAAHNVSDSIHITALDVTDEQSIVSFGKAVSAYAPIDLLVNNAGTAYGGFIEDVPMEHFRQQFETNVFGVIHVTKTVLPYIRKHGGAKIINVSSISGLTGFPALSPYVSSKHALEGFSESLRIELLPFGIETALIEPGSYKTSIWSTSLSNFMSVPADDSAYHQYYKKILSYVQKNGEESGDPQEVADLIYQLATKQHIKNLRYPIGKGIKLTLLFRSLFPWSAWESILKKKLFS

SEQ ID NO: 23288 - protein, 462 aa, Bacillus subtilis
MEYRIERDTMGEVKVPADKFWGAQTQRSKENFKIGSEKMPMRVVKAFAILKRSTALANKRLGNLDAEKAEAIAAVCDDVLKGKYDDNFPLVVWQTGSGTQSNMNMNEVVANRATALLKEKNSDQTIHPNDDVNRSQSSNDTFPTAMHVAAVLAVYEQLVPALDQLRNTLDEKAKAYNDIVKIGRTHLQDATPLTLGQEISGWVHMLDRSKEMILEATDKMRALAIGGTAVGTGINAHPEFGELVSEEITKLTGQTFSSSPNKFHALTSHDEITYAHGALKALAADLMKIANDVRWLASGPRCGIGEIVIPENEPGSSIMPGKVNPTQSEALTMIAAQIMGNDATIGFAASQGNFELNVFKPVIIYNFLQSVQLLSDGMNSFHDKCAVGIEPNKETIQENLSNSLMLVTALNPHIGYENAAKIAKLAHKEGLTLKEAALKLELLTEEQFNEMVKPEDMVKPKA

SEQ ID NO: 23289 - protein, 263 aa, Bacillus subtilis
MDLQLKEKLVLITGSTSGIGKAAAKSFLQEGAAVIVNGRKQETVDRTIEELSGYGTVHGAAADLSKTDEAAAFIEKVNEIGDIDILVNNLGFFEVKDFADVTDEEWNQYFEVNVMSAVRTSRHFLPKMLAKNSGRILNIASEAGVKPLPTMIPYSMTKTALISLSRGMAEMTKGTNVTVNSVLPGPTWTEGVASYMEGAAQAAGQDTDTFIKDYFKVNEPTSLIQRYATAEEVANTIVFLASDAASAINGTAQRVEGGIIRSL

SEQ ID NO: 23290 - protein, 292 aa, Bacillus subtilis
MDAVLEADTRAVIGEGPLWDEENGRLYWVDILGSELHIFDPEEKINRSIKFKSFVTALAKYSKDELIMTMKDGFYLYHLRDDSLEKIKQPKDMHESLRFNDAKCDPYGRLWAGTTSMEGEQKQASLYRLNLDGSLVKIKDQVSTSNGLDWDRERNLMYYIDTPTQEIVRYSYDPQSGDVSNPEPVYRFDQSDGLPDGMTIDQNGMLWVALFGGSRVVHIDPFQKKEINSISVPAKYVTCCAFGGRDLKTLYITTATEQMTEKERYEQPHAGGLFSAQLETGGYQPVPFAGDV

SEQ ID NO: 23291 - protein, 469 aa, Bacillus subtilis
MEQTKKWGFWLLTAFVVGNMVGSGIFSLPSSLASIASPFGATSAWLLTGAGVLMIALVFGHLSIRKPELTAGPQSYARALFSDPKKGNAAGFTMVWGYWVASWISNVAIITSLAGYLTSFFPILVDKREMFSIGGQEVTLGQLLTFAVCTILLWGTHAILVASINGASKLNFVTTLSKVLGFVFFIVAGLFVFQTSLFGHFYFPVQGENGTSIGIGGQVHNAAISTLWAFVGIESAVILSGRARSQRDVKRATITGLLIALSIYIIVTLITMGVLPHDKLVGSEKPFVDVLYAIVGNAGSVIMALLAILCLFGTMLGWILLGSEVPYQAAKAGDFPAFFAKTNKKGSPVIALIITNVMSQVFIFSVISRTISDAFTFLTTAATLAYLIPYLVSAIYSLKVVIKGETYDQLKGSRVRDGLIAILACAYSVFVIVTGTADLTTFILGIGLFFVGLIVYPFVSNKFQKEKQA

SEQ ID NO: 23292 - protein, 276 aa, Bacillus subtilis
MPTSLKDTVKLHNGVEMPWFGLGVFKVENGNEATESVKAAIKNGYRSIDTAAIYKNEEGVGIGIKESGVAREELFITSKVWNEDQGYETTLAAFEKSLERLQLDYLDLYLIHWPGKDKYKDTWRALEKLYKDGKIRAIGVSNFQVHHLEELLKDAEIKPMVNQVEFHPRLTQKELRDYCKGQGIQLEAWSPLMQGQLLDNEVLTQIAEKHNKSVAQVILRWDLQHGVVTIPKSIKEHRIIENADIFDFELSQEDMDKIDALNKDERVGPNPDELLF

SEQ ID NO: 23293 - protein, 571 aa, Bacillus subtilis
MVTKILKAPDGSPSDVERIKKESDYLRGTLKEVMLDRISAGIPDDDNRLMKHHGSYLQDDRDLRNERQKQKLEPAYQFMLRVRMPGGVSTPEQWLVMDDLSQKYGNGTLKLTTRETFQMHGILKWNMKKTIQTIHSALLDTIAACGDVNRNVMCASNPYQSEIHSEVYEWSKKLSDDLLPRTRAYHEIWLDEERVAGTPEEEVEPMYGPLYLPRKFKIGIAVPPSNDIDVFSQDLGFIAIVEDGKLIGFNVAIGGGMGMTHGDTATYPQLAKVIGFCRPEQMYDVAEKTITIQRDYGNRSVRKNARFKYTVDRLGLENVKEELENRLGWSLEEAKPYHFDHNGDRYGWVEGIEDKWHFTLFVEGGRITDYDDYKLMTGLREIAKVHTGEFRLTANQNLMIANVSSDKKEEISALIEQYGLTDGKHYSALRRSSMACVALPTCGLAMAEAERYLPTLLDKIEEIIDENGLRDQEITIRMTGCPNGCARHALGEIGFIGKAPGKYNMYLGAAFDGSRLSKMYRENIGEADILSELRILLSRYAKEREEGEHFGDFVIRAGIIKATTDGTNFHD

SEQ ID NO: 23294 - protein, 702 aa, Bacillus subtilis
MRLVKQEYVLDGLDCSNCARKIENGVKGIKGINGCAVNFAASTLTVSADGKEEQWVTNKVEKKVKSIDPHVTVRQKHIKKSADDGYRNRMVNMLIRMAAAVILGAAAYLVQSGTIEFFLFLGAYLIIGGDIIIRAVKNIIRGQVFDEHFLMALATIGAFLIQQYPEGVAVMLFYQIGELFQGAAVSRSRKSISALMDIRPDYANLKTKNGIEQVSSEDVQTGDIIVVNPGESIPLDGKVVQGSAMVDTSALTGESVPRKAAEGQDVMSGFINQNGVLHIEVTKGYQESAVSKILDLVQNASSRKARTENFITKFAKYYTPAVVIIAVLLAFVPPLVLSGAALSDWVYRALIFLVISCPCALVVSIPLGFFGGIGAASKAGVLVKGSNYLEALNQVKYAVFDKTGTLTKGSFEVTEIKPAEGFTKDRLLEAAAYAELHSQHPIAESVRKAYGKMLSSDEIESYEEISGHGIFAKVNGTEILAGNKKLMEREQIEDVPDENAGTIVHVAVDQRYAGAIIIADEIKEDAAQAVADLKSLGIKQTAMLTGDSKQTGEAVGKQLGIGEVYAELLPQDKVAQVEALEAKLLPSEKLIFVGDGINDTPVLARADIGVAMGGLGSDAAVEAADIVLMTDQPSKIAEAIRIAKRTRRIVWQNIGFALGVKAIFLILGAFGIATMWEAVFSDVGVTLLAVANAMRVMRLKNK

SEQ ID NO: 23295 - protein, 803 aa, Bacillus subtilis
MLSEQKEIAMQVSGMTCAACAARIEKGLKRMPGVTDANVNLATETSNVIYDPAETGTAAIQEKIEKLGYHVVTEKAEFDIEGMTCAACANRIEKRLNKIEGVANAPVNFALETVTVEYNPKEASVSDLKEAVDKLGYKLKLKGEQDSEAAAKKKEERKQTARLIFSAVLSFPLLWAMVSHFTFTSFIWVPDIFLNPWMQFALATPVQFLIGWPFYVGAYKALRNKSANMDVLVALGTTAAYAYSLYLTFQSIGSHGHTDGLYYETSAILLTLILLGKLFETKAKGRSSDAIKKLMKLQAKTATVVRDGQEQIIPIDEVLVNDIVYVKPGERIPVDGEVVEGRSAVDESMITGESLPVDKNPGDSVTGSTVNANGFLKIKAVNVGKDTALSHIIKIVEEAQGSKAPIQRLADQISGIFVPIVLGIAVLTFLIWYLWAAPGDFAEAISKFIAVLVIACPCALGLATPTSIMAGSGRAAEFGILFKGGEHLEKTHRLDTIVLDKTGTVTNGKPRLTDAIPFGRFEEKDLLQFAAAAETGSEHPLGEAIIAGVKDKGLEIPKLTRFEAKVGAGILAEAGGKSILVGTRKLMESEQVEHGALLAQMEELEAEGKTVMLVSIDGEAAGLVAVADTIKDTSRKAVARLKELGLDVIMMTGDNRRTAEAIAKEAGIANIIAEVLPEQKAAEIARLQKEGRQTAMVGDGINDAPALATADIGMAIGTGTDIAMETADITLIRGDLNSIADAIRMSRLTMKNIKQNLFWALGYNSLGIPIAALGFLAPWIAGAAMAFSSVSVVLNALRLQKVK

SEQ ID NO: 23296 - protein, 264 aa, Bacillus subtilis
MKLNLQGKTALVTGSTSGIGKAIASSLAEEGAAVIINGRREEKVNQTIDELKTQHAEAVLYPAAFDLGTEEGCNELFQAYPEVDILVNNLGIFEPAEYFDIPDDEWFRFFEVNIMSGVRLTRRYLHNMIEKKEGRVIFIASEAAIMPSQEMAHYSATKTMQLSISRSLAELATGTNVTVNTVMPGSTLTEGVETMLNSLYPGENLTVQEAEARFMKENRPTSIIQRLIRPEEIAHFVTFLSSPLSSAINGAALRADGGLVRSVF

SEQ ID NO: 23297 - protein, 381 aa, Bacillus subtilis
MLTLENVSKTYKGGKKAVNNVNLKIAKGEFICFIGPSGCGKTTTMKMINRLIEPSAGKIFIDGENIMDQDPVELRRKIGYVIQQIGLFPHMTIQQNISLVPKLLKWPEQQRKERARELLKLVDMGPEYVDRYPHELSGGQQQRIGVLRALAAEPPLILMDEPFGALDPITRDSLQEEFKKLQKTLHKTIVFVTHDMDEAIKLADRIVILKAGEIVQVGTPDDILRNPADEFVEEFIGKERLIQSSSPDVERVDQIMNTQPVTITADKTLSEAIQLMRQERVDSLLVVNDERVLQGYVDVEIIDQCRKKANLVSEVLHEDIYTVLGGTLLRDTVRKILKRGVKYVPVVDEDRRLIGIVTRASLVDIVYDSLWGEEKQLAALS

SEQ ID NO: 23298 - protein, 380 aa, Bacillus subtilis
MLKLEQVSKVYKGGKKAVNSIDLDIAKGEFICFIGPSGCGKTTTMKMINRLIEPSSGRIFIDGENIMEQDPVELRRKIGYVIQQIGLFPHMTIQQNISLVPKLLKWPEEKRKERARELLKLVDMGPEYLDRYPHELSGGQQQRIGVLRALAAEPPLILMDEPFGALDPITRDSLQEEFKKLQRTLNKTIVFVTHDMDEAIKLADRIVILKAGEIVQVGTPDEILRNPANEFVEEFIGKERLIQSRPDIERVEQMMNRTPVTVSADKTLSQAIQLMREKRVDSLLVVDRQNVLKGYVDVEMIDQNRKKASIVGDVYRSDIYTVQKGALLRDTVRKILKQGIKYVPVVDEQNHLAGIVTRASLVDIVYDSIWGDEENQLMTI

SEQ ID NO: 23299 - protein, 430 aa, Bacillus subtilis
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 23300 - protein, 511 aa, Bacillus subtilis
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFVIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAILAKGGHAIITADHGNADILITESGEPHTAHTTNPVPVIVTKEGITLREGGILGDLAPTLLDLLGVEKPKEMTGTSLIQK

SEQ ID NO: 23301 - protein, 253 aa, Bacillus subtilis
MRKPIIAGNWKMNKTLGEAVSFVEEVKSSIPAADKAEAVVCAPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 23302 - protein, 394 aa, Bacillus subtilis
MNKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 23303 - protein, 335 aa, Bacillus subtilis
MAVKVGINGFGRIGRNVFRAALNNPEVEVVAVNDLTDANMLAHLLQYDSVHGKLDAEVSVDGNNLVVNGKTIEVSAERDPAKLSWGKQGVEIVVESTGFFTKRADAAKHLEAGAKKVIISAPANEEDITIVMGVNEDKYDAANHDVISNASCTTNCLAPFAKVLNDKFGIKRGMMTTVHSYTNDQQILDLPHKDYRRARAAAENIIPTSTGAAKAVSLVLPELKGKLNGGAMRVPTPNVSLVDLVAELNQEVTAEEVNAALKEAAEGDLKGILGYSEEPLVSGDYNGNKNSSTIDALSTMVMEGSMVKVISWYDNESGYSNRVVDLAAYIAKKGL

SEQ ID NO: 23304 - protein, 464 aa, Bacillus subtilis
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 23305 - protein, 447 aa, Bacillus subtilis
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 23306 - protein, 301 aa, Bacillus subtilis
MMKEAVTVSNVTKHFQRKTAVNNISFSIEKGEIAAILGPNGAGKTTVVSMILGLLKPSEGEIKLFNRVPDDQQVREKIGVMLQEVSVMPGLKVDEILELFRSYYPNPLSMKELVSLTALTKEDLKTRAEKLSGGQKRRLSFALALAGNPELLILDEPTVGMDTSSRHRFWQTIHGLSDQGKTIIFSTHYLQEADDAAQRILFFTEGQLVADGSPMQIRSRIQKQSVSFTLHSSESLERLSCHPEVERVIHEHERTIIQTSNTDKVLALIFQENIHARDIRIEQATLDEAFRQLADGNREAM

SEQ ID NO: 23307 - protein, 687 aa, Bacillus subtilis
MMSKLEKTHVTKAKFMLHGGDYNPDQWLDRPDILADDIKLMKLSHTNTFSVGIFAWSALEPEEGVYQFEWLDDIFERIHSIGGRVILATPSGARPAWLSQTYPEVLRVNASRVKQLHGGRHNHCLTSKVYREKTRHINRLLAERYGHHPALLMWHISNEYGGDCHCDLCQHAFREWLKSKYDNSLKTLNHAWWTPFWSHTFNDWSQIESPSPIGENGLHGLNLDWRRFVTDQTISFYENEIIPLKELTPDIPITTNFMADTPDLIPYQGLDYSKFAKHVDAISWDAYPVWHNDWESTADLAMKVGFINDLYRSLKQQPFLLMECTPSAVNWHNVNKAKRPGMNLLSSMQMIAHGSDSVLYFQYRKSRGSSEKLHGAVVDHDNSPKNRVFQEVAKVGETLERLSEVVGTKRPAQTAILYDWENHWALEDAQGFAKATKRYPQTLQQHYRTFWEHDIPVDVITKEQDFSPYKLLIVPMLYLISEDTVSRLKAFTADGGTLVMTYISGVVNEHDLTYTGGWHPDLQAIFGVEPLETDTLYPKDRNAVSYRSQIYEMKDYATVIDVKTASVEAVYQEDFYARTPAVTSHEYQQGKAYFIGARLEDQFQRDFYEGLITDLSLSPVFPVRHGKGVSVQARQDQDNDYIFVMNFTEEKQLVTFDQSVKDIMTGDILSGDLTMEKYEVRIVVNTH

SEQ ID NO: 23308 - protein, 489 aa, Bacillus subtilis [sequence omitted]

SEQ ID NO: 23309 - protein, 473 aa, Bacillus subtilis; identical to SEQ ID NO: 19753

SEQ ID NO: 23310 - protein, 516 aa, Bacillus subtilis
MNYIKAGKWLTVFLTFLGILLFIDLFPKEEHDQKTKSKQKPDYRAAYHFTTPDKWKNDPQKPIYFDGKYHYFYLYNRDYPKGNGTEWRHAVSEDLVHWTDEGVAIPKYTNPDGDIWTGSVVVDKENTAGFGKNALVAIVTQPSAKDKKQEQYLWYSTDKGKSFKFYSGNPVMPNPGTDDFRDPKVIWDDQDNKWVMVMAEGSKIGFYESDNLKDWHYTSGFFPEQAGMVECPDLYMMRASDGTNKWVLGASANGKPWGKPNTYAYWTGSFDGKEFKADQTEAQWLDYGFDWYGGVTFEDSKSTDPLEKRYALAWMNNWDYANNTPTMKNGFNGTDSVIRELRLKEQDGTYSLVSQPIEALEQLTVSTDEIEDQDVNGSKTLSITGDTYQLDTDLSWSELKNAGVRLRESEDQKRHIDVGIFAEGGYAYVNRAATNQPDKSNTYVESKAPYDVNKRKVHLKILVDKTTIEVFVGDGKTVFSNEVFPKPEDKGITLYSDGGTASFKNITVKHFDSIHE

SEQ ID NO: 23311 - protein, 520 aa, Bacillus subtilis
MSKQGNFQKSMSLFDLILIGMGAIFGSAWLFAVSNVASKAGPSGAFSWILGGAIILLIGLVYAELGAALPRTGGIIRYPVYSHGHLVGYLISFVTIVAYTSLISIEVTAVRQYVAYWFPGLTIKGSDSPTISGWILQFALLCLFFLLNYWSVKTFAKANFIISIFKYIVPITIIIVLIFHFQPENLSVQGFAPFGFTGIQAAISTGGVMFAYLGLHPIVSVAGEVQNPKRNIPIALIICIIVSTIIYTVLQVTFIGAIPTETLKHGWPAIGREFSLPFKDIAVMLGLGWLATLVILDAILSPGGNGNIFMNTTSRLVYAWARNGTLFGIFSKVNKDTGTPRASLWLSFALSIFWTLPFPSWNALVNVCSVALILSYAIAPISSAALRVNAKDLNRPFYLKGMSIIGPLSFIFTAFIVYWSGWKTVSWLLGSQLVMFLIYLCFSKYTPKEDVSLAQQLKSAWWLIGFYIMMLIFSYIGSFGHGLGIISNPVDLILVAIGSLAIYYWAKYTGLPKAAIDYDK

SEQ ID NO: 23312 - protein, 226 aa, Bacillus subtilis
MKAVIFDLDGVITDTAEYHFLAWKHIAEQIDIPFDRDMNERLKGISREESLESILIFGGAETKYTNAEKQELMHRKNRDYQMLISKLTPEDLLPGIGRLLCQLKNENIKIGLASSSRNAPKILRRLAIIDDFHAIVDPTTLAKGKPDPDIFLTAAAMLDVSPADCAAIEDAEAGISAIKSAGMFAVGVGQGQPMLGADLVVRQTSDLTLELLHEEWEQYRIRESIP

SEQ ID NO: 23313 - protein, 561 aa, Bacillus subtilis
MSEWWKEAVVYQIYPRSFYDANGDGFGDLQGVIQKLDYIKNLGADVIWLSPVFDSPQDDNGYDISDYKNMYEKFGTNEDMFQLIDEVHKRGMKIVMDLVVNHTSDEHAWFAESRKSKDNPYRDYYLWKDPKPDGSEPNNWGSIFSGSAWTYDEGTGQYYLHYFSKKQPDLNWENEAVRREVYDVMRFWMDRGVDGWRMDVIGSISKYTDFPDYETDHSRSYIVGRYHSNGPRLHEFIQEMNREVLSHYDCMTVGEANGSDIEEAKKYTDASRQELNMIFTFEHMDIDKEQNSPNGKWQIKPFDLIALKKTMTRWQTGLMNVGWNTLYFENHDQPRVISRWGNDRKLRKECAKAFATVLHGMKGTPFIYQGEEIGMVNSDMPLEMYDDLEIKNAYRELVVENKTMSEKEFVKAVMIKGRDHARTPMQWDAGKHAGFTAGDPWIPVNSRYQDINVKESLEDQDSIFFYYQKLIQLRKQYKIMIYGDYQLLQENDPQVFSYLREYRGEKLLVVVNLSEEKALFEAPPELIHERWKVLISNYPQERADLKSISLKPYEAVMGISI

SEQ ID NO: 23314 - protein, 589 aa, Bacillus subtilis
MMEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPDVNDFFGGDLQGIVDKLDYLEDLGVNGIYLTPIFSAPSNHKYDTLDYFSIDPHFGDPELFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLNGENDPLCRKCMVWEKEKQNQDMLQFMKRLIALRKQENTLLTEGHLEWNLLDDKNDFISFSRTLDEKILIYFFNQGNVVQHVSLRELNIDRNKKICDAWTEQPLQHHDVIAVQPGEFLILSAAAPV

SEQ ID NO: 23315 - protein, 254 aa, Bacillus subtilis
MIKMSDFLKDCFQKIGWEKDHVSFGDLPLFLKAMAYRFPFENRAVLAKENYKITKEELWRRLLKDQHGGLCYDLNGFLYFVLREAGFHVKLIRGTVYAGDQEGWALEGTHAAVWLSAENGDYLVDIGFGINLALQPIPLSGETVQSPVGSFRIKKEETEKGSYVLLMDKGEGWQIGYAFTLEESDLGDLDNMKDIIHSHEKSPFNKSLLASKLTPSGRMVMSERHFTIYENGGNIQKSDIGPSGFEEKLNTHFL

SEQ ID NO: 23316 - protein, 589 aa, Bacillus subtilis
MPTKKQKSKSKLKPFFALVRRTNPSYGKLAFALALSVVTTLVSLLIPLLTKQLVDGFSMSNLSGTQIGLIALVFFVQAGLSAYATYALNYNGQKIISGLRELLWKKLIKLPVSYFDTNASGETVSRVTNDTMVVKELITTHISGFITGIISVIGSLTILFIMNWKLTLLVLVVVPLAALILVPIGRKMFSISRETQDETARFTGLLNQILPEIRLVKASNAEDVEYGRGKMGISSLFKLGVREAKVQSLVGPLISLVLMAALVAVIGYGGMQVSSGELTAGALVAFILYLFQIIMPMGQITTFFTQLQKSIGATERMIEILAEEEEDTVTGKQIENAHLPIQLDRVSFGYKPDQLILKEVSAVIEAGKVTAIVGPSGGGKTTLFKLLERFYSPTAGTIRLGDEPVDTYSLESWREHIGYVSQESPLMSGTIRENICYGLERDVTDAEIEKAAEMAYALNFIKELPNQFDTEVGERGIMLSGGQRQRIAIARALLRNPSILMLDEATSSLDSQSEKSVQQALEVLMEGRTTIVIAHRLSTVVDADQLLFVEKGEITGRGTHHELMASHGLYRDFAEQQLKMNADLENKAG

SEQ ID NO: 23317 - protein, 209 aa, Bacillus subtilis
MKQADELRFNEDGLIPAIVQDAASKEVLTLAYMNKESYEKTLETKETWFYSRSRQALWHKGETSGNTQAVKGIRYDCDQDALLVLVEPSGPACHTGSYSCFTKEQTEEQAADRFGIMNELERVIAERQAEMPEGAYTTYLFREGVDKILKKVGEEASEVIIAAKNRDHEELKWEAADLLYHLLVLLREQSLPLDDVLDVLKKRHSEIEE

SEQ ID NO: 23318 - protein, 252 aa, Bacillus subtilis
MITKRIIPCLDVKEGRVVKGIQFLELKDAGDPVELAEVYDREGADELVFLDISASHEGRKTMVDVVEQVAAKLAIPFTVGGGINQLSDMKTILRAGADKVSVNTAAVLRPELITEGAEFFGSQCIVLAIDAKYDKESDTYKVYTHGGRKKTDWEVTAWAKEGVKRGAGEILLTSMDSDGEKKGFDHTLTKLVSEAVPVPVIASGGAGNAQHMLEAFTKGEADAALAASIFHYKETSIKEVKSYLKEYGVNVR

SEQ ID NO: 23319 - protein, 194 aa, Bacillus subtilis
MRKAERVRKTNETDIELAFTIDGGGQADIKTDVPFMTHMLDLFTKHGQFDLSINAKGDVDIDDHHTTEDIGICLGQALLEALGDKKGIKRYGSAFVPMDEALAQVVIDLSNRPHLEMRADFPAAKVGTFDTELVHEFLWKLALEARMNLHVIVHYGTNTHHMIEAVFKALGRALDEATTIDPRVKGIPSTKGML

SEQ ID NO: 23320 - protein, 427 aa, Bacillus subtilis
MKIKTISGAERLSLKRSIDAGTEEQRKTVRSIIEDVKANGDQAVRSYTAKFDCIEIDSPLVTKEEFEEAYTSLDSRLLQVIRQAIENIREYHERQLQSSWFYHRKDGTMLGQKVTALDSAGVYVPGGTAAYPSSVLMNVIPALVAGVERIVLVTPPGKDGLLSPGVLVAAAELGIKDIYKMGGAQAIAALAYGTETIEPVDKITGPGNIYVALAKREVFGDVDIDMIAGPSEIVVLADETAIPSEIAADLLSQAEHDKLSSCVFVTDSMALAETVSAEVNKQLETLPRREIAEASVRDYGCIYVAETMVEAIETVNTLAPEHLEIITQSPEALLGSIKHAGAIFLGRYSPEPVGDYFAGPNHVLPTNGTARFSSPLNVTDFQKKSSIISYSQSAFEEHAESIAAFARLEGLEAHARSIEARERRISK

SEQ ID NO: 23321 - protein, 216 aa, Bacillus subtilis
MSDKQVTTILFDLDGTLINTNELIIASFLHTLEHYYPSKYKREDVLAFIGPSLFDTFSSMDPDKCEDMIAMYRAYNHDMHDSLVTEYETVYETLDALKKAGFTLGIVTTKLRDTVNMGLKLTGIGEFFETVVTLDDVTNAKPDPEPVLLALKQLGSEPAEAIMVGDNYHDVLAGKNAGTKTAGVAWTIKGPEMLAKHEPDFMLEKMSDLLQIVGVK

SEQ ID NO: 23322 - protein, 461 aa, Bacillus subtilis
MKKIAVIGTGYVGLVSGTCFAEIGNKVVCCDIDESKIRSLKNGVIPIYEPGLADLVEKNVLDQRLTFTNDIPSAIRASDIIYIAVGTPMSKTGEADLTYVKAAAKTIGEHLNGYKVIVNKSTVPVGTGKLVQSIVQKASKGRYSFDVVSNPEFLREGSAIHDTMNMERAVIGSTSHKAAAIIEELHQPFHAPVIKTNLESAEMIKYAANAFLATKISFINDIANICERVGADVSKVADGVGLDSRIGRKFLKAGIGFGGSCFPKDTTALLQIAKSAGYPFKLIEAVIETNEKQRVHIVDKLLTVMGSVKGRTISVLGLAFKPNTNDVRSAPALDIIPMLQQLGAHVKAYDPIAIPEASAILGEQVEYYTDVYAAMEDTDACLILTDWPEVKEMELVKVKTLLKQPVIIDGRNLFSLEEMQAAGYIYHSIGRPAVRGTEPSDKYFPGLPLEELAKDLGSVNL

SEQ ID NO: 23323 - protein, 292 aa, Bacillus subtilis
MKKVRKAIIPAAGLGTRFLPATKAMPKEMLPIVDKPTIQYIIEEAVEAGIEDIIIVTGKSKRAIEDHFDYSPELERNLEEKGKTELLEKVKKASNLADIHYIRQKEPKGLGHAVWCARNFIGDEPFAVLLGDDIVQAETPGLRQLMDEYEKTLSSIIGVQQVPEEETHRYGIIDPLTSEGRRYQVKNFVEKPPKGTAPSNLAILGRYVFTPEIFMYLEEQQVGAGGEIQLTDAIQKLNEIQRVFAYDFEGKRYDVGEKLGFITTTLEFAMQDKELRDQLVPFMEGLLNKEEI

SEQ ID NO: 23324 - protein, 457 aa, Bacillus subtilis
MKKQSNIWLYFFGALGGALYGYDTGVISGAILFMKKELGLNAFTEGLVVSSLLVGAILGSGAAGKLTDRFGRKKAIMAAALLFCIGGLGVALAPNTGVMVLFRIILGLAVGTSTTIVPLYLSELAPKHKRGALSSLNQLMITVGILLSYIVNYIFADAEAWRWMLGLAAVPSLLLLIGILFMPESPRWLFTNGEESKAKKILEKLRGTKDIDQEIHDIKEAEKQDEGGLKELFDPWVRPALIAGLGLAFLQQFIGTNTIIYYAPKTFTNVGFGNSASILGTVGIGTVNVLMTLVAIKIIDKIGRKPLLLFGNAGMVISLIVLALVNLFFNNTPAASWTTVICLGVFIVVFAVSWGPVVWVMLPELFPLHVRGIGTGVSTLMLHVGTLIVSLTYPILMEAIGISYLFLIYAAIGIMAFLFVRFKVTETKGRSLEEIEQDLRDKNGQGGAAGKQQTVGT

SEQ ID NO: 23325 - protein, 293 aa, Bacillus subtilis
MRNICVIGSCSMDLVVTSDKRPKAGETVLGTSFQTVPGGKGANQAVAAARLGAQVFMVGKVGDDHYGTAILNNLKANGVRTDYMEPVTHTESGTAHIVLAEGDNSIVVVKGANDDITPAYALNALEQIEKVDMVLIQQEIPEETVDEVCKYCHSHDIPIILNPAPARPLKQETIDHATYLTPNEHEASILFPELTISEALALYPAKLFITEGKQGVRYSAGSKEVLIPSFPVEPVDTTGAGDTFNAAFAVALAEGKDIEAALRFANRAASLSVCSFGAQGGMPTRNEVEELLS

SEQ ID NO: 23326 - protein, 440 aa, Bacillus subtilis
MNITVIGTGYVGLVTGVSLSEIGHHVTCIDIDAHKIDEMRKGISPIFEPGLEELMRKNTADGRLNFETSYEKGLAQADIIFIAVGTPQKSDGHANLEQITDAAKRIAKHVKRDTVVVTKSTVPVGTNDLINGLITEHLAEPVSISVASNPEFLREGSAIYDTFHGDRIVIGTADEKTANTLEELFRPFQIPIYQTDIRSAEMIKYASNAFLATKISFINEISNICEKVGADIEAVAYGMGQDKRIGSQFLKAGIGYGGSCFPKDTNALVQIAGNVEHDFELLKSVIKVNNNQQAMLVDKALNRLGGVTGKTIALLGLSFKPNTDDMREAPSIVIADRLAALDARIRAYDPIAVSHAKHVLPQAVEYKETIEEAVKGSDAVMILTDWADIKQFPLAAYQDLMETPLIFDGRNCYTLDEALAAGVEYYSVGRKAVVPSGAIQ

SEQ ID NO: 23327 - protein, 132 aa, Bacillus subtilis
MLDTQQIKEIIPHRYPFLLVDRITEVEEGKRAKGYKNVTANEEFFNGHFPQYPVMPGVLIVEALAQVGAVAMLIKEENRGRLAFFAGIDNCRFKKQVKPGDQLHLEVEIIRARGTIGRGKGVATVDGKSFAN

SEQ ID NO: 23328 - protein, 436 aa, Bacillus subtilis
MEKIIVRGGQKLNGTVKVEGAKNAVLPVIAASLLASEEKSVICDVPTLSDVYTINEVLRHLGADVHFENNEVTVNASYALQTEAPFEYVRKMRASVLVMGPLLARTGHARVALPGGCAIGSRPIDQHLKGFEAMGAEIKVGNGFIEAEVKGRLQGAKIYLDFPSVGATENLIMAAALAEGTTTLENVAKEPEIVDLANYINGMGGKIRGAGTGTIKIEGVEKLHGVKHHIIPDRIEAGTFMVAAAITEGNVLVKGAVPEHLTSLIAKMEEMGVTIKDEGEGLRVIGPKELKPIDIKTMPHPGFPTDMQSQMMALLLRASGTSMITETVFENRFMHAEEFRRMNGDIKIEGRSVIINGPVQLQGAEVAATDLRAGAALILAGLVAEGHTRVTELKHLDRGYVDFHQKLAALGADIERVNDESASEQENKEVVSDLNA

SEQ ID NO: 23329 - protein, 287 aa, Bacillus subtilis
MASLRDIKSRITSTKKTSQITKAMQMVSAAKLNRAENNAKSFVPYMDKIQEVVSNVGRVSGNVKHPMLLSREVKKTAYLVITSDRGLAGAFNSSVLRSAYQAMQERHQSKDEYAVIAIGRVGRDFFKKREIPIISELTGLGDEVTFTEIKDLARQTIQMFIDGAFDELHLVYNHFVSAITQEVTEKKLLPLSDLGSGGGKRTASYEFEPSEEEVLEVLLPQYAESLIFGALLDSKASEHAARMTAMKNATDNAKELIDSLSLSYNRARQAAITQEITEIVGGAAALE

SEQ ID NO: 23330 - protein, 502 aa, Bacillus subtilis
MSIKAEEISTLIKQQIQNYQSDIEVQDVGTVIQVGDGIARVHGLDNCMAGELVEFSNGVLGMAQNLEESNVGIVILGPFSEIREGDEVKRTGRIMEVPVGEELIGRIVNPLGQPVDGLGPILTSKTRPIESPAPGVMDRKSVHEPLQTGIKAIDALIPIGRGQRELIIGDRQTGKTSVAIDAILNQKDQDMICVYVAIGQKESTVRGVVETLRKHGALDYTIVVTASASQPAPLLYLAPYAGVTMAEEFMYNGKHVLVVYDDLSKQAAAYRELSLLLRRPPGREAFPGDVFYLHSRLLERAAKLSDAKGAGSITALPFVETQAGDISAYIPTNVISITDGQIFLQSDLFFSGVRPAINAGLSVSRVGGSAQIKAMKKVSGTLRLDLASYRELEAFAQFGSDLDQATQAKLNRGARTVEVLKQDLNKPLPVEKQVAILYALTKGYLDDIPVADIRRFEEEYYMYLDQNHKDLLDGIAKTGNLPADEDFKAAIEGFKRTFAPSN

SEQ ID NO: 23331 - protein, 181 aa, Bacillus subtilis
MSGSAVSKRYASALFDIANESAQLNQVEEELIVVKQVFQNEKALNDVLNHPKVPAAKKKELIQNAFGSLSQSVLNTIFLLIDRHRAAIVPELTDEFIKLANVARQTEDAIVYSVKPLTDAEMLPLSQVFAKKAGVASLRIRNEVQTDLIGGIKVRIGNRIYDGSVSGKLQRIERQLAGENR

SEQ ID NO: 23332 - protein, 244 aa, Bacillus subtilis
MNHGYRTIEFLGLTFNLTNILMITVASVIVLLIAILTTRTLSIRPGKAQNFMEWIVDFVRNIIGSTMDLKTGANFLALGVTLLMYIFVSNMLGLPFSITIGHELWWKSPTADPAITLTLAVMVVALTHYYGVKMKGLKEYSKDYLRPVPFMLPMKIIEEFANTLTLGLRLYGNIFAGEILLGLLAGLATSHYSQSVALGLVGTIGAILPMLAWQAFSLFIGAIQAFIFTMLTMVYMSHKISHDH

SEQ ID NO: 23333 - protein, 582 aa, Bacillus subtilis
MGYYLTWLTISRKKEICLNNIKKTKEGHLETTLRGKEVLSIPTLNKGVAFSLEERQELGLEGLLPPTVLSLDQQAQRAYEQFQAQPDRLRQNVYLSDLANRNEVLFYKLLKNHLREMLPVVYTPTVGEAIQEYSHEYRRPQGIYLSIDNIDGIEKAFENLHATAGDIDLIVATDSESILGIGDWGVGGINIAIGKLAVYTAAAGIDPSRVIPVVLDVGTNNEKLLNDPLYIGNKHERVQGERYEAFIDAYVKAALKFFPKALLHWEDLGNKNARNIMKKYNHEILTFNDDIQGTGAITLAGVLAAMKKTGASIKDQRVVIFGAGSAGIGIADQIRDTMVLAGLSEEEANKRFYTLDYRGLLTEDIEGILDFQKPYLRNADEVKDWKRDEKGQIPFDEVVRQAKPTILIGTSGVSGAFTEEIVKEMASHVDRPVIMPMSNPTHLAEAVPEDLFKWTDGKVLIATGSPFDNVEYNGVSYEIGQSNNAFAFPGLGLGSIVAEARIITPAMFAATADAIAEMVDLETPGAGLLPSIDKLQEVSIQVAIAVAEAAIKDGVANRQPEDVKQAVLDAMWTPEYKKVIAK

SEQ ID NO: 23334 - protein, 427 aa, Bacillus subtilis
MKDVSISSLENMKLKELYELARHYKISYYSKLTKKELIFAILKANAEQEDLLFMEGVLEIIQSEGFGFLRPINYSPSSEDIYISASQIRRFDLRNGDKVSGKVRPPKENERYYGLLHVEAVNGDDPESAKERVHFPALTPLYPDRQMVLETKPNFLSTRIMDMMAPVGFGQRGLIVAPPKAGKTMLLKEIANSITANQPEAELIVLLIDERPEEVTDIERSVAGDVVSSTFDEVPENHIKVAELVLERAMRLVEHKKYVIILMDSITRLARAYNLVIPPSGRTLSGGIDPAAFHRPKRFFGAARNIEEGGSLTILATALVDTGSRMDDVIYEEFKGTGNMELHLDRSLAERRIFPAIDIRRSGTRKEELLVPKEHLDRLWSIRKTMSDSPDFAEKFMRKMKKTKTNQEFFDILNQEWKQANLSSARR

SEQ ID NO: 23335 - protein, 429 aa, Bacillus subtilis
MEKLNIAGGDSLNGTVHISGAKNSAVALIPATILANSEVTIEGLPEISDIETLRDLLKEIGGNVHFENGEMVVDPTSMISMPLPNGKVKKLRASYYLMGAMLGRFKQAVIGLPGGCHLGPRPIDQHIKGFEALGAEVTNEQGAIYLRAERLRGARIYLDVVSVGATINIMLAAVLAEGKTIIENAAKEPEIIDVATLLTSMGAKIKGAGTNVIRIDGVKELHGCKHTIIPDRIEAGTFMIAGAAMGKEVIIDNVIPTHLESLTAKLREMGYHIETSDDQLLIVGGQKNLKPVDVKTLVYPGFPTDLQQPMTALLTRAKGTSVVTDTIYSARFKHIDELRRMGANMKVEGRSAIITGPVELQGAKVKASDLRAGSCLVVAGLMADGVTEITGLEHIDRGYSSLEKKLEGLGATIWRERMTDEEIEQLQNS

SEQ ID NO: 23336 - protein, 285 aa, Bacillus subtilis
MPLVSMTEMLNTAKEKGYAVGQFNLNNLEFTQAILQAAEEEKSPVILGVSEGAGRYMGGFKTVVAMVKALMEEYKVTVPVAIHLDHGSSFESCAKAIHAGFTSVMIDASHHPFEENVATTAKVVELAHFHGVSVEAELGTVGGQEDDVIAEGVIYADPKECQELVERTGIDCLAPALGSVHGPYKGEPNLGFKEMEEIGKSTGLPLVLHGGTGIPTADIKKSISLGTAKINVNTENQISSAKAVRETLAAKPDEYDPRKYLGPAREAIKETVIGKMREFGSSNQA

SEQ ID NO: 23337 - protein, 379 aa, Bacillus subtilis
MNFSLSEEHEMIRKLVRDFAKHEVAPTAAERDEQERFDRELFREMANLGLTGIPWPEDYGGIGSDYLAYVIAVEELSKVCASTGVTLSAHISLCSWPLFAFGTEEQKTEYLTQLALGEKIGAFALTEAGSGSDAGSMKTTAERIGDDYVLNGSKVFITNGGVADIYIVFAVTDPEKKKKGVTAFIVEKDFEGFFTGKKEKKLGIRSSPTTEIMFEDCVVPASKRLGEEGEGFKIAMKTLDGGRNGIAAQAVGIAQGALDAALQYAKERKQFGKSIAEQQGIAFKLADMATMIEASRLLTYQAAWLESSGLPYGKASAMSKLMAGDTAMKVTTEAVQIFGGYGYTKDYPVERYMRDAKITQIYEGTQEIQRLVISRMLAD

SEQ ID NO: 23338 - protein, 575 aa, Bacillus subtilis
MLRQFFSYYKPYKTLFFLDFFSAIAGGLMELSFPLIVNYFIDTLLPGRDWGLIIATSIGLFAVYALSSALQYIVTYWGHMLGINIETDMRKSLFDHLQKLSFKFYDNNKTGTLMSKLTNDLMYIGEVAHHGPEDLFIAVMTILGAFGVMLFINWQLALLTFIIMPIVIWLALYFNKKMTKAFTTLNKDIGDFSARVENNIGGIRLVQAFGNEAFEKERFAVNNQRFRVTKLSSYKIMAKNGSISYMLTRFVTLFVLLCGTWFVIRGSLSYGEFVAFVLLTNVLFRPIDKINAIIEMYPRGIAGFKSYMELMETEPDIQDSPDSKDVSGLKGNIRYKHVSFGYDDHHNVLNDINLSIQAGETVAFVGPSGAGKSTLCSLLPRFYEASEGDITIDGISIKDMTLSSLRGQIGVVQQDVFLFSGTLRENIAYGRLGASEEDIWQAVKQAHLEELVHNMPDGLDTMIGERGVKLSGGQKQRLSIARMFLKNPSILILDEATSALDTETEAAIQKALQELSEGRTTLVIAHRLATIKDADRIVVVTNNGIEEQGRHQDLIEAGGLYSRLHQAQFGQMVHR

SEQ ID NO: 23339 - protein, 223 aa, Bacillus subtilis
MSGQILWGIMPYIVLTIFIGGHIYRYQHDQFGWTAKSSELLEKKKLAAGSTLFHWGLLCVVGGHVMGILIPEGVYASLGISEHMYHKMAIGAGLPAGIAACTGLVILTYRRLFDKRIRKTSSPSDILTLLLLLFMMLSGVAATFLNIDSKGFDYRTTVGPWFREIVLFRPDASLMESVPLWFKFHIVIGYVVFILWPFTRLVHVFSLPLKYLTRSYVVYRKRS

SEQ ID NO: 23340 - protein, 184 aa, Bacillus subtilis
MNTTDRQITFSALSCLLSYPDEEWRAELPDWKALIQEIGNRQIREKLLHFFETSASYSPEALIEHYVYTFDFGKKTNMYVTYFNSGEQRERGIELLHLKNTYEQSGFLPTEKELPDYLPLMLEFAAAAEIEAARSVFEKYLSNVRELASRLEKNDSIYAELLHVLLAALENIGVRESVEGAVQA

SEQ ID NO: 23341 - protein, 487 aa, Bacillus subtilis
MKIKAQIGMVMNLDKCIGCHTCSVTCKNTWTNRSGAEYMYFNNVETKPGIGYPKQWEDQDKYKGGWTLKKGKLELKSGSKTNRLAGLFYNPNQPSIDDYYEPWNYDYETLTNSPQKKHQPVARPKSSLTGDFMNIEWGPNWEDDLAGGHITGLEDPNVQKMEESIKTEFDDVFMMYLPRICEHCINPACVSSCPSGAMYKREEDGIVLVDQNACRSWRYCVSSCPYKKVYFNWQTNKAEKCTLCFPRLEAGLPTICSETCVGRIRYLGVMLYDADKVEEAASVENEKDLYHSQLDVFLDPNDPEVAKLAKEQGIPAEWIEAAQQSPIYKMIIDWKIALPLHPEYRTLPMVWYIPPLSPIMNLFEGKGSRQTAEDIFPAIDQMRIPIDYLAQLLTAGDTDHIRSTLKKMSVMRQYMRAVQTNKSIDPELISSVGLTEQQIEDMYRLLAIAKYDDRFVIPSSHREEVSDLYAEQGSCGLSFSGGPGSCF

SEQ ID NO: 23342 - protein, 1228 aa, Bacillus subtilis
MKKKKRSPLFRRLNYFSPIEHHSNKHSQTTREDRDWENVYRNRWQYTKVVRSTHGVNCTGSCSWNIYVKNGIVTWEGQNLNYPSTGPDMPDFEPRGCPRGASFSWYIYSPLRVKYPYVRGVLINLWREALQTHQNPLEAWKSIVENPEKAKSYKQARGKGGFVRAEWPEVLKLISASLLYTVMKYGPDRNVGFSPIPAMSMISHASGSRFMSLIGGPMLSFYDWYADLPPASPQIWGDQTDVPESSDWYNSGYIITWGSNVPLTRTPDAHFLAEARYKGAKVISISPDFAESSKFADDWLSIRQGTDGALAMAMGHVILQEFYVNQETERFIEYAKQYTDFPFLVTLSKENGVYTAGRFLHAKDIGRKTKHDQWKPAVWDEQTSSFAIPQGTMGSRWDGQQKWNLHMIDEETGEPIEPRLSVLGIEDEIGTVRIPYFSNDGNKVLERDLPIKKMNLNGEETYITTVFDLILANYGVNRGIGERSAVSYDDPEPFTPAWQEQMTGIKKEAVVKIAREFAQNAIDTDGRSMIIVGAGINHWFNSDTIYRAVLNLVLLVGAQGVNGGGWAHYVGQEKLRPAEGWQTIATAKDWEGVPKLQNGTSFFYFATDQWRYEDQPISDLASPIAASSRYKHHADYNVLAARLGWLPSYPTFNQNGIDLYKEAEKAGAATPEDVGAYVASQLQEKKLKFAIEDPDNEVNFPRNLFVWRANLISSSGKGHEYFLKHLLGTTNGLMNDDSDSIRPEEIKWREQAPEGKLDLLINLDFRMAGTALYSDIVLPAATWYEKHDLSSTDMHPFIHPFAPAISAPWESKSDWDIFKALSKAVSDLAEEVDMEPVKEVVATPLLHDTMQELAQPFGKINDWSKGECEAIPGKTMPNIQVVERDYKHIFHKMTALGPNVALKPSGTKGMSWSIADEYESLKQRLGEITSDSVAKGCPNISEAKQAAEAILTLSSTSNGKVAVKAWESLENITNLKLKDLAEEREEECFTFEQITAQPKTVITSPAFTGSEKGGRRYSPFTTNVEKLIPWRTLTGRQSYYVDHELMMEFGETMATFKPILQHRPFLSKRPDQEGKEIVLNYLTPHNKWSVHSMYFDSLPMLTLFRGGPTVWMNKDDAEDTDIKDNDWIECFNRNGVVVARAVLSHRIPKGMAFMHHAQDRHINVPGTKLTNNRGGTHNSPTRIHVKPTQMIGGYAQLSYGFNYYGPTGNQRDLNVVIRKLKEVDWLED

SEQ ID NO: 23343 - protein, 239 aa, Bacillus subtilis
MSILDIHDVSVWYERDNVILEQVDLHLEKGAVYGLLGVNGAGKTTLINTLTGVNRNFSGRFTLCGIEAEAGMPQKTSDQLKTHRYFAADYPLLFTEITAKDYVSFVHSLYQKDFSEQQFASLAEAFHFSKYINRRISELSLGNRQKVVLMTGLLLRAPLFILDEPLVGLDVESIEVFYQKMREYCEAGGTILFSSHLLDVVQRFCDYAAILHNKQIQKVIPIGEETDLRREFFEVIGHE

SEQ ID NO: 23344 - protein, 290 aa, Bacillus subtilis
MRFDEAYSGKVFIASRPEWEEADAILYGMPMDWTVSYRPGSRFGPSRIREVSIGLEEYSPYLDRDLADLNFFDAGDIPLPFGNPQRSLDMIEEYVDSILEKGKFPMGMGGEHLVSWPVIKAMYKKYPDLAIIHFDAHTDLRVDYEGEPLSHSTPIRKAAELIGPHNVYSFGIRSGMKEEFEWAKENGMHISKFEVLEPLKEVLPKLAGRPVYVTIDIDVLDPAHAPGTGTVDAGGITSKELLASVHEIARSEVNVKGADLVEVAPVYDHSEQTANTASKIIREMLLGFVK

SEQ ID NO: 23345 - protein, 259 aa, Bacillus subtilis
MSKRTAFVMGASQGIGKAIALKLADQHFSLVINSRNLDNIESVKEDILAKHPEASVIVLAGDMSDQHTRAGIFQKIESQCGRLDVLINNIPGGAPDTFDNCNIEDMTATFTQKTVAYIDAIKRASSLMKQNEFGRIINIVGNLWKEPGANMFTNSMMNAALINASKNISIQLAPHNITVNCLNPGFIATDRYHQFVENVMKKNSISKQKAEEQIASGIPMKRVGSAEETAALAAFLASEEASYITGQQISADGGSMKSI

SEQ ID NO: 23346 - protein, 399 aa, Bacillus subtilis
MEITPSDVIKTLPRQEFSLVFQKVKEMEKTGAHIINLGQGNPDLPTPPHIVEALREASLNPSFHGYGPFRGYPFLKEAIAAFYKREYGVTINPETEVALFGGGKAGLYVLTQCLLNPGDIALVPNPGYPEYLSGITMARAELYEMPLYEENGYLPDFEKIDPAVLEKAKLMFLNYPNNPTGAVADAAFYAKAAAFAKEHNIHLIHDFAYGAFEFDQKPASFLEAEDAKTVGAELYSFSKTFNMAGWRMAFAVGNEKIIQAVNEFQDHVFVGMFGGLQQAASAALSGDPEHTESLKRIYKERIDFFTALCEKELGWKMEKPKGTFYVWAEIPNTFETSHQFSDYLLEHAHVVVTPGEIFGSNGKRHVRISMVSKQEDLREFVTRIQKLNLPFGSLQETSR

SEQ ID NO: 23347 - protein, 255 aa, Bacillus subtilis
MIMNLTDKTVLITGGASGIGYAAVQAFLGQQANVVVADIDEAQGEAMVRKENNDRLHFVQTDITDEAACQHAVESAVHTFGGLDVLINNAGIEIVAPIHEMELSDWNKVLQVNLTGMFLMSKHALKHMLAAGKGNIINTCSVGGLVAWPDIPAYNASKGGVLQLTKSMAVDYAKHQIRVNCVCPGIIDTPLNEKSFLENNEGTLEEIKKEKAKVNPLLRLGKPEEIANVMLFLASDLSSYMTGSAITADGGYTAQ

SEQ ID NO: 23348 - protein, 470 aa, Bacillus subtilis
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 23349 - protein, 515 aa, Bacillus subtilis
MTVTYAHEPFTDFTEAKNKTAFGESLAFVNTQLGKHYPLVINGEKIETDRKIISINPANKEEIIGYASTADQELAEKAMQAALQAFDSWKKQRPEHRANILFKAAAILRRRKHEFSSYLVKEAGKPWKEADADTAEAIDFLEFYARQMLKLKEGAPVKSRAGEVNQYHYEALGVGIVISPFNFPLAIMAGTAVAAIVTGNTILLKPADAAPVVAAKFVEVMEEAGLPNGVLNYIPGDGAEIGDFLVEHPKTRFVSFTGSRAVGCRIYERAAKVQPGQKWLKRVIAEMGGKDTVLVDKDADLDLAASSIVYSAFGYSGQKCSAGSRAVIHQDVYDEVVEKAVALTKTLTVGNPEDPDTYMGPVIHEASYNKVMKYIEIGKSEGKLLAGGEGDDSKGYFIQPTIFADVDENARLMQEEIFGPVVAICKARDFDHMLEIANNTEYGLTGALLTKNRAHIERAREDFHVGNLYFNRGCTGAIVGYQPFGGFNMSGTDSKAGGPDYLILHMQAKTTSEAF

SEQ ID NO: 23350 - protein, 424 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVERANGPTTIDATKILNERGVLLVPDILASAGGVTVSYFEWVQNNQGYYWSEEEVAEKLRSVMVSSFETIYQTAATHKVDMRLAAYMTGIRKSAEASRFRGWV

SEQ ID NO: 23351 - protein, 246 aa, Bacillus subtilis
MKGVILAGGNGSRLMPLTKAVNKHLLPVGPYPMIYWSIMKLQEAGIKDILLISQKEHMPQFYKLLGNGEELGVTITYQVQPAASGISDGLSYAKRFTKKESFILLLGDNIFEDSLKPYTERFEQQGKGAKVLLKEVDDPERFGIAEIDEKNKRIRSIIEKPEQPPTNLCVTGIYMYDAEVFSYIEQISPSKRGELEITDVNNLYIENSQLTYDVLSGWWVDAGTHESLYLASQLVHQALRKGQDEK

SEQ ID NO: 23352 - protein, 457 aa, Bacillus subtilis
MNSSIPSIISKHKAYFAAGHTRPLESRLNILRKLKQAVRTHEADLIAALYQDLHKSEQEAYSTEIGIVLEEISFVMKRLRKWSKPKRVKTPLTHLGSKSIIIPEPYGTVLVIAPWNYPLQLALSPLIGAIAAGNTVVLKPSEYTPAVSAILSKLISSVFPTDYVAMAEGGPDVSTALLQQPFDYIFFTGSVAVGKIVMEAAAKQLIPVTLELGGKSPCIVHKDADIQLAAKRIVFGKFTNAGQTCIAPDYLFVHEDIKTKLTEEMKRAIREFYGPQPERNPQYGKIVSERHYQRLLSFLNDGIPLTGGQSDPNHHKIAPTILEQVRDDSPVMQEEIFGPILPLFTYRNIGEVIEKVQSRPKPLALYLFTTNKEIERAVLGNLSFGGGCVNDTLMHVATPYLPFGGVGESGIGSYHGFDSFNTFTHKKSVVKQTNRFDFAFRYPSSKNGLRMIRKILK

SEQ ID NO: 23353 - protein, 225 aa, Bacillus subtilis
MKQLLQDSWWNQLKEEFEKPYYQELREMLKREYAEQTIYPDSRDIFNALHYTSYDDVKVVILGQDPYHGPGQAQGLSFSVKPGVKQPPSLKNIFLELQQDIGCSIPNHGSLVSWAKQGVLLLNTVLTVRRGQANSHKGKGWERLTDRIIDVLSERERPVIFILWGRHAQMKKERIDTSKHFIIESTHPSPFSARNGFFGSRPFSRANAYLEKMGEAPIDWCIKDL

SEQ ID NO: 23354 - protein, 480 aa, Bacillus subtilis
MTAHDQELRRRAYEEVEKKEPIANSDPHRQHFHIMPPVGLLNDPNGVIYWKGSYHVFFQWQPFQTGHGAKFWGHYTTQDVVNWKREEIALAPSDWFDKNGCYSGSAVTKDDRLYLFYTGNVRDQDGNRETYQCLAVSDDGLSFEKKGVVARLPEAILTAHFSRSEVWEHEGTWYMVIGAQTENLKGQAVLFASDNLTEWRFLGPITGAGFNGLDDFGYMWECPDLFSLQGSDVLIVSPQGLEADGFRYQNVYQSGYFVGRLDYNKPELKHGEFTELDQGFDFYAPQTLEDDQGRRILFAWMAVPDQDEGSHPTIDCHWIHCMTLPRQLTLSGQKLIQQPLPELKAMRRNEKKIHINMHGSSGALPVEKPERTEILLEDIHTESGFSISIRGTATFSFHKDEGIVTLERKSFDGKRTEARHCRIKDLHTVHMFLDASSVEIFINNGEEVFSARYFPFPGNHEVTASATGKSEMNVGIWTLM

SEQ ID NO: 23355 - protein, 390 aa, Bacillus subtilis
MREELKGIFASVFGEKEGLRFFFAPGRVNLIGEHTDYNGGHVFPCALTMGTYAAVAERNDGLVRMYSDNFRNAGIKECSLDDIRYQKEDDWANYPKGVIYEFQQRGYAVPHGFDIVFSGNIPNGAGLSSSASIELLMGVVLQSYFHPEVDALELVKMAQHAENHFIGVNCGIMDQFAIGMGKKHHAMLLNCDTLDYEYSKLNVSGLALVIANTNKKRTLADSSYNTRRQECNDALLDLKKGLDIAALGDIKPSDFDAHSSLIQNETNRRRAKHAVYENHRAIKTAHMFKENNIDEIGQLMKESHLSLKDDYEVTCPELDELVFAAWDHEGVIGSRMTGAGFGGCTISIVKDEFVDDFIQKVGDRYQEKTGLRADFYVADIGEGARELKGE

SEQ ID NO: 23356 - protein, 442 aa, Bacillus subtilis
MTKGLKIVTIGGGSSYTPELVEGFIKRYDELPVRELWLVDIPEGEEKLNIVGTLAKRMVEKAGVPIDIHLTLDRRKALKDADFVTTQFRVGLLQARAKDERIPLKYGVIGQETNGPGGLFKGLRTIPVILEIAKDIEELCPNAWLVNFTNPAGMVTEALLRYSNLKKVVGLCNVPIGIKMGVAKALDVDVDRVEVQFAGLNHMVFGLDVFLDGVSVKEQVIEAMGDPKNAMTMKNISGAEWEPDFLKALNVIPCGYHRYYFKTKEMLEHELEASQTEGTRAEVVQKVEKELFELYKDPNLAIKPPQLEKRGGAYYSDAACNLISSIYNDKHDIQPVNTINNGAIASIPDDSAVEVNCVMTKTGPKPIAVGDLPVSVRGLVQQIKSFERVAAEAAVTGDYQTALLAMTINPLVPSDTVAKQILDEMLEAHKAYLPQFFNKIEA

SEQ ID NO: 23357 - protein, 196 aa, Bacillus subtilis
MTREKNPLPITFYQKTALELAPSLLGCLLVKETDEGTASGYIVETEAYMGAGDRAAHSFNNRRTKRTEIMFAEAGRVYTYVMHTHTLLNVVAAEEDVPQAVLIRAIEPHEGQLLMEERRPGRSPREWTNGPGKLTKALGVTMNDYGRWITEQPLYIESGYTPEAISTGPRIGIDNSGEARDYPWRFWVTGNRYVSR

SEQ ID NO: 23358 - protein, 547 aa, Bacillus subtilis
MKDDHQNKQHQSNAQGSEEAFSHKTSGKNESEDTLTNRQGHPVTDNQNVRTVGNRGPTTLENYDFLEKISHFDRERIPERVVHARGAGAHGYFEAYGSFGDEPISTYTRAKLFQEKGKKTPAFVRFSTVNHGKHSPETLRDPRGFAVKLYTEDGNWDLVGNNLKIFFIRDPLKFPDLVHAFQPDPVTNIQDGERIFDFISQSPEATHMITFLFSPWGIPANYRQMQGSGVHAYKWVNEEGKAVLVKYHFEPKQGIRNLTQKEAEEIQGKNFNHATQDLYDAIENGDYPEWEVYAQIMSDDEHPELDFDPLDPTKLWYKDDFPWKPIGKLVLNKNPENYHAEVEQASFGTGVLVDGLDFSDDKLLQGRTFAYSDTQRYRVGANYLQLPINSPKKHVATNQEGGQMQYRVDRAEGQNPHVNYEPSIMGGLKEAKQDGKDHTPHVEGDVKREAIDRTNNFGQAGETYRRFTEFERNELITNLVNTLSTCRKEIQDQMIENFTKADPDYGKRVAEGLKKVSENNSNGPIGTTETEQAAKQAEQESHPSDPY

SEQ ID NO: 23359 - protein, 295 aa, Bacillus subtilis
MLSIESLCKSYRHHEAVKNVSFHVNENECVALLGPNGAGKTTTLQMLAGLLSPTSGTIKLLGEKKLDRRLIGYLPQYPAFYSWMTANEFLTFAGRLSGLSKRKCQEKIGEMLEFVGLHEAAHKRIGGYSGGMKQRLGLAQALLHKPKFLILDEPVSALDPTGRFEVLDMMRELKKHMAVLFSTHVLHDAEQVCDQVVIMKNGEISWKGELQELKQQQQTNVFTLSVKEKLEGWLEEKPYVSAIVYKNPSQAVFELPDIHAGRSLLSDCIRKGLTVTRFEQKTESLEDVYLKVVHA

SEQ ID NO: 23360 - protein, 575 aa, Bacillus subtilis
MKKEEWILPYIKQNARLFVLVIFLGAVTIFSAAFLMFTSGFLISKAATRPENILLIYVPIVAVRTFGIARSVSRYVERLVGHHIILKIVSDMRVRLYNMLEPGALMLRSRFRTGDMLGILSEDIEHLQDAFLKTIFPAISALLLYAVSVIALGFFSWPFAILLALYLFVLVVLFPVVSLLVTRAKNAKLKSGRNVLYSRLTDAVMGVSDWMFSGRRHAFIDAYEKEERDWFELERKKQRFTRWRDFAAQCLVAGLILLMLFWTAGQQADGELAKTMIAAFVLVVFPLTEAFLPLSDALGEVPGYQDSIRRMNNVAPQPEASQTESGDQILDLQDVTLAFRDVTFSYDNSSQVLHNFSFTLRQGEKMALLGRSGSGKSTSLALIEGALKPDSGSVTLNGVETALLKDQIADAVAVLNQKPHLFDTSILNNIRLGNGEASDEDVRRAAKQVKLHDYIESLPDGYHTSVQETGIRFSGGERQRIALARILLQDTPIIILDEPTVGLDPITERELMETVFEVLKGKTILWITHHLAGVEAADKIVFLENGKTEMEGTHEELLAANERYRRLYHLDVPVK

SEQ ID NO: 23361 - protein, 485 aa, Bacillus subtilis
MSFETLNKSFINGKWTGGESGRTEDILNPYDQSVITTASLATGKQLEDAFDIAQKAQKEWAKSTTEDRKAVLQKARGYLHENRDDIIMMIARETGGTIIKSTIELEQTIAILDEAMTYTGELGGVKEVPSDIEGKTNKIYRLPLGVISSISPFNFPMNLSMRSIAPAIALGNSVVHKPDIQTAISGGTIIAKAFEHAGLPAGVLNVMLTDVKEIGDGMLTNPIPRLISFTGSTAVGRHIGEIAGRAFKRMALELGGNNPFAVLSDADVDRAVDAAIFGKFIHQGQICMIINRIIVHQDVYDEFVEKFTARVKQLPYGDQTDPKTVVGPLINERQIEKALEIIEQAKTDGIELAVEGKRVGNVLTPYVFVGADNNSKIAQTELFAPIATIIKAGSDQEAIDMANDTEYGLSSAVFTSDLEKGEKFALQIDSGMTHVNDQSVNDSPNIAFGGNKASGVGRFGNPWVVEEFTVTKWISIQKQYRKYPF

SEQ ID NO: 23362 - protein, 257 aa, Bacillus subtilis
MRKQVALVTGAAGGIRFEIAREFAREGASVIVSDLRPEACEKAASKLAEEGFDAAAIPYDVTKEAQVADTVNVIQKQYGRLDILVNNAGIQHVAPIEEFPTDTFEQLIKVMLTAPFIAMKHVFPIMKKQQFGRIINIASVNGLVGFAGKSAYNSAKHGVIGLTKVGALEGAPHGITVNALCPGYVDTQLVRNQLSDLSKTRNVPYDSVLEQVIFPLVPQKRLLSVKEIADYAVFLASEKAKGVTGQAVVLDGGYTAQ

SEQ ID NO: 23363 - protein, 686 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFPYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPAKRKASKENLTSPALSQARTVKTASTRKVAVLAGNGFHEKELQTVLEALKQEGITVDIISQNLGYMTSGSGQQLEASGTFLTVDSVLYDAVYAAGGLELKDNKQAMAFIREAYNHYKAIGAANEGIDLLQSSVGTTEGLGIVTAKDEPDYTAFSKAFIDAVAAHRHWDRRI

SEQ ID NO: 23364 - protein, 479 aa, Bacillus subtilis
MSHFKNYQISHDILRALEGLGYTEPTKVQQSVIPAALERKDLVVKSQTGSGKTASFGIPLCELANWDENKPQALILTPTRELAVQVKEDITNIGRFKRIKATAVFGKSSFDKQKAELKQKSHIVVGTPGRVLDHIEKGTLPLDRLSYLVIDEADEMLNMGFIEQVEAIIKHLPTERTTMLFSATLPQDIEKLSRQYMQNPEHIEVKAAGLTTRNIEHAVIQVREENKFSLLKDVLMTENPDSCIIFCRTKEHVNQLTDELDDLGYPCDKIHGGMIQEDRFDVMNEFKRGEYRYLVATDVAARGIDIENISLVINYDLPLEKESYVHRTGRTGRAGNKGKAISFVTAFEKRFLADIEEYIGFEIPKIEAPSQEEVARKKPEFLAKLNDRPESKKDKSEELNKDIMKLYFNGGKKKKIRAVDFVGTIAKIDGVSADDIGIITIMDNASYVEILNGKGPHVLKVMKNTTVKGKQLKVNKANK

SEQ ID NO: 23365 - protein, 508 aa, Bacillus subtilis
MVTLDGSSLTTADVARVLFDFEEAAASEESMERVKKSRAAVERIVRDEKTIYGINTGFGKFSDVLIQKEDSAALQLNLILSHACGVGDPFPECVSRAMLLLRANALLKGFSGVRAELIEQLLAFLNKRVHPVIPQQGSLGASGDLAPLSHLALALIGQGEVFFEGERMPAMTGLKKAGIQPVTLTSKEGLALINGTQAMTAMGVVAYIEAEKLAYQTERIASLTIEGLQGIIDAFDEDIHLARGYQEQIDVAERIRFYLSDSGLTTSQGELRVQDAYSLRCIPQVHGATWQTLGYVKEKLEIEMNAATDNPLIFNDGDKVISGGNFHGQPIAFAMDFLKIAISELANIAERRIERLVNPQLNDLPPFLSPHPGLQSGAMIMQYAAASLVSENKTLAHPASVDSIPSSANQEDHVSMGTIAARHAYQVIANTRRVIAIEAICALQAVEYRGIEHAASYTKQLFQEMRKVVPSIQQDRVFSYDIERLTDWLKKESLIPDHQNKELRGMNI

SEQ ID NO: 23366 - protein, 319 aa, Bacillus subtilis
MDKYPFLREAGSSFKDRDVTKMSDLIATWDGQDIKGPALIGVPLSKSSISHSGASFAPGTIRQALKHSSAYSAELGEHVVSELLYDLGDIDIHVTDIVKSHHHIFQTMHALLSDHPDWVPLILGGDNSISYSTIKAIAQTKGTTAVIQFDAHHDVRNTEDGGPTNGTPFRRLLDEEIIEGQHLIQLGIREFSNSQAYEAYAKKHNVNIHTMDMIREKGLIPTIKEILPVVQDKTDFIFISVDMDVLDQSHAPGCPAIGPGGLYTDELLEAVKYIAQQPNVAGIEIVEVDPTLDFRDMTSRAAAHVLLHALKGMKLSPFK

SEQ ID NO: 23367 - protein, 475 aa, Bacillus subtilis
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 23368 - protein, 290 aa, Bacillus subtilis
MAFVSMKELLEDAKREQYAIGQFNINGLQWTKAILQAAQKEQSPVIAAASDRLVDYLGGFKTIAAMVGALIEDMAITVPVVLHLDHGSSAERCRQAIDAGFSSVMIDGSHQPIDENIAMTKEVTDYAAKHGVSVEAEVGTVGGMEDGLVGGVRYADITECERIVKETNIDALAAALGSVHGKYQGEPNLGFKEMEAISRMTDIPLVLHGASGIPQDQIKKAITLGHAKININTECMVAWTDETRRMFQENSDLYEPRGYLTPGIEAVEETVRSKMREFGSAGKAAKQQVG

SEQ ID NO: 23369 - protein, 325 aa, Bacillus subtilis
MKYTFNEEKAFDIVAIGRACIDLNAVEYNRPMEETMTFSKYVGGSPANIAIGSAKLGLKAGFIGKIPDDQHGRFIESYMRKTGVDTTQMIVDQDGHKAGLAFTEILSPEECSILMYRDDVADLYLEPSEVSEDYIANAKMLLVSGTALAKSPSREAVLKAVQYAKKHQVKVVFELDYRPYTWQSSDETAVYYSLVAEQSDIVIGTRDEFDVMENRTGGSNEESVNHLFGHSADLVVIKHGVEGSYAYSKSGEVFRAQAYKTKVLKTFGAGDSYASAFIYGLVSGKDIETALKYGSASASIVVSKHSSSEAMPTAEEIEQLIEAQS

SEQ ID NO: 23370 - protein, 487 aa, Bacillus subtilis
MAEIRKLKNYINGEWVESKTDQYEDVVNPATKEVLCQVPISTKEDIDYAAQTAAEAFKTWSKVAVPRRARILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARYPAPDFN

SEQ ID NO: 23371 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLSAMGIAWVFMVFSVICLLSFFFAFYMVPETKGKSLEEIEASLKKRFKKKKSTQNQVLNERTL

SEQ ID NO: 23372 - protein, 626 aa, Bacillus subtilis
MAKKEFKAESKRLLDMMINSIYTQKEIFLRELISNSSDAIDKIYYKALTDDALTFDKDSYYIKVAADKDARTLTISDTGIGMTKDELEQHLGTIAKSGSLAFKKENELKDGHDIIGQFGVGFYAAFMVADVVTVISKALGSEEAYKWESAGADGYTIEPCEKDSVGTDIILKIKENTEDDSYDEFLEEYRLKAIIKKYSDFIRYPIKMDTTINKPKEGSENEFEEVQEEQTVNSMVPIWRKNKSELTDEDYEKFYAEKHYGFDKPLTHVHISVDGAVRYNAILFVPENMPFDYYSKEYEKGLELYSNGVLIMNKCADLLPDHFSFVKGMVDSEDLSLNISREMLQHDRQLKLIAKNISKKIKSELQSLLKKDREKYETFYKSFGRQLKFGVYNDFGANKDQLKDLLLFYSSKEKKLVSLDEYVSRMPEEQKFIYYATGDSYDRIEKLPQTEMVADKGYEILYFTEDIDEFAIKMLASYQEKEFKSVSSGDLGIDTDEDQKQSEEEESKYKDLFEEMKNILSDKVKNVRISKRLKSHPVCLAADGEVTIEMEKILNAMPDSQNVKAEKVLEINPNHEVFQTLQDAFEQDKEKLSLYTNLLYNQALLIEGLPIQDPVEFTNNICKVMV

SEQ ID NO: 23373 - protein, 262 aa, Bacillus subtilis
MGRLENKTAVITGAATGIGQATAEVFANEGARVIIGDINKDQMEETVDAIRKNGGQAESFHLDVSDENSVKAFADQIKDACGTIDILFNNAGVDQEGGKVHEYPVDLFDRIIAVDLRGTFLCSKYLIPLMLENGGSIINTSSMSGRAADLDRSGYNAAKGGITNLTKAMAIDYARNGIRVNSISPGTIETPLIDKLAGTKEQEMGEQFREATNGSRRSDVLASPKKWQQWHCSSHQTTAHTSQEKTSPQTAASWRTHGLGRC

SEQ ID NO: 23374 - protein, 445 aa, Bacillus subtilis
MEQQVKDDIQRVFQLQKKQQKALRASTAEQRREKLQRFLDSVIAHEEEIIEAIRKDVRKPYHEVKKAEIEGTKKAIRDNMNNLEQWMAPKEVGSSLSPDANGILMYEPKGVTLILGPWNYPFMLTMAPLAASLAAGNSAIVKLSDFTMNTSNIAAKVIRDAFNEKEVAIFEGEVEVATELLDQPFDHIFFTGSTNVGKIVMTAAAKHLASVTLELGGKSPTIIDSEYDLMDAAKKIAVGKFVNAGQTCIAPDYLFIKKDVQDRFAGILQTVVNAGFMEDDHTPDRSKFTQIVNDRNFNRVKDLFDDAIERGAEVVFGGVFDASDRTISPTVLKNVTPDMKIMQEEIFASILPMMNYEDIDEVIDYVNDRDKPLALYVFSKNQDLIDNVLQHTTSGNAAINDVVVHFSDVNLPFGGVNTSGIGSYHGVYGFKEFSHEKGVFIQAAE

SEQ ID NO: 23375 - protein, 307 aa, Bacillus subtilis
MTIDHSVTNTEQLEQQNPAIKTKLKLKKLKDQVIVITGASSGIGLVTARMAAEKGAKVVAAARNEEALKELTDELKEKGHDAIWVKADVGKEEDVNRIAETAISTFGRFDTWVNNAAVSTFGHAMDVTVEDMKRMFDTNFWGPVYGTRAAVKHYTGRGVPGALINVGSLFGDRGTVIQSTYASAKFALHGWTESIRMELEKEQAPVSVTLIHPGRIDTPYNEHAHSYLDKQPAHYRSMIYPPEAVAEAILFAAEHPKRDMYIGSQAKAIAMLGALFPRLDRQTDGKNHVSQPACRKTVQSERRKRSL

SEQ ID NO: 23376 - protein, 513 aa, Bacillus subtilis; identical to SEQ ID NO: 16749

SEQ ID NO: 23377 - protein, 468 aa, Bacillus subtilis
MFNSIGVIGLGVMGSNIALNMANKGENVAVYNYTRDLTDQLIQKLDGQSLSPYYELEDFVQSLEKPRKIFLMVTAGKPVDSVIQSLKPLLEEGDVIMDGGNSHYEDTERRYDELKEKGIGYLGVGISGGEVGALTGPSIMPGGDRDVYEKAAPILTKIAAQVGDDPCCVYIGPKGAGHFTKMVHNGIEYADMQLIAEAYTFLRETLRLPLDEIASIFETWNQGELKSYLIEITAEILRKKDEKTGQPLIDVILDKTGQKGTGKWTSMQAIDNGIPSTIITESLFARYLSSLKEERMAAQDVLAGPEAEEKHLDKDTWIEYVRQALYMGKVCAYAQGFAQYKMSSELYGWNLPLKDIALIFRGGCIIRADFLNVISEAFSEQPNLANLLIAPYFTDKLHAYQTGLRKVVCEGISTGISFPCLTTALSYYDGYRTGRSNANLLQAQRDYFGAHTYERTDMDGVFHTNWSE

SEQ ID NO: 23378 - protein, 187 aa, Bacillus subtilis
MSLIGKEVLPFEAKAFKNGEFIDVTNEDLKGQWSVFCFYPADFSFVCPTELEDLQEQYAALKELGVEVYSVSTDTHFVHKGWHDSSEKISKITYAMIGDPSQTISRNFDVLDEETGLADRGTFIIDPDGVIQTVEINAGGIGRDASNLVNKVKAAQYVRQNPGEVCPAKWEEGGETLTPSLDLVGKI

SEQ ID NO: 23379 - protein, 479 aa, Bacillus subtilis
MGNMPKDFLWGGALAAHQFEGGWNQGGKGPSVVDVMTAGAHGVPRKITDTIEENEFYPNHEAIDFYHRYKEDIALFAEMGLKCLRTSIGWSRIFPKGDEAEPNEAGLQFYDDVFDELLKHGIEPVITLSHFEMPLHLAREYGGFRNRKVVDFFVNFAEACFTRYKDKVKYWMTFNEINNQMDVNNPLFLWTNSGVVVGENENAKEVMYQTAHHELVASALAVAKGKDINPEFQIGAMVSHVPIYPFSSNPEDVMLAEEEMRQRYFFPDVQVRGYYPSYALKEFEREGYNITFEDGDDEILRNGTVDYLGFSYYMSTTVKSDVKNDNTGDIVNGGLPNGVENPYITSSDWGWAIDPTGLRYTLNRFYDRYQIPLFIVENGFGAVDTLEEDGKVHDPERIQYLKSHIEALKKAVTYDGVDLIGYTPWGIIDIVSFTTGEMKKRYGMIYVDRDNEGNGSMKRYKKDSFEWYKNVIQTNGEEL

SEQ ID NO: 23380 - protein, 586 aa, Bacillus subtilis
MIVMIIKNLFVCNSQEILKEYKFNAVGVNIILGEKREDHEETNGVGKSTMIECISFLLGKTISNFYTTNEILLNKNVFIVLNVEIDGNQVFLARSFNSPKHGYTLHDTSLTFNLEEWKKVSISVYKKFIEKEILKGEKEDITFAALREYIIRDEKTGFNDIVLPNRGGLKQYKLLNYLFTLPTHTEKNIKVFRDKIEKLNSEIKLIESMNINIGDLKVKEDELINEIEDYNRVIYQTKTANKYNNDTNRYSEIKSELNKIQNEIFENEHICKQYQRNIDDLNKKVTKIKELENIEKFYEDIVGFFPEEVKQNYNKVQEFYNFMVESRGSYFKDKIVKIQADLKKLNIKKQGLTEQLESSARILKSNNFIEDISIVMEEQRRKEIELAEVRLRISDYDKKNHIFDKINELQHEILRVNSMYYDEFQSYSAIVSELKKLFNNLMDVTYNQHGFLDFEYDNRISNAKQSTTGRIKISCSIPDERSHGRLHMKINIFDLTWFLYRCINKCSLNILIHDGSYSNPDPHVKGTLLKHINSSLLENRIGQYFVTINKNELLLDDLQELESKGMIVAKLDRNNEDKNRFFGFRF

SEQ ID NO: 23381 - protein, 296 aa, Bacillus subtilis
MDKTISVIGMPMDLGQARRGVDMGPSAIRYAHLIERLSDMGYTVEDLGDIPINREKIKNDEELKNLNSVLAGNEKLAQKVNKVIEEKKFPLVLGGDHSIAIGTLAGTAKHYDNLGVIWYDAHGDLNTLETSPSGNIHGMPLAVSLGIGHESLVNLEGYAPKIKPENVVIIGARSLDEGERKYIKESGMKVYTMHEIDRLGMTKVIEETLDYLSACDGVHLSLDLDGLDPNDAPGVGTPVVGGISYRESHLAMEMLYDAGIITSAEFVEVNPILDHKNKTGKTAVELVESLLGKKLL

SEQ ID NO: 23382 - protein, 467 aa, Bacillus subtilis
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 23383 - protein, 401 aa, Bacillus subtilis
MTALSKSKEIIDQTSHYGANNYHPLPIVISEALGAWVKDPEGNEYMDMLSAYSAVNQGHRHPKIIQALKDQADKITLTSRAFHNDQLGPFYEKTAKLTGKEMILPMNTGAEAVESAVKAARRWAYEVKGVADNQAEIIACVGNFHGRTMLAVSLSSEEEYKRGFGPMLPGIKLIPYGDVEALRQAITPNTAAFLFEPIQGEAGIVIPPEGFLQEAAAICKEENVLFIADEIQTGLGRTGKTFACDWDGIVPDMYILGKALGGGVFPISCIAADREILGVFNPGSHGSTFGGNPLACAVSIASLEVLEDEKLADRSLELGEYFKSELESIDSPVIKEVRGRGLFIGVELTEAARPYCERLKEEGLLCKETHDTVIRFAPPLIISKEDLDWAIEKIKHVLRNA

SEQ ID NO: 23384 - protein, 430 aa, Bacillus subtilis
MSSVVVVGTQWGDEGKGKITDFLSENAEVIARYQGGNNAGHTIKFDGITYKLHLIPSGIFYKDKTCVIGNGMVVDPKALVTELAYLHERNVSTDNLRISNRAHVILPYHLKLDEVEEERKGANKIGTTKKGIGPAYMDKAARIGIRIADLLDRDAFAEKLERNLEEKNRLLEKMYETEGFKLEDILDEYYEYGQQIKKYVCDTSVVLNDALDEGRRVLFEGAQGVMLDIDQGTYPFVTSSNPVAGGVTIGSGVGPTKIKHVVGVSKAYTTRVGDGPFPTELKDEIGDQIREVGREYGTTTGRPRRVGWFDSVVVRHARRVSGITDLSLNSIDVLAGIETLKICVAYRYKGEIIEEFPASLKALAECEPVYEEMPGWTEDITGAKSLSELPENARHYLERVSQLTGIPLSIFSVGPDRSQTNVLRSVYRAN

SEQ ID NO: 23385 - protein, 451 aa, Bacillus subtilis
MNTIFKQKNTHPFSNAANRLDRLPISRVHFQVLTALGIVYFFDLADLFTLSNVAPALIEHWGIPLSTIANVTAASFLGMFLGASLGGRLSDRIGRKKALNLFVFVFSIASLCNAAAWDIPSLMTFRFLTGFGVAAAMVITDSYLAEFFPSSVRGKYISFCAMIGLIGVPITNIVSAFVIPLGSWGWRLVFVWGAVGLIYFFFIHRLEESPRWHENRGEYAKADAILTRIEEQVEKEKGPLPAASQPKVSETVKQNAGYAGLLKGRNLKITIVLSAVWIFETFGFYGFASWVPSLLKSNGVTMENTLWYNVLHSVGAPLGALLGSMISERFQRKWILAASAFLTAIAGLLYGMTFIPIMIIVFGFIVNITERVFTSNLYAYTSEPYPTEYRSSGSGLAYGLGRFSNIFGSLLVGFIAVQLGYISVFLFIGGCWLACSLLLIFFGPNTNAKQI

SEQ ID NO: 23386 - protein, 252 aa, Bacillus subtilis
MKLISWNVNGLRAVMRKMDFLSYLKEEDADIICLQETKIQDGQVDLQPEDYHVYWNYAVKKGYSGTAVFSKQEPLQVIYGIGVEEHDQEGRVITLEFENVFVMTVYTPNSRRGLERIDYRMQWEEALLSYILELDQKKPVILCGDLNVAHQEIDLKNPKANRNNAGFSDQEREAFTRFLEAGFVDSFRHVYPDLEGAYSWWSYRAGARDRNIGWRIDYFVVSESLKEQIEDASISADVMGSDHCPVELIINI

SEQ ID NO: 23387 - protein, 667 aa, Bacillus subtilis
MSKVHQSACPLNCWDSCGFLVTVDDGKVTKVDGDPNHPITEGKICGRGRMLETKTNSPDRLRYPMKKQNGEFVRISWEQALDEIADKLREIKETSETTAVLHSHDYANNGLLKALDQRFFNGYGGVTEIVGSICWGSGIEAQSWDFGRSYGHGPLDIYNSKHVVVWGRNVSRTNMHLYHHLQQVKKKGATITVIDPIFNPTAKLADRYISVKPGMDGWLAAAVLKVLIEMGRTDETFISEHSVGFDDVKELLKTVSLEEFIVKTETSMEELEYLAGLYADGPVSTFMGLGMQRYKNGGGTIRWIDALVAASGNVGIKGGGANFGNVQIGESFAKTKLTLPELKTTSRSFSMMTQAEEVLTAADPAIEMIIVTCGNPLTQVPNTNKVRQAFEKVPMTVAIDSIMTDTAELCDYVLPTATVFEEEDIYYSSMYHHYVQYGKKLVEPQGEAKSDSWIWSELAKRLGFGELFEYSTQEFLEMGLSSLEAEDVTLERLKEKGHLPLPVKQVPWDDYQFLTPSGKFEFTSSLAEQKGFSGSLQLNVPEESVFHNEELAGKYPYTLLSIHPQRSNHSQHVPFIEKLQHVQVDISPDIAAGQDLQDGDEVVIFNDRGSMKGKVKVMKQAHAKTINIDEGMWAAFGGSVNALTNDTNSDNGMGSTLFDCLVGLKKA

SEQ ID NO: 23388 - protein, 381 aa, Deinococcus radiodurans
MPPAVRVPGGLKFMIQPFTADPIRFVAEDGRPVLALPERYTPALLRELHRLMLQGREFDRKLITLLRQGRTSFYSQASGMEATQIGLAKAIRAGHDWVWGYYRDQVLGMGLGVPMFTLISQCLGSNTDECRGRQMPHHFSSRAHNFVSASSSIASQVPPAAGNARAQKYLGTDEITVVTFGDGATSEGDWHTGMNMAGAMQAPCLFVCENNQWAISTHIRHQTASENIHIKAKAYGMPGFYVDGNDVVAVMEVCHHAAEWVRAGNGPALVECLTYRVGSHSNADADAEKSYRTRDEVNEWLGRDPIQRVENLLEHLGDPISAEERAGMIAEIHKQIDDDVRRAEAAGYPDWRIMFEDVYSDMPDHLRQQAAMLREEQGGSA

SEQ ID NO: 23389 - protein, 344 aa, Deinococcus radiodurans
MTATQEKQAQGKQAGTEQPAVRTLNLIQAITEALADELERDPNVVLFGEDVGARGGVFMATAGLQERFGKKRVFDTPLAEGSIVGAAVGMAVRGMRPIAEIQFADYIGPGFDQILSQAAKIRYRSGGQFSAPLVIRTPSGGGVKGGHHHSQSPEAYYCHMAGIKVVMPSTPYDAKGLLKAAVRSDDPVMFFEPKRLYRAAKGEVPEHDYVVELGKAAIRREGDDLSLIGYGGVMPDLERAADALAAEGISVEVIDLRSLVPWDRPLVLQSVEKTGRAVLVSEAPRMANFMGEVAYTIQNEAFDSLSAPVQQVAGFDTPYPYIQDKIYLPGANRIVAACVKALNY

SEQ ID NO: 23390 - protein, 525 aa, Deinococcus radiodurans
MKELLLPELAESVVEGEILKWLVEEGDAIALEQPLCEVMTDKVTVELPSPFEGTLHKRMANEGDVVAVHAVIALIDDGAGAGAGAIPSATQAIQDSAENPTTTEVTLPAQAEEEREAMGGSIVEAGHIAKADDDSTSLFKTFANDEEVKVQGLGARSGSGAPGSSTAGTGTLDRAPETAPASPTPATANGGRVLAVPAARQAARELGIDLAAVRGSGPNGRIRVADVLAHQQSGQAQPQQTQPQQAAASQAVAPQPQAAAPAAPAPAGKLAAPSAHLPAPVQYRTPKGYEDRETRVPLRGMRRAIANQMQASHLYTVRTLTVDEVNLTKLVEFRQRVKDEAKAADVKLSYLPFIFKAITVALKKYPSLNTSFDEATQEIVQKSYYNLGMAVATEAGLTVPVIRDVDRKSIFDLARDVVDLAGRANAGKLSPDELTGSSFSVTNIGSIGALFSFPIINVPDAAIMGVHSIVKRPIVDEHDNITVAHMMYLSLSFDHRLIDGAEAARFCKEVIRLLENPDRLMLEGF

SEQ ID NO: 23391 - protein, 405 aa, Deinococcus radiodurans
MPGIAIVGAQWGDEGKGKIVDFLAPEAEYVVRYQGGANAGHTVNAKGKTFKLNLLPSGVLHEGATSILGDGMVIDPEKFIEERRNLMEGGLNPRLKISDRAHIVLPHHKYVDGRKDFVGTTGKGIGPAYADRARRVGIRFGDLLDEGVLRERIERLLEAKPNSTRDAGWATVEDGLKSLAPIREQLAPFIADTGSELRQAIKDGRKVLFEGAQATLLDLNYGTYPFVTSSHPTVGGILVGTGVNHKALHRVYGVAKAFNTRVGHGPFATEVHDEAGILRLRGDGSQPWDEYGTTTGRPRRVGWLDLELLKYAVDVNGLDGLVINKMDILGGLDEIPVCTGYDEGGQPVFKKMKGWSSTDGVTSRATLPKEAQAYLDLIEDTVQCPVVIFSAGPEREKTYGEVHWG

SEQ ID NO: 23392 - protein, 216 aa, Deinococcus radiodurans
MPQARGEGATPPTSLPNPSLKGVPLPDNPNNLEPLTREWLAAIGEDPDREGLQRTPQRVAKAWAYMTEGYGQTLAQVVGEGVFAAEGSEMVIVKDIEFYSMCEHHMLPFYGRAHVAYIPGTRILGLSKFARIVDLYSRRLQVQERITTQVADAVEELLAPKGVAVLMEGIHLCMAMRGVQKQNSSTTTSAMRGLFRSDPRTRAEFMSAVQGTLRGR

SEQ ID NO: 23393 - protein, 273 aa, Deinococcus radiodurans
MLPAPRFDRDTRLCMSLAAGPGNFGTRFHNYLYELLGLNYMYKAFTTQDLPAAIGGIRALGIRGCAVSMPFKEAVIPLLDELMPSAAAIESVNTIVNDDGVLRAYNTDYEAVRLLIREKELDPSWRVGVRGSGGMGKAVASALRDAGFENGVLVARNEAAGRELAGRLGWRWTPEPEAADLLVNVTPIGMAGGPEEHDLSFAPELIAQARAVFDVVALPAETPLIAEARRQGKPVVTGEEVAALQALEQFVLYTGVRPTPEQVQAAAAWARQG

SEQ ID NO: 23394 - protein, 306 aa, Deinococcus radiodurans
MNKPKIFIDGEAGTTGLQIRERLAGRSDLELLSIDPVRRKDSAARAELLNAADVSILCLHDDAAREAVSLTTNPASRLLDASTAHRIHPDWVFGFPELSAEQPEKIRQARYVANPGCYSTGAIALLAPLTGRGLLPADFPVHIQGYSGYTGGGRALVDAHEQGSAHPSKGAFISYGLTLEHKHLPETMVYGGLTRKPVFTPNVGGWAQGMTVTVPLHLAELGVSAEALHAALKEHYAGQQYVKVFELADNPEILDPQTLNGTNNLELFVYPAADGERALLAARLDNLGKGASGAAVQNLELMLGLS

SEQ ID NO: 23395 - protein, 353 aa, Deinococcus radiodurans
MTTLDRGGVYFFPMTKAARSSKKSAPSVPTPAQARLHTPDTLPRPVLAGRDFLSNLDMTSAELRAVMDTAHSMKAGEWRAVKPLSGLSLALVFEKASLRTRTTFDVGMYQLGGHAITLSNTEIGLGTRERVSDVARNLERWVDGVMGRVYLQQTLVELAQHARIPVINGLSDMLHPAQLLADYQTIEEEFGQDLRGKRVVYIGDGNNLANSHIHMGILTGTDVTVVTPVGYEPNAGVLMDAVKAGVEVHLTNDLDAIQGADVLYTDVWISMGQEAEADIRRRAFRGYQVTPEMLETISPDGIFLHCLPAHYGEETVPEATEHPKSRVFDQAENRLHAQKALLYHVLGDMKPRW

SEQ ID NO: 23396 - protein, 417 aa, Deinococcus radiodurans
MADIKVPVFSESVSEGTLLTWHKKPGEAVKRGELLAEIETDKVVLEVTAQQDGVLQSIAKNEGDTVLSEEVLGTMGEGDAAAPAPAAQDQASGPVASETTAGGTAQQPDSTGTQPAAQSGERREDLSPAVRKIVEEKGLDVSQVPATGPKNNITKADAMGASAPAPAAQPAPQAAKSAVVLPSGPRPEERVPMTRIRARIAERLKEVQNTAALLTTFNEVNMQPTMELRKKYQDQFVKKHGVKLGFMSLFVRAATEALKAFPMVNASVDGKDVIYHGYYDIGIAVASERGLVVPILRDTDNMSLADIEKQIAEFATRARAGKLTMEDMSGGTFSITNGGTFGSMMSTPIINAPQSAILGMHNIIERPIAQNGQVVIAPMMYLAVSYDHRLIDGKEAVQFLVMIKNLLEDPARMLLDL

SEQ ID NO: 23397 - protein, 511 aa, Deinococcus radiodurans
MPDYDLIVMGAGHNALVTAAYAARAGLKVGVFERRHLVGGAVSTEEVVPGYRFDYGGSAHILIRMTPIVRELELTRHGLHYLEVDPMFHASDGETPWFIHRDAGRTIRELDEKFPGQGDAYGRFLDDWTPFARAVADLFNSAPGPLDLGKMVMRSGQGKDWNEQLPRILRPYGDVAREYFSEERVRAPLTWMAAQSGPPPSDPLSAPFLLWHPLYHEGGVARPKGGSGGLTKALRRATEAEGGEVFTDAPVKEILVKDGKAQGIRLESGETYTARAVVSGVHILTTANALPAEYVPSAARNVRVGNGFGMILRLALSEKVKYRHHTEPDSRIGLGLLIKNERQIMQGYGEYLAGQPTTDPPLVAMSFSAVDDSLAPPNGDVLWLWAQYYPFELATGSWETRTAEARENILRAFEHYAPGTRDTIVGELVQTPQWLETNLGLHRGNVMHLEMSFDQMFSFRPWLKASQYRWPGVQGLYLTGASTHPGGGIMGASGRNAARVIVKDLTRRRWK

SEQ ID NO: 23398 - protein, 583 aa, Deinococcus radiodurans
MAAPSPTLTVLRTYLGPLRGAVAALAALLLVGTGLNLLLPQLLSRFVDAAKLGAQADVALLVRLAVTYLVLAVGVQLLSAGATYLGARVGWQATNRLRADLTAHLLSLDMQEHKERTPGEMIERIDGDVTALSNFFSQFAVRVFGAALLLTGAVVMFWRTDWRVGAGVTVFVALTLWAMNRVRKGGVEPTQQEREASAKLFGYVEERLAGLDDVRSLGAGEYHLRGFLKVQREFFSRSIFSWRRRAVVWQLSMALFAVGYVALLASAVGLYAAGAITLGTAFALYQYMTMVEEPIDQLTNQLQDLQKAGASVMRVGELLALRSHLPEGTRELPPGPLDLRFDHVGFSYGGAEGTPVLRDVDLTLEAGQTLGLLGRTGSGKTTLTRLVSRLYDPTSGSVRLGGVDTRDVTLASLRSRVAVVTQDVQLFQASVRDNLSFFDEGVSDAQVEAALAEVGLGDWLSRLPEGVRTPLPAGSLSAGQAQLLAFARVMLRDPAVIILDEPSSRLDPATEAQLTAAMTRLLAGRTAIVIAHRLDTVARADRIVVLGAGEVLEDGARTDLARDPRSHYAGLLRAGREAEAVLA

SEQ ID NO: 23399 - protein, 340 aa, Deinococcus radiodurans
MDGVYKGKPFLCWKRLFCLGRHSVYLRRLFGIGRCSTLSGRFHSRPFHVPTPRRFSMTQSSPNRPADPATTFRPDLLAGKHALITGGGSGINLGIAQSFAAHGCAVTILGRNLEKAQNAAQGIVDAGGRAMGVSADVRDFAALEAAVAAATAEFGDFDIVLAGAAGNFPAPVDGISPNGFKTVVDIDLLGTYNTIKAAAPRLKVPGGNILSISAYGVPVPMQAHVVAAKAGVDALTQTLAVEWGLRGVRVNAIIPGPIDGTEGMARLAPDEKSRSAFTRTVPLGRFGVPQDIANAALFLVSDAASYVTGVILPVDGGQNMLGGAPQYQMYLQMQAAQQKD

SEQ ID NO: 23400 - protein, 445 aa, Deinococcus radiodurans
MFKKILIANRGEIALRVIRTAREMGIQTVVVYSTADEKSLPVLLADESVCVGPPASNQSYLNIPNILSAALMTGAEAIHPGYGFMAENPDFAEMCREHGIVFIGPTPESMRALGSKAGGREIAAQSNVPTVPGTGVLESVDAALLAAKQIGYPVLLKASAGGGGRGQKVIRTQEELQKGFNQAQEEARLYFGDPAIIMEKFLEEFRHIEVQVMGDGQGHVIHIGERDCSIQRRNQKLIEEAPSTLPESLRQEILAAGVRLAQFVNYAGAGTLEFIMDRDGNYYFMEMNTRIQVEHCVSEMISSLDLVRLQIEIAAGLGLNIQQDDVKLHGHAIECRINAEDPDKDFRPAAGKIDDAHFAGGAGVRVDTHVYSGYSIPPHYDSLIGKLIVWHEDRDKAVSRMKRALEETVIQGPKTTIPLYIKIMDNPFYKRGAVMTNFLKTRMEM

SEQ ID NO: 23401 - protein, 208 aa, Deinococcus radiodurans
MSEGKVRVKVCGTTTLPDALHAAAAGADALGFIFAPGSKRRVTASQARGISLNVGPSVARIGVFMGQSLDEVLRTAEAARVSAVQLHGPLPGVYVAAVAGYYPVLRVLGPEELQAGNVQAATVQATPGVTLMLDAPQPGSGQPLDWAALVPHFPPGSWLAGGLGPDNVAQAIATLRPAGVDAVSRLEASPGLKNPQAVEAFIDAVKRS

SEQ ID NO: 23402 - protein, 628 aa, Deinococcus radiodurans
MAKAVGIDLGTTNSVIAVMEGGRPEVIVNAEGGRTTPSVVAYKGDEILVGQIARRQAALNPAATLFEVKRFIGRRWDEVKEEAARSPFTVKEGPSGSVRIEVNGKDLAPEQVSAEVLRKLVSDASAKLGNKITDAVITVPAYFDNSQREATRQAGEIAGLNVLRVINEPTAAALAYGLERKGNETVLVFDLGGGTFDVTILELGDGVFEVKSTAGDTHLGGADFDYRIVDWLAGEFQKEHNFDLRKDKQALQRLIEAAEKAKIDLSNASETSISLPFITFDPETRTPMHLERSLSRAKFEELTADLLRRVRQPVEQALSDAKLSAGDINEVILVGGSTRIPAVKRIVQDLVGKTPNESVNPDEAVALGAAVQAGIIQGDSSLGDIVLVDVTPLTLGVEVKGGMIAPMITRNTTVPAKKTEIYTTAENNQPGVEINVLQGERPMAADNKSLGRFKLEGIPPMPAGRAQIEVTFDIDANGILHVTAKEKTSGKESSITIENTTTLDKTDVERMVQEAEQNAAADKQRKEKVEKRNNLDSLRVQAVQQLEEQEGAAQDAKDRLKAAADEAEEAVRSEDDSKIADAQKKLEEELRSFMTANQASTQGQPEGTQAQANKADDDVIDADFKPAE

SEQ ID NO: 23403 - protein, 606 aa, Deinococcus radiodurans
MSQPAQPSVTRRLYGLLTPYRTAVGAGLLLLLGSVAAELYPPLVWIRVVDQGIPARDWGLIGGQLAVLVGVFALQQVLSAWRGVLLERAGQQFTLDLRTAVYRKLQSQSADYFETQRTGDLLVRVTGDVDALQDVLVRGTDSVIANALRLVGVIGIFIALQPLLGVLTTLPMLAVGLLLWNYGKTVRPAYRAARARLGELSALIADRLAGIRVVQGFAREEAEAARVEALGRELYREQARAVALRNRAFPVARFVGNLGNVIMLGGGAWLILAGQFTLGGLLAYRGYGRYFYGPIDDLVNISDLLQRAEAAGRRVFAVLDAPVTVADPAHPKPLPTPVRGELHFDNVTFGYDSASYDSASSDPTQPILRGVTLHIPAGQRVALLGASGAGKSTLLGLVTRQHDPQSGRVLLDGVDVRDVALAELRTAAAVMPQDTFLFHDTVLENVRYARPDAALAEVEEALRAAYALDFVRALPQGLETLVGERGVRLSGGQRQRLAIARTLLARPALLLLDEPTSAVDAESEAQVVAALNDLMQGRTSLTVTHRLSLARAADRVLVLDGGVVVEDGPPALLRTRGGPYARLEQVAERLERGEVAVISEVVNSSL

SEQ ID NO: 23404 - protein, 84 aa, Deinococcus radiodurans
MNFEQAQQEVNTLSKKPGNDVLLKLYALYKQGSAGDVDGKRPGGFDFVGGAKYDAWAGLKGKTQEQAQQEYVALVEELKAKDGQ

SEQ ID NO: 23405 - protein, 354 aa, Deinococcus radiodurans
MPSPSGGWGCGGTWARGVDGARLFSIHHQAVRPNLSTISPPKEPPMIEVRHLCKSFARKPAVQDISFSIPAGEIVGYLGPNGAGKSTTIKVLTGLLVPDSGEVRVGGLVPWKQRRQHVARLGAVFGQRTTLWWDLPVRESLELLRHVYRVPAARFAENLAGFTELLELGPFLNTPARALSLGQRMRADLAAALLHDPELLFLDEPTVGLDVVAKERIREFVKAVNAERGVTVLLTTHDLGDVERLARRVMMIDTGRLLFDGPLAELQARYGGERELWVEFEKAPAQPALPGLTLLGQDGPRVRYGFSGAAAAPIAQVTALAPVRDLAVKEPEVEATIRRIYEGNLLGSRSVREG

SEQ ID NO: 23406 - protein, 286 aa, Deinococcus radiodurans
MDYAKDVLVSTEWAAQNLQTPGVRFIEVDEDILLYETGHLPGAVKLDWQTDLWHPVERDFIEPQQVSELLGKLGIKADDTIVLYGDKSNWWASYAYWFLTYSGVSNLKIMNGGRQKWVAEGREMTTEAPTVTATTYPALQRDESLRAYRDEVRAHLESVNNGQGAMVDVRSPDEFSGKVTHMPNYPQEGVLRGGHIPGARNIPWAKATNEDGTFKSADELKALYEGEGVTADKDVIAYCRIAERSSHSWFVLRELLGYPKVRNYDGSWTEWGNGVGLPIEKTYSEE

SEQ ID NO: 23407 - protein, 662 aa, Deinococcus radiodurans
MCPARLRTPRTASLPTHRRSAMTTANPLNTSFTSADAAELYQVPNWSGGWFRVSDKGLMEATPAPGLHASLRAIVDEIVDRGESLPVILRFPQVLAGRVKHLNEAFQAAINEYNYSGHYQGVFPIKVNQRRAVVETVAAAGYDYAHGLEAGSKAELALCLAQKMHPDALLCCNGFKDDGFIKLALWGRTLGKNVVITIEKFTELDRILKQAKALGVKPAVGVRFKLHARGSGQWEESGGDQAKFGLNAYELLRVVERLKEENMLDSLVMLHTHIGSQITDIRRVKVAVREAAQTYAGLIAAGADLKYLNVGGGLGVDYDGSKTTFYASMNYTVKEYAADIVYTVQEVCKAREVPEPVIVSESGRALTAHHAVLILPVVDVTGPTRNLEDQELTVPGEDSHQIVRDMYETLENISMRNYRESYNDAVGDKQTLHNLFDLGYVTLEDRARGEALFNAILRKIAKLIQGEKYVPDELEDLQKVLADKFICNFSLFQSLPDNWAIGALFPIVPLDRLNEQPTRQATLVDITCDSDGKVEKFIDLRDVKATLPLHEPGDRPYYLGAFLMGAYQDVLGSAHNLFGKVSEAHVTVRPGGRFNIDLFVRGQKARRMIESMGYEEPMLRDAIEDQADAAIGRGTLTQEQEHELLEDYGEELLGYTYLEYES

SEQ ID NO: 23408 - protein, 617 aa, Deinococcus radiodurans
MAAMVSHSSPVDGAPVSRPRSPVMATELKLPDVGDNIEKGTVVTVLVNPGDSVTEGQPIIEIETDKAVVEVPASAAGTIEAVNVKVGDTIPVGGVIATLGGGAASASDSAPSASAPSPANGGGDQAANVESTPATDSGTAQRVAQAQQDAQKEQAGQPTSGGTADANQAQATPSEGQSSGGQQVTLPDVGDNIEKGTVVTILVNVGDTVSEGQPVIELETDKAVVEVPANASGTVQSVAVKIGDSIPVGGTILTLSGAASTQPTAPAPESAQPASQSQQSTQPEPARPAGAPQAQAAAPQQSGTQNPQTFDGRPVVPAAPSVRRLAREIGIDIHAVHGTGIAGRISEEDVRRTAGTPSVQAQASAASAAAPAPMAAPLPNFEKWGTVRREDMSGIRKATVRSMTTAWTTIPMVTHFDKADVTAMEETRKRFGARVEKEGGKLTMTHILMKVVANALRKFPKFNASLDLGAEQVIYKEFVNIGVAVDTPVGLLVPVVKDADRKGITELVLDLSELAGRARERKLKPDEMQGATFTISNLGGIGGNAFTPIVNSPEVAILGVSRGGFEPVWNKEKGEFEPRNMLPLSLTYDHRLIDGADAARFLRYICESLEDPFLISL

SEQ ID NO: 23409 - protein, 720 aa, Deinococcus radiodurans
MPYKSLTLRPGSPFPLGATWDGKGTNFALYSENATGVELCLFDAEGHETRFPLTEQTAFVWHGYLPGIQPGQRYGYRVHGEYAPEKGLRFNPNVVLLDPYAKALDGTEQFDRGVFGYVAGGEDDSQMQEEEQRGAPLGLVVDPMFNWVGDQKPGIPFHQSVIYEAHVKGLTMTHPDVPEELRGTYAGVATPAILDYLRDLGITAIEFLPVHQHVDDPFLLDKGLTNYWGYSTLNFFAPDVRYSAEARKGNPSGAVPEFKNMVRALHDAGIEVILDVVYNHTAEGNHMGPTMSFKGIDNPTYYRLVADDQRFYFDYTGTGNSLNVRHPQTLQLIMDSLRYWVTEMHVDGFRFDLASTLARGLHEVDQLSGFFTIIHQDPIISQVKLIAEPWDVGEGGYQVGNFPVNWAEWNGIYRDDMRSFWKGEGGLASEIGYRITGSSDLYEFNGRKPYASINFVTAHDGFTLRDSVTYEQKHNEANGEGNNDGHNHNITWNCGVEGPTDDPEINRLRGQQMRNFLATLLLGQGTPMILGGDEFGRTQGGNNNAYCQDNDISWYDWEKVDEELLAFTRKLIALRKAHPSLHRRKFFAGRNIRGEDVRDIVWLRFDGAEMSDEDWNNPQTQSLGMFLAGDGLADVDAEGKPLTDDHLLLLLSSSYVDLPFKMPDLGGCGEWDLLLDTSDDGAEEKVAAGGETTLRGRSVKLYRCQVPEKELEKLAEPAEA

SEQ ID NO: 23410 - protein, 956 aa, Deinococcus radiodurans
MTQSHDEPMQTMMWGGNAAFIEGLYESYLQDPSSVGAEWRSYFDGLRGGAQERVHSEVQQRFYELGQHRGPVTVQVTGGASGAQQAAGALVTAYRVYGHISARNNPLKLRGVPTVPELTPEFYGLSEADLSEQVQDSPFSGTLRDVIAQLQDTYCGAIGFEYNYLPANERAWFQERIEKGRGQGRYGLSQDERRRLMQKLNAAEGLELYLKNRYPGVKRFGLEGGESFIPLMDRIIQQAGGRYGVKEVVVGMAHRGRLNTLVNIFGKPSGTLFDEFDGKKKLSDDPDIAGDVKYHMGYSSDVRTPGGPMHLAMAFNPSHLEIVSPVVHGSVRARQDRRGDTERKQVLPITVHGDAAVSGQGVVMETLNFSRLRGFTTGGAIRIVINNQIGFTISDPRDSRSSRYCTDVAKIANAPVMHVNGDDPEAVAFCGDLALAYRQEFGKDVFIDLICFRRNGHNEGDEPRMTQPVMYREIDQHPGTRALYAAQLEKDGVLAAGEGDKLVNDFRDRLDRGETVVEEMENAEQSKLAVDWSGYTNTHWKDDEVATAVPREKLEALGLKLTQVPEGFRVHRTVERTVIKAREAMARGEQPLDWGMGEMLAYASLLDEGFGLRLDGQDSGRGTFVHRHAVLHNQDAVDPLSEEYMALAHLSPEQGRVEVIDSTLSEEAVLAFEYGYSTSEPKALVAWEAQFGDFANGAQAVVDQFLSAGESKWQRLSGLTMLLPHGYEGAGPEHSSARLERYLQLCAQKNMQVVVPSSAAQIFHLLRRQVLRPYRKPLIVMTPKSLLRNKHAMSPLSDLYDGVFHEVIGDAEVQNARRVVLSSGKLHWELTEAREKDKEGYAGTALVRLEQLYPFPAEQVKAELAKHPGAQVVWAQEEPENQGAWLMIWEDLEHCLQPGQTLTHASRPRSASTAVGYTSVHVREQAKVIADALGEPITRQDVDAQVPLTEEASAQG

SEQ ID NO: 23411 - protein, 642 aa, Deinococcus radiodurans
MAVRGAVPRWTFPFRPGAEAESSGRGKAPTHARGAFMCGIVGYIGPRQAQDVLLSGLSKLEYRGYDSAGVAVGDGACIAVRKKAGKLANLAGDLQAAPLSGSFGIGHTRWATHGLPNDRNSHPHTTEDGRIVLVHNGIIENYLPLKEELLARGHTFKSDTDSEVVAHLIEEAYQGNLEEAVQAALAQVRGAYALVVTHVDHREIVAARTVSPLVMGVGEGEMFLASDVPALLAYTRQMVFLMDGDMVILSDDGYRVTDLQGHPVQRDVETIEWDAEAAEKGGFDTYMLKEIYEQPQALTNTLLGRLRDEQGAVDLDISLDPTSFKRISIVACGTAYYAGLVGEYLIEQLARIPVEVDVASEYRYRNPLVGENTLAIAVSQSGETIDTLEAMREAKKGGAQTLGVINAKGSSMTRELDSTLYIHAGPEIGVASTKAYTSMVSAFLMLALWLGRARGTLSDAEGAELIHAARELPRLVEDALKPERVQRIKEVAEKYAHARDYLFLGRGVNSPTAFEGALKLKEISYIHAEAYAAGEMKHGPIALIDENLPVAVIATESRLLEKTISNVQEVRARAGKVILFLSDGDEENALHGDDVVYLPRAHELVSPVVNAVAMQLLAYFTATALGKDVDKPRNLAKSVTVE

SEQ ID NO: 23412 - protein, 275 aa, Deinococcus radiodurans
MAVKKYRPYTPSRRQMTTADFSGLTKKRPEKALTEALPKTGGRNNRGRITSRFIGGGHKRLYRIIDFKRRDKSGVNAKVAAIEYDPNRSARIALLHYADGEKRYILAPEGLTVGATVNAGPEAEPKLGNALPLRFVPVGAVVHALELVPGKGAQLARSAGTSVQVQGKESDYVIVRLPSGELRRVHSECYATIGAVGNAEHKNIVLGKAGRSRWLGRKPHQRGSAMNPVDHPHGGGEGRTGAGRVPVTPWGKPTKGLKTRRKRKTSDRFIVTRRK

SEQ ID NO: 23413 - protein, 330 aa, Deinococcus radiodurans
MTMKQPVRVAVTGAAGQIGYSLLFRIAAGDMLGQDQPVILQLLEITPALKALNGVVMELRDGAFPLLADVITSDDPMVAFKDADYALLVGAMPRKAGMERGDLLGANGGIFKPQGEALGAVASRNVKVLVVGNPANTNALIAQQNAPDLDPKCFTAMVRLDHNRALSQLAEKTGAAVSDIKNVTIWGNHSSTQYPDLSQATVNGKPALEQVDRTWYENDYIPTVAKRGAAIIEARGASSAASAASAAIDHMHDWALGTKDGEWVSMGIPSDGSYGIPEGLIYGFPVRVKDGKYEIVQGLDVSDFSRGKMDATAQELEEERDEVRKLGLVK

SEQ ID NO: 23414 - protein, 478 aa, Deinococcus radiodurans
MSPAATSPRRQRQDGRQPQAAQQADPAPQPTMISLASPEEWRKLLGEREPTPVQAKAIPELLAGRDVIATARTGSGKTLAFLIPAAARGIGVTGKTRGMAPEVLIVSPTRELAVQIRDVARELGMTAGRITGGITPAATTREASNKGVVSGTPGRLKDLIGKGELSLAHVRYVVLDEADELLSLGFLKDVEWIVNQARAQARGGEIQVALASATFPEEVRGVAARVLRNPVRIDIEPPRTAEAAPLKAGEVVAAGEGRAEHVARDTTRDEVLEHAAAEIREALREPGGCVVVFCRTKALTKRRAEKLGQLLPHEEVVPLEGNMDQRKRERVMDKLRDGTARVLVATDIAGRGIDLPEVRLVIHADVATTSEDHVHRSGRTARAGRGGRNLVFIIPEQRQRWAQVRRGLPAHLHPPKTAQEHLIDKDIQEKQGRGSGNGVDPVRSGSGRSGGGRDGGQRGGSGQRSQGQGRGGPRGGRR

SEQ ID NO: 23415 - protein, 524 aa, Deinococcus radiodurans
MPMNTPLTPLTLVRRGLKLYPDHTAVIEPGGPRFTYREWGRRIYQLARAIQAAGYGGQHVAVLSPNTHGGLLTYAGVPWAGSVLVPLNTRLTPEEYEFQLRHAEVRLLLVDESLHDRVREVAAGLGIEVWVMGDARGAGTAFEAKLAAQDDSPLPLPVQDENGTITLNFTSGTTSDPKGVMMTHRSTMLNAIETIYYFKADQDTVYLHTLPDFHANGWGGVWSPFGVGATHVTLPTVRADAAYDAIEQHGVTHLCAAPTVLSMLTDPAHARPLSRQIRVATAGSPPHARIIADMNALGFHVTQVYGLTETSPLITVAELSAQQEELPTPRRAALIAKQGVEMILAGEVEVLDPELRPVPGDGETLGEIMVRGNLVMKGYYRNEEATAKALEGGWFHTGDVAVVHPDGRIEIRDRNKDVIISGGENISSVEVEGVLYAHPAVREAVVVAMPHEKWGEVPCAFIALHQGQEVTPEDLTAHVREHLAGFKVPKHYEFRDDLPKTASGKFQKFILRAELWQGKARGVN

SEQ ID NO: 23416 - protein, 821 aa, Deinococcus radiodurans
MPDSTALPTTIPVCPVRGSVIYPTMVQHIDASRAISINAIEAAMSGEKVILIVSQRDKDVDDPKGEDLYDVGTACNVLRVRKNPDGTLQMLVSAVARVQVSAYQLGDYLTADIEPLDAGKSGGVELQALSRELKDKFETVASGGRINAESVQTINSKDDIGEMADHIAFNLDFKLEDKQAILEAANVTERLKKLLTLLDTEQEVQAVQAKIRAQVKEEIDKNQREYYLREQMKVIQKELQGGDEEEGDEAEAFRAKIDALGLNPEVKKEIDREVNRLARMHPDAAEASVIRTYLTWVTELPWNERSDDRLDVEEAAQVLDEDHYGLEKVKDRVLEFLAVRRLRKERAERGEISAEEVNKGPILVFTGPPGVGKTSIAQSIAKSLGRKYVRIALGGARDESDIRGHRRTYIGAMPGRIIQGIRTAGTKNPVILLDEVDKLGSSYQGDPSSALLEVLDPSQNQHFTDHYLGVPFDLSEVMFIATANYPEQIPAALMDRMEVIEFNSYIEQEKLEIAKRYLLPRQLLQNGLKPNQISFSDAALEKLISHYTREAGVRNLEREIGTVARKVARNIATGKTKRAKVTDKELEKYLGQPRHTPETENMEDMVGVSTGMFYTPVGGDILFVETSIMTGKGGGLLLTGQLGDVMKESARAALTYAKSNAERFHIDREKLDNSEIHVHVPAGAIPKEGPSAGGAMATSLISALTGIPARHDVAMTGEMTLTGRYLPIGGLKEKVLGARRAGIKHIILPKANERDINDIPLHLRSSMRFHPCETVDQVLDVALVGGLKALETPRTDSQVTPPADSGSKGRKTGRRSPEARA

SEQ ID NO: 23417 - protein, 283 aa, Deinococcus radiodurans
MSLLAPAQVPGSQSSHALWSAPMSAPAAPPLTGPLKVTTFNVNGLRSALRKGLADWVESNQPDVLLLQEVRAEPMPDALPGYHSAWFPAQKAGYSGVAILSRLPLKDVRLGMPHDEMDAEGRVVSAVVAGVRFVSVYLPSGSSGEARQGFKDRVLADYQAWVSELLAAGEPVVIGGDYNIAHREIDLKNWRSNQKNSGFLPHERTWMTAHLAAGLVDCHRDCLGEEAEYTWWSNRANAYANNVGWRIDYLLSAGVRVSGVRSDRSVRLSDHAPLTGWVELESE

SEQ ID NO: 23418 - protein, 697 aa, Deinococcus radiodurans
MIEWPRDAELWPTVPAPPPYPPPMTATRDVLLTCPLDCPDACRLKITIERQPDGSEKAVKLTGDPAHPYTRGFACAKTVHYPARQNHPERPLYPLRRVNPKTDPEPQWERVTWDEALDDIAGRLRQLIAERGPQSILPYHYAGNMGLLEGSHVHALWRALGAAELEETICASAGTAAWEVGYGTRLAVDPLDVPHARLIVLWGINSLSTHSHLTPQITAARKNGARVVCVDPYRNRTAAFADEHLKIRPGTDAALALGVMRELFVNGWTDAEYLAQATEGVDDLRAAAEEWSPQRTAEVTGLTADEVRDFARLIGTTRPTYIRVGYGMTRYENGATALRAVTLLPALTGDWRYRGGGCVMSTSGTFKLNRRRLGAAHVTRPEAPRVNMNELANALDPAVGFGALFVYNCNPAVVSPDSGRVRAGMRRDDLLVVVLEQAMTESARLADYVLPATTFMESPDLYTSYGHFWLGYNPAELTPPGECRPNSWVFAELARRLGVEEPSVYWTADDLMAELLDTDHPFLDGLTPERLKAEGTVRLNVPDGFLPYAYGAETPSGKVQLAPAPRFVPVQAELNADFPLRLLTPPAHHFLNSTYGNLGNLNRAEGGEPQVLLCPADAAASGVQDGEYARLTSEQGEVRRRVKVTDAAQPGVAVVEGTWWGLTAPDGRSINELTAQTLTDLGGGSTFHNTRIRVSPA

SEQ ID NO: 23419 - protein, 910 aa, Deinococcus radiodurans
MKTDWKKLGFIVHKGDDKDPGPDGTLTREQGNQLWIVSGNPTPSTTRPDTRVRTVGDLKQQQAIMLSRDLIVVKPALAQPGAWLTLHVSPTATLKLGADGVSGGDTLALEEVEGGLTPALQAKAPYLAGYKLLQIRAADRAKLPTALSGQLAVSSVLPGGKVLDATGVQTAWALDDLYAYAGPLGVTWQGNKPTVRLWAPTAQDVKLHVSRPDGTQERTLPMTRDTQGVWTASGDQSWKGLAYRFEVRVFAPSTGNIETNLVTDPYSVALTRNSTHSVFADLSDNSQKPAGWNALKKPALRSFADLSFYELHLRDFSAADASVPAAERGTYLAFTRPGSDGMTHLRALAGAGLKAVHLLPTFDIATINEDKGQWQTPGDLTQFGPNSEEQQKAVNAVKDADAYNWGYDPYHSMVPEGSYAVNPAERTKEYRQMVMSLNAAGLRVVQDVVFNHTAASGQAERSVLDKIVPGYYHRLNVNGGVENSTCCSNTATEHTMMRRLMVDTLVLMAREYKVDGFRFDLMGHHMVADMQAARRALDALTPAKDGVDGKQIYLYGEGWDFGEVQGNRRGANATQLNLYGAGIGTFNDRVRDALRGGSPFGGLQEQGVATGLATVPNGQAGNDSAEKWGQLADLVKLGLAGNLRDYRFTDHSGKPVTGGQLRYGDAPAGYAASPRETINYASAHDNQTLWDAVLLKTPANMNSAARVRFQNLAHSYLLLGQGLPFVPAGDELLRSKSFDTDSYNSGDWFNALDWTGHTNGFGKGLPPAEKNEANWALYRTLLGDAALKVTPADITRASDHFRELLRVRSSSSLFRLDTAAQVQQSLSFLPAPTGVIAMKLSGGVSATNPYRDLLVIFNGSADAVTLNDASASGMKLHPVLAASSDPIVRTSKVSGTQASVPALTTAVFVR

SEQ ID NO: 23420 - protein, 506 aa, Deinococcus radiodurans
MKRWLAWTALTLGGLAQAAAPQLRVEQGTLNGKAVNSVQQFLGVPFAAPPVGPLRWQPPQPPVWSGQRDATQFGPACAQGDGGSEDCLTLNIYRPPNAKNAPLLVWVHGGFFTGGDASLFDGSALARERGVVVATVNYRLGLYGFLAVPGVTDGNAGLYDILGAVRWLKQNAASIGADPGNITLAGQSAGAAAICTLLAAPSAAGLFQKAILQSGSCAAPIFQTPLGDARRKGELFSRALRCDRGETATCLRGKSRAELDGVRLTGRGPVDPVPLPPVYGDALIPLRPQDAFAQGQSLKVAVMLGINREEGQIFEPYLPDLLRGSRTLYRAGLTLINPLQAWALGGRYPLRSDEQPIRAVTRLLTDQVFACPTSWLAGKLGAGLPTYFYEFSDPRPPLQLAGKVNVPNLGAYHGAELAYVLDTPVVGVSDPAQFSSAQAKLAAQMGEYWTNFARSGQPASLGLTVWPTFNPAFPQVMTLEPGATALKPNFDGRHQCDYWNGAEGRR

SEQ ID NO: 23421 - protein, 244 aa, Deinococcus radiodurans
MIKGKWRGVRGGPCLLCRPAFGRVGPGSGALTRARPSRAALHRRLYLRPMPRTAAVTRTTKETDITVRLDLDAAPYEQPATGHGFFDHMLDALARHSRLGISISGTGDLHIEPHHLIEDTGITLGQALSQALGDRKGIERYGSAFVPMDETLAHVVLDLSGRAHLAFEPETLDVYGDAGGMTHYHLREFLRGFCNHAGATLHVRLLAGREAHHVIEAVMKAFARALRDAVAVTSDALPSTKGSL

SEQ ID NO: 23422 - protein, 449 aa, Deinococcus radiodurans
MTSVSPTPDGILRQLQDAEVSFLRLQFTDILGHTKNVEVPRTQFAKALSGDVTFDGSAVQGFTRVEESDMLLSPDLSTFLVYPQFARDDRERGRVARLICDVTLPDGTPFEGDPRRVLRAQVERAQALGLEMYVGTEPEFFLFERGPNGAATTVTHDRAGYFDLAPIDRGERIRREIASRLVEMGFEIEASHHEVAPGQHEIDFRYAPALETADRIATFKFVVKRIALEHGLLASFLPKPIAGVSGSGMHCHLSLFKDGQNVFDDPGGEHGLSDTAHQFVAGLLDHAEGMTAITNPLVNSYKRLVPGFEAPVNIAWSTSNRSALVRIPAKRGPSTRAELRMPDPSCNPYLALAAMLAAGLDGIERQLEPPPAIQRNIFRMTVREKRHHRVKELPGDLREAVDELAKDEVIAAALGEHVMEHYVTAKRAEWREYSSAVHAWELERYLDLV

SEQ ID NO: 23423 - protein, 642 aa, Deinococcus radiodurans
MDPALLTTPLVSPTDALKKTAPVTPERAQQLRDMPAGDYWLSVASELTWDVPPTTALEGTFGDFQYFPGAKGNVSVNCLDRHPKNRVALYYEREDGLKETWSYGDLTDATARFAAALQDLGVDKGDRVAIYLSNVPEAFIAIHACYRIGAIYSVIFAGFSASAVRDRLTDAQPKVVVCTDGTLRRGRNIPLKATLDEALEGLEKPTVIVARRLDPFLPLGENELDFAELLEKTTRRAAPVSLDANDPGFIIYTSGTTSKPKGLVHSGIGFLTGTYANVKWALNLQPDDVYWCTADVGWLTFPIFALVGGLAHGATHVIYEGSIDTPTPERPYQIIERYRADKVFTAPTALRMLRRSGDEALARYDLSPLQLVALVGEPLDPETWHWTHDVLGGGRLFVNNTYGQTETGTAWASSMVGLTEGRPGSCGHPLPGYRAAVVHEDGTPCGPNELGSLTLTEPFPCLARTVWGDHDRYVETYLSEFPGKYAAADAALLDSDGQLWVTGRLDDVMNVAGHRLGTMEMEAALLTHPAVSEAAVVAMPDDIKGAVPVAFVVPRAGIRLDTDLTWLENELADAVVSGVGAIARPGRVVVTPTVPRTRSGKIMRRLLRDLLLTGEVKGDLTSLENPDALETVRERLGGAAAG

SEQ ID NO: 23424 - protein, 260 aa, Deinococcus radiodurans
MTGLCDSHLHTPLCGHATGTPREYAQAALDAGLSGLCFTDHMPMPRWYDAPWRMKLEQLPEYIAEIQAVQQEFAGRLDVRLGLEADFHPGTEKFVEKVLGMFDWDYVIGSVHYLGAWGFDNPEFVAEYEERDLGGLYRDYYALVEGAARSGLFDAIGHLDLPKKFGHLDPDPVYALHALDVVAGQGLALDFNTAGWRKPVAEAYPAPDLVRAAAERGIPFVLGSDAHQPGEVGFRFADAVKEIRDVGGRTVTFRHRKMQP

SEQ ID NO: 23425 - protein, 525 aa, Deinococcus radiodurans
MKTDRRGLTVGRGLEQRQSGTLFSNHPRASPLTPLSGLMLSLMSAPSSPRVTRIAPSPTGDPHVGTAYIGLFNHTLARQSGGRFILRVEDTDRNRYVPDSEKRIFQMMQWLNLTPDESPLQGGPNGPYRQSERFDLYGDYARQLVQSGHAYYAFETSDELAALREEAQKAGHVIAIPSRDLGAAQAQARVDAGEPAVIRLKVDRDGETVVNDLLRDPIHFANKEIDDKVLLKADGFPTYHLANVVDDRLMQVTHVVRAEEWITSTPIHVLLYRAFGWPEPVFAHMPLLRNADKSKISKRKNPTSVEWYQNQGFLPEAMLNFLATMGWTHPDGQEIFDLAEFERVFRLEDVTLGGPVFDLAKLRWYNGKYLREVLSEDDVARRLHAFLMQNKVTLPSVDGPQDPYFRAVTHLMIPRLEVFADFMDKTLYFWSEDYPVNEKAQKAIDAGKELLPELAARLKNLPTFDAASIKEMFHAYAEEKGLKMGKVMPPIRAAVAGTMESPDLPEMLEALGRERVLARVEKAAR

SEQ ID NO: 23426 - protein, 369 aa, Deinococcus radiodurans
MYQTVRPLLFRLDAEDAHHLTLRGLELASGVPLLPRLARTLTVPGTQGPGDAALRRTLWGQTPSEQTFESPLGLAAGLDKNAQAVPAFTAFGFGFVEVGTVTPLAQSGNERPRLFRLPEDEALINRMGFNNGGTAAMHARLAVLTDRAAPVWVNIGKNKVTPNEDAAEDYRKCVRALGDLADAFVVNVSSPNTPGLRALQAADDLAALVRAVLDEVEAGRVRTLRRPPVLVKLAPDLHPADFEASVGAVLDAGASGLIISNTTLSRGGLSHPNREQAGGLSGRPLTDRSTELVRDAYRLTRGQVPIVGVGGVFSAEDAYAKLLAGADLVEVYSALIYRGPGLVREINAGLVKLLERDGVRNIADVVGQG

SEQ ID NO: 23427 - protein, 568 aa, Deinococcus radiodurans
MKKNLLLIGASLLLGACSTTPEPSKPEQEKPATTKVTVVGLNDFHGNLEPTSFAGVMVPDPKDPTKQVKLTTGGIEVIGGYLDQERAKNANLTFVGAGDLIGASPVTSSLLRDEPSVIGLSKLGMQYSSLGNHEFDQGYKELLRMQNGGCDSNAPDKACKFQNPYPRATFSWLGANVEVKATGKPALPAYGIQEIGGARIAFIGAVTKTTPTIVSPDGVADLKFLDEAESINKYVPELKAKGVDAIIVLIHEGGVSKDGFDKPACGTLTGPIVNIVNKLDPAVDAVISGHTHQGYNCVVNGRTVIQGDYYGHLLQRLDMTIDLQKHKVTDIRAANVVMDPNTITKNAEMTALVGRAKSLTDAVKQRAIGSLAAPTISRTTNAAGESALGDLIADSQLAATADRGAVIAFMNPGGIRADLNATGGGTTVTFGDAYAVQPFGNTLVVMDLTGAQIKALLEQQFDNPSAGQNRVLQVSKNFTYSYDSTAAAGNRVDPASIKLGGVTLDPAKTYRVTLNSFLSTGGDNFTTFASGTNVLQLPNVSDLDALTAYIVAHPGVAGGAQDRIVKLK

SEQ ID NO: 23428 - protein, 414 aa, Deinococcus radiodurans
MNDKQLKQLSRALGVGGSGRQRVLPAADGDYYDYLDTLTDSQVEVAGRVHDFMRAEVMPIMNEYWSRDEFPRDLIGKMRELNLLRSIWNEDGTRKPDATLIEGVVILEACRVDVSTAVFFGVHGGLATASIALGSDEEQKKRWLPDMLDMKKIGAFGLTEPEGGSQVSEGMRTTCRRDGDGWVLNGEKKWIGNSTFSDFTVIWARDEETNEVRGFVVEAGTPGYDVEKIQGKIALRMVENGHITLKDCRVADANRLQAVQGWETVSQVLKLTRAGVAWQGVGCAMGAYELALAYTQTRKQFGKRIGEFQLIQSHLTHMLADVTAMLGMVMRLSHIADEGRMDDAHAALAKVHTAARCREVVARAREVFGGNGILLEHGVAKHFCDTEAIYSYEGTNEINTLVVGRAITGLSAFV

SEQ ID NO: 23429 - protein, 455 aa, Deinococcus radiodurans
MPSPRFASLRNMTLSETHPTARSEALFVRARAVTPGGVNSPVRAFRSVGGVPRFIASAQGAYLTDADGARYLDYIGSWGPMILGHNHPAVRDAVAQALASGTSFGAPNEREVELAELIVELTGAERVRFVSSGTEATMSALRLARGYTGRKFIVKFRGNYHGHADGLLVEAGSGLLTNAEGDLGAAAPSSAGVPEEYAGLTLVLDYNDPEALDALMAQRGDEIAAVIFEPVVGNAGVLIPTSDFLAALHRVRDFGAVLIADEVMTGFRLSLNGATGLLSLDPDLRCWGKIVGGGLPVGAYGGRADIMDFVSPQGPVYQAGTLSGNPLAMAAGIATLRELKANPGLYRQLDEYAARLAAGLRGAAERAGVAVSINHIGSMLTVFFQDAPDGSVRDYAAAARSDTAAFAAWFQGLLARGIYWAPSQFESIFISAAHGEPELAATLEAAAQAFEGVKP

SEQ ID NO: 23430 - protein, 618 aa, Deinococcus radiodurans
MKWWGWALLALTGGLLVLVLSGSPRSQSELNVNDFTQAVRTQQVKTADISFQNGTALVTGRLTSGLPYRARTLPADPVLKLGTLEGRGVTVTYLPPPRISVLGALSVLLTLALIGGLIALLVRSRNGGNNDAASSFGKSKAAIISEGQIKLTFADVAGCDEAKQDLQEVVEFLRQPEKYHQLGARIPRGVLLVGPPGSGKTLLAKAVAGEAKVPYFSISGSDFVEMFVGVGAARVRDLFEQARKASPCIVFIDEIDAVGRKRGMNIQGGNDEREQTLNQLLVEMDGFGSGQDVIILAATNRPDVLDAALLRPGRFDRQVVVDAPDVRGREQILRIHSRKKPLDVSVDLGVIARRTAGMVGADLENLLNEAALLAAREGRNRITGRDVDEARDRVLMGPERRSMVVREADRKVTAYHEVGHALVAQLLPHSDKAHKLTIVPRGRSLGSALYTPEDRMHHTRTALLDRICVALSGHAAEEVIYGEVTTGAQNDFQQATGLARRMVTEWGMSEVGQLALAQDNGNYLGFGPQPTNYSDHTAEQIDTAVADILNTQYARAHALLSEHVHVLHRLTDELVARESLSGDELQTVLNGGTLPELPAAVRPEGAPPPEGTLRPEGA

SEQ ID NO: 23431 - protein, 741 aa, Deinococcus radiodurans
MLSEHLQAALQRAADLAQAAGHEYITQEHLLLALLGDPEAKDALNALGADLNALREALTEQLAELDILDDPDPDFTLGVHRVVQGAVLQLHASGKGKEQADGARVLVELLEEDDSPARAALEAQGVTRLDLLNYLSHGVAKAPGHSRERRVAGVDGELTAEGAPAEENPLEAYAQNLTEAAKNGEFDPVIGRGAELERVVHILARRGKNNPVLVGEPGVGKTALAEGLAQRVADGKAPGFLRGASVYALDLGALLAGTRYRGDFEGRLKAVLAALDGQNSVLFIDELHTLVGAGATEGGSVDAANLLKPALARGKLRVMGATTPAELRLLEKDRALWRRFQTVDVPEPSEADAVQILQGLAPKYAAHHGVTYTPPALEAAVRLSARYLRDRFLPDKAIDVLDEAGAARSSTGQGGEIDVPDIESTVARMARVPVGAVKAEEVQSLATLEADLNRRVYGQEPAVSAVSSAVKLARAGLRNPQKPQGSFLFAGPTGVGKTELARALAERLGVELIRFDMSEYQEPHTVARLIGAPPGYVGFDQGGLLTDAVAKNPHAVLLLDEIEKAHPDVYNIFLQLMDHGTLTDHAGKKVDGRGLILIFTTNAGAADASRPALGFSREGRAGEQAEAVKRTFTPEFRNRLDAVIYFAPLSRTVMTSVVDKFLRELGEQLTERGVTLTVTPAARARLAELGYDPLLGARPLARVIEDKLGRPLADELLFGRLKDGGAVKVGVQGGEFSFAVS

SEQ ID NO: 23432 - protein, 472 aa, Deinococcus radiodurans
MARGRPCLSAQRLGEEPRVNSTGRYSGPMRVLHLASEVFPFSRSGGLGDVLGALPAVQARLGEDAEVTVLSPWYASLQGEPQELWRGEAWGEQAWLGELRQDGVRYLFLGLNEFQRPGLYHPDDVERFCAFGRAALPALDAVGVTPDVLHGHDWQAGLVVAHARLRGLRTAFSVHNLQYQGRWNLHEAAGWTGLPDWTFGPDGVEFFGDLNLMKAGLNFAGHVTTVSPTYAQEITTPQYGEGLEGLLVRLTHEGRLSGILNGLDQDRWNPRTDPDIAAYSDPAGKAGAVKALRQEFGLDDAPILATVSRLADQKGMDLLITALPELVRDWNVVVLGGGDPLLEAALTGWANHPRVAFASGMNEPLAHRIYAGAHAFAMPSRFEPCGLSQLIAMRYGTLPIVRETGGLADTVPPEVGFRFADATAPAFLQACREAQAAFQDPAQWQTRATRAMSLDFSWDGPARQYLELYRGL

SEQ ID NO: 23433 - protein, 422 aa, Deinococcus radiodurans [sequence omitted]

SEQ ID NO: 23434 - protein, 487 aa, Deinococcus radiodurans
MTTTDLRTTYSSVTRSQAYFDGEWRNAPRNFEVRHPGNGEVIGEVADCTPTDARQAIDAAEVALREWRQVNPYERGKILRRWHDLMFEHKEELAQLMTLEMGKPISETRGEVHYAASFIEWCAEEAGRIAGERINLRFPHKRGLTISEPVGIVYAVTPWNFPAGMITRKAAPALAAGCVMILKPAELSPMTALYLTELWLKAGGPANTFQVLPTNDASALTQPFMNDSRVRKLTFTGSTEVGRLLYQQAAGTIKRVSLELGGHAPFLVFDDADLERAASEVVASKFRNSGQTCVCTNRVYVQRGVAEEFIRLLTEKTAALQLGDPFDEATQVGPVVEQAGLDKVQRQVQDALTKGAQATTGGQVSSGLFFQPTVLVDVAPDSLILREETFGPVAPVTIFDTEEEGLRLANDSEYGLAAYAYTRDLGRAFRIAEGLEYGIVGINDGLPSSAAPHVPFGGMKNSGVGREGGHWGLEEYLETKFVSLGLS

SEQ ID NO: 23435 - protein, 392 aa, Deinococcus radiodurans
MKAIVWQGVNKVGVETVPDPTLLLPTDAIVKITSTAICGSDLHLLDGYIPSMETGDILGHEFMGEVVEVGSEVRKLKVGDRVVVPFNIACGVCDPCKRGFFSACDNSNPNHRMAEALYGATSGGALFGYSHMYGGYAGGQAQYVRVPFADVGPFKIESGLKDEQVLFLTDIFPTGYQAAEQCNIVPGRDVVAVFGAGPVGQFAARSAQMLGAAHVIVIDRVPERLAMAEAAGCQTINYEKEDVLLSLREATGGRGPDHVIDAVGMEAHGHGPGSTMDKVQQNLKLTFDRITALRWAILSCAKGGTVSMPGVYGGLVDKMPIGAAFAKGLIFRMGQTHTHRHIPSLLGRIEAGQIDPSFVITHRASLDQAPELYKTFRDKQDCCIKVVLNPWA

SEQ ID NO: 23436 - protein, 301 aa, Deinococcus radiodurans
MITTFEQVSKTYGHVTALSDFNLTLRTGELTALLGPNGAGKSTAIGLLLGLSAPSAGQVRVLGADPRRNDVRARIGAMPQESALPAGLTVREAVTLFASFYPAPLGVDEALALADLGPVAGRRAAQLSGGQKRRLAFALAVVGDPELLLIDEPTTGMDAQSRAAFWEAVTGLRARGRTILLTTHYLEEAERTADRVVVMNGGRILADDTPQGLRSGVGGARVSFVSDLVQAELERLPGVSAVQVDAAGRADLRTSVPEALLAALIGSGTTFSDLEVRRATLEEAYLQLTGPQDMTAVTRSA

SEQ ID NO: 23437 - protein, 563 aa, Deinococcus radiodurans
MFCPQWKFTFLINQRPCAAGQLSRRGFAPSFAAFSGAAMSDIEALKKELPPFQIFDLIPQYAAAGQIDPEKIDLLKWAGVYPQRPQEDGFLMMRVKVPTAELHTDALRVVAGISEDFGRGLLDVTDRQAFQFHWLRIQDIPEILDRLETVGLHTKGACGDTVRAVIASPLAGLDAREKIDVRPLAAAMEGTLSGNHDFEDLPRKFKISITATPELEGIHLINDIGFLAHEVDGEIGFDVWVGGGLGAVPHLAERLGVFIRPDEVVEVGRAIVGAYRDHGYRVNRKKSRLKYLIKDLGPAKFREIVETEYLGRPLRDGPSAPVARFGGSDVLGVNPQKDGLNYVVLTTTVGRITPEKARRLADLAEQYGNGYLRTTAFQNMMIPNVPDEHVGALVAELQELELAPKATLRGTTIACTGTQFCRLAQTETKARVAGMIDVLEPRHNDLDVPFVINLTGCSNACTRYQVADLGFMGALRANKETGGEDEVYNVHLAGSIGQAQRTGTKLRGIVPAERLTEYTDRVISDFKANKTPGESFVEYADRVGADRFVPDTVLDGGKELVNA

SEQ ID NO: 23438 - protein, 192 aa, Deinococcus radiodurans
MSASPSLPASQGPLPQGERVNKAGRVVWFTGLSGAGKSTLATALFEELSARGEAVELLDGDAVRENLSKGLGFSREDRDTNVRRIAFVAGLLAKHGVTVLVSAISPYADTRREVLASLPNALEVFVDAPLEVVTERDVKGLYLKALAGEIPHFTGVSDPYEAPENPDLHLRTDRISVEDGVQQLLGRLSDDR

SEQ ID NO: 23439 - protein, 255 aa, Deinococcus radiodurans
MMTAEVRTPEQGGGPLTTEPRAPRSAPGHADASAPAFGPETDPRDIIRWALAAHPDLLMPSAFNLNGVVLLDLAAQAGYRGEVVFVDTGYHFPETLATRDRLESRYPELTFVTLNAGASPDDGQTPPDLYASDPDACCAARKVDPLQRYLKEQGPSALLNARSRDQASTRADIPFVEEGGARRRVNPLAHWTREQLEAYAAEHDLPVNPLYFDGFLSIGCWPCTRAVKPGEDARAGRWAGKGKTECGLWQGENKL

SEQ ID NO: 23440 - protein, 387 aa, Deinococcus radiodurans
MTTFQTAPVTLPTPLGGSLVRRIWRPGQDFDPAELAGRPRLELSSRSLADLEMIATGAYSPLTGFVGEADYLSIIEHLRLADGTPWSLPITLPVTAEQAAGLSGRVVLTHGGEPVGTLDIEEKYAAQKSLEAREVYRTEEEAHPGVAALYAQGDVYLAGPVTLFEVPRGEFPRAHRTPAEVREVIEARGWRSTVAFQTRNPIHRAHEYLQKVALELVDGLLLHPLVGQTKGDDVPAETRMEAYEVLLRGYYPQERTLLSVYPAAMRYAGPREAIVHALSRRNYGATHFIVGRDHAGVGSYYGTYDAQEIFNTYTAEELGIRILKFEHTFYCQSCGQLVSPRTCPHDSSHHLVLSGTKVREKLRAGENLPPEFTRPEVAEVLRKAYTR

SEQ ID NO: 23441 - protein, 454 aa, Deinococcus radiodurans
MTATQAKPRQPDLKTSLPGPKTAEIMARDQATLSTSYMRPYPFVPDFGKGVWLTDVDGNTMLDFFAGIAVSTTGHAHPHVVQAVQRQIEKFTHVCLTDYPQEITTSLAERLVKHVERPGEKWRVFFSNSGAEAVEAAVKLARNHTGRQHIISTMGSFHGRTYGAITLTGSKTKYKRGFGPLLPAVSHVPYPNPFRPPLGSTPENCGQAVIDHIESLFVGILPADEVAAIIVEPMQGEGGYIVPPADFLPGLRALCDKHGIMLIFDEVQAGMGRTGKMFSFQHFDVQPDIITSAKGIASGMPLGALLAKESVMTWPVGSHGSTYGGNPVAAAASHATLDLLEGQVKHEGCGDSLMDNAAQVGDFILGELKGMQDEFPFIGDVRGRGLFIGIEFVKPDGSPDGALRDQASMMMFEKGLLNLDCGEAVIRISPPLILTREEAATGLDIMRGVFQELK

SEQ ID NO: 23442 - protein, 526 aa, Deinococcus radiodurans
MSTLLDGLLPFQHEPYFDFADPAVAEAQTAAYAQARQKYAGQTFPLLVGGQQVKGDGTLTVTNPATGEQLWHFQNATAAQLDEAVRAANEAFQSWRFSDPLQRASIFLRAAQLLRSRRMELNAVMSLENGKNWAEADGEIAECVDHCEVFARETLKWAQGKPVYPMPDEHVTTVYEPLGAVAVISPWNYPSAIPLGMALGALAAGNTVIWKPASETPLSSWLLIRLLFEAGLPRDCVQFLTGSDDVLGDPLVDHKDVRMVAFTGSREIGCRIYERAAKVQPGQKFLKRVIAEMGGKDPTVVCADADLDAAAAGIVASTFGYSGQKCSACSRVIAEASVYDTLLEKVKTLTEALKVGLPEHNAAVGPVIHQGSANRIRQYIENGKGTARLVCGGGEMEVADSGEASANYIQPTIFADVDAKDPLFQEEIFGPVLAFAKADDWRHAIDLANDSDYGLTAAFYSRDPHKLTEARRLMHVGNLYLNRKCTGALSGSHSFGGYGMSGTNAKVGGPDYLFWFLQTKTVAQKY

SEQ ID NO: 23443 - protein, 361 aa, Deinococcus radiodurans
MRSGISILFMKALIPAAGLGTRLRPLTFTRPKPVLRVAGQPIIRHAIRTLTEAGITDIGIVVSDVTRDEIQHAVREIRDVKLTLINQHDQLGLGHAVLTAREWVGQDDFCVYLGDNLFEFGARPFIESFHQKHPAALIALVKVADPTAFGVAELDGEQITRLVEKPKDPPSNLAVAGLYCFTPQIFEVLDVMPPSARGEYEITDGIQGLIERGQTVVGQRVEGWWKDTGRPADLLDANRLLLEQIETDVQGDMEGSRMTGRVIVPASSKVLRSKIVGPVIIGEDVIIEDAYIGPFTSIGRGTVIRNAEIEHSSVDSGVVIENVQTRLQDCLIGVKAQVRGGRTLPKTHKLTISDASVVELA

SEQ ID NO: 23444 - protein, 364 aa, Deinococcus radiodurans
MTQGNQPSDKQQWKSLLVTGGCGFIGSNFVRYWLGQHPESKVVVYDKLTYAGRKENLHDLWDNPALSLVVGDIGDMDLVRRTCQENDVDLIVNFAAETHVDQSILGPLVFTETNVRGTHVLLEVARELGIRLHHISTDEVYGHIKDGHQSVETDELAPRSPYAASKAAADQLVQAYAITYGIPVTITRGANNVGPYQYPEKAVPLFSTNAILGEPLPVYGDGQQMRDYAHVYDHCTGIETVLLRGNIGEVYNVGTGREMTNLEMVDIVLETLGKDHSLVKHVTDRPGHDRRYSMNVDKLRSLGWQPKYDPKQAVAEAARWYEGNRWWWEPIRSGEFREYYNRQYAGRLASAEPAAAQSTEAKQQ

SEQ ID NO: 23445 - protein, 473 aa, Deinococcus radiodurans
MPIKFGTDGWRDIIAEDFTFENVRTVARAHAQVLRSSGARSVAVGFDTRFQGQAFARVVAEVMAAQGLDVWLAQDYLPTPALSFAVVHHGAGGGVMITASHNPPQYSGYKIKGSYGGSATPAVVAQVEAALATAESYDGPRGEIRPLDIRQAYYEQLDRQLDLETLREYRGKVIHDPMGGAACGWLTGYAQHAGLQLELEEMHGRPDPLFYGVNPEPIPQNLGELTERLTRESAPTLGVITDGDADRVGAITAGGHFFNSHQIFAVLIKHLYGRGVRGRVVKTVSGSRVIELLAETLGLELLETPVGFKYITDAFLEGQQDESKAVLMGGEESGGLSSRGHIPERDGLLNSLLMIEAVAASGQSLDELFAEIEREVGFRHVYDRADLHLSEAFDKSALMQAAQGYREVAGQAVTGIKTTDGVKLALAGDASVMFRASGTEPVVRVYVEAQTPEMVQAVLTEAVQRVRSFDPMS

SEQ ID NO: 23446 - protein, 461 aa, Deinococcus radiodurans
MPCWGPFPALFGCPAGQLRPPRRVRQVADAGSTCPRIEIMPPTSDRDVVIVAAVRTPIGAIRGSLATVRPDDLAALVIREVVARSGVPATEIEEVIFGCANQAGEDNRNVARMAALLAGLPETVAGVTVNRLCASGLAAVNMAARAIRNGDGDVYVVGGVESMTRAPLSMPKGSAAFANGNVTAYDTTLGWRYPNPAMEALFPLEAMGETAENIVGRSREGAYAGGEITREQQDAFALESQRRAVAAINAGKFKDEIVPVEIKGRKGVTVFDTDEHPRMKKGAESYELATDPDTLAGLKPAFRKGGSVTAGNASGLNDGAAALVLMSAERARALGVKPLARWVGGAAAGVEARVMGLGPIPATRKLLERTGVQKDDLDLIELNEAFAAQALACMRELDLDPEKVNVNGGAVALGHPLGMSGARLVVALTHELGRRQGRYGLATLCVGVGQGEAALIERVAE

SEQ ID NO: 23447 - protein, 300 aa, Deinococcus radiodurans
MSGSEGTDLPRVLVVGSANLDFVTRLSHLPAPGETVLGESYTTAPGGKGANQAVACARAGGAVAFCGALGTDPFAEPLLASLRESGVQDWTVRASTPTGAAFISVSEAGENCIAVASGANGTLRPEQLPPLTGVGWLVLQLEIPLETVQAAAQAAREAGAQVVLNAAPARTLPPELLRLVDVLIVNEGELRTLIGATDLRAGVRQAQASGPRTVVVTLGERGCLALSGDDWTELPALPVPVRDTTGAGDTFVGVLVAALSRGEPFAAALRWAVAGSALACTREGAQPAMPGREEIQANLG

SEQ ID NO: 23448 - protein, 728 aa, Deinococcus radiodurans
MEAHGTRLSYFVEGMDCANCVARVEKMVGGLPGTGEVKTSFTRQTLTLELDETQTSRAALEKNLRSLGYGPSLLPDRDAPQTGEGAHTHDHADHQHAGHSHSHDPAEQGKPWYRTGQGQLVVASGVLLALAWVFGRFEPAWAQWGYAAAALLGAWPLAKKAWASVRLGDPFSINLLVTLAAIGAVAIGQAAEGAVVVFLFAVGELLEGVAAGRARAGIATLAALAPKTALLVEPGGVREVPADTLQVGQTVQVGPGARVPADGTITAGQSSLDDSPVTGESVPVSKGPGDHVYAGSINTDGVLTVRVDRAAADNTIARIIHLVEEAESSKAPTARFIDRFSRWYTPGVVAVAALTAALPPLLLGQPWYPWLYKGIALLLIGCPCALVLSVPAAITSGISAGTRRGLLIKGGAALETIGSVRTIAFDKTGTLTSGRPRVTDVLADNPAELLRLAAAVETGSSHPLAQAITAEAQARGLTVPAASEARALPGQGVTALVEGRPVQVTSPIFAASQATLSAEQQQTVATLEQQGRTVVVGLDGGRVLGLIALRDEPREDAREALAELRRLGIRPLMLTGDNARTGQAVAADLGLDVQAELLPADKLNIIDELRAQGGVAMVGDGINDAPALARADVGIAMGSGTDVALETADAALLRGQVQGVGELVQLSRDTLANIRQNVAFALGLKAIFLVTTLLGYTNLWMAVLADTGATAIVTANALRLLNWRPRHA

SEQ ID NO: 23449 - protein, 430 aa, Deinococcus radiodurans
MSNVFYRSSKPYPVAVRGEGVFLYDDAGRRYLDGSSGALVANIGHGRAEVGERMAAQAARLPFVHGSQFSSDVLEEYAGRLARFVGLPTFRFWAVSGGSEATESAVKLARQYHVERGEPGRFKVITRVPSYHGASLGSLAASGMGARRELYTPLMRPEAWPKLPKPDPARNGAEDAEGLRALLEREGPETVAAFMAEPVVGASDAALAPAPGYYERVRDICDEAGIIFIADEVMSGMGRCGSPLALSRWSGVTPDIAVLGKGLAAGYAPLAGLLAAPQVYETVMGGSGAFMHGFTYAGHPVSVAAGLSVLDIVEREDLTGAAKERGAQLLAGLQALQARFPQMMQVRGTGLLLGVVLGDLATGQAFETPGIASRIGAAALKRGLITYPGSGAEPNGRGDHLLLGPPLSITAAEVDELLALLAGALEDVLG

SEQ ID NO: 23450 - protein, 495 aa, Deinococcus radiodurans
MTAEPQVSPAPTPPPAAPLLVRDRLFIGGEWVTPCGQGTLEVVNSATEEVMGTVPEGTPEDAERAILAARAAFDSWSQTPAEERAALLERISRGLNERQSEIAALVAQEVGMPFVLSNVIQVGLPAVTFMSMAEEIRQLPAEETLASSLLLREPVGVVAAITPWNYPLHQIAAKVAPALAAGCTVVLKPSEVAPLNAFVLAEIIEAAGAPAGVFNLVTGTGPVVGEVLAAHPEVDMVSFTGSTAAGKRVSELAARTVKRVALELGGKSPYLILDDADLSGEALVQAVMNGIQGCYLNSGQTCSALTRMLVPRSRLPEVEAVAQAVVSQVKVGSPFDAATTLGPLVSDVQRERVRGHIRQGVAEGARLIAGGAESPEGLERGYYVQPTIFSDVTPEMTIAREEIFGPVLVIQPYEDEEDAVRIANATHYGLAGGVWSSDRERAVRVARRLRTGQVSINGGAFNPVAPFGGYKQSGNGREFGRLGLEEFMEVKALQF

SEQ ID NO: 23451 - protein, 347 aa, Deinococcus radiodurans
MTRLRVWSRLGLLHGVWLAKLRPTPSRSPAAFVEPPGELASLPRGARQESSMSIKTVTVCGSGVLGSQIAFQTAFHGFDVHLYDINDAAIAKARETLGKLQARYQQDLKVDAQQTGDAFARISFFTDIAEAVKGVDLVIEAIPENMDIKRKFYNQLGEVADPNTIFATNSSTLLPSQFMEETGRPEKFLALHFANEIWKFNTAEIMRTPRTDDAVFDTVVQFAKDIGMVALPMYKEQAGYILNTLLVPLLGAALELVVKGIADPQTVDKTWMIATGAPRGPFAFLDVIGLTTPYNINMASAETNPGSAAAAKYIKENYIDKGKLGTATGEGFYKYPNPAFESADFLK

SEQ ID NO: 23452 - protein, 524 aa, Deinococcus radiodurans
MILDRDLNLEQFISVVRHGEQVELSAAARERIARARTVIEQIVEGDTPIYGVNTGFGKFENVQIDRSQLAQLQHNLIVSHAIGMGEPLPAEVVRGMLLLRAQSLSLGHSGVRVEVVELLLALLNADALPVVPSQGSVGASGDLAPLAHLALGLIGLGDIEYQGQVRPAADVLAELGLSPVQLQAKEGLALINGTQLMGSLLALALHDAQVLLGTANLAAAMTVEARYGSHRPFQPDVVGLRPHPGALAVAAELREFLAGSEIAPSHLTGDGKVQDAYSLRAVPQVHGATWDALAQAERVLAVEFASVTDNPLIFPETGEVVSGGNFHGQPLAVTIDALKVAVAELGSISERRTEQLLNPALSGLPAFLTPNGGLNSGFMIAQYTSAALVSENKVLSHPASVDSIPTSANQEDHVSMGAHAARQLRQIVANVQTVLSIELLCAAQGLDFQQLRAGRGVQAAYEYVRTFVPTLTEDRYFRPDLLRLRGELVSGELLRVAQAADTQAPAPAKLPDSGDEDRDTTSRH

SEQ ID NO: 23453 - protein, 304 aa, Deinococcus radiodurans
MSGPAHLPYGGIPTFARAPLVQPDGDWQADVAALGVPFDIALGFRPGARFAPRALREASLRSVPPFTGLDGKTRLQGVTFADAGDVILPSLEPQLAHDRITEAARQVRGRCRVPVFLGGDHSVSYPLLRAFADVPDLHVVQLDAHLDFTDTRNDTKWSNSSPFRRACEALPNLVHITTVGLRGLRFDPEAVAAARARGHTIIPMDDVTADLAGVLAQLPRGQNVYFSVDVDGFDPAVIPGTSSPEPDGLTYAQGMKILAAAAANNTVVGLDLVELAPNLDPTGRSELLMARLVMETLCEVFDHV

SEQ ID NO: 23454 - protein, 349 aa, Deinococcus radiodurans
MTPDASAAPAEPLMLREMREAPAVVRRLLNENQDAVARLANAIRERQPAYAVTIARGSSDHACTVLKYALETQLSLPVASLGPSVHTLYGARLDLAGALVIAVSQSGASPDVVENVRMAREGGALTVALVNVEDSPLAEAAEFTLPLRCGPEKAVAATKSYLASLCAFLPVLAELTGDEALKRALDALPEQLAHTLTLEDAAHELAGRYRFADNLLILARGHHYGVAQEAALKLKETCGIHAEAYSAAEFSHGPKRLLAEGLPLLGFASADAAWEATRQAYDDLRAAGADLRLLGPVAGADLPTPLGGHPLTDPVTSTLAFYLFVAHLALERGLDPDRPPLLSKVTKTR

SEQ ID NO: 23455 - protein, 415 aa, Deinococcus radiodurans
MTMFDTTPRAQDLRERLLRFMDTYIYPNEAEFHRQVESGERWAPVELIEELKPKARAEGLWNLFLPPASDPEGKFGAGLTNLEYAGLCEIMGRVWWAPEVFNCNAPDTGNMEVIARYGTPEQQEQWLLPLLNGEIRSAFSMTEPQVASSDATNIEAQIVRDGDEYVINGRKWWSSGAGDSRCKVSIFMGKTDPQAPRHLQQSMILVPFDAPGVKIERALQVFGFDDAPHGHMEMSFDNVRVPVTNMLLGEGRGFEIAQGRLGPGRIHHCMRLVGQAERALELMIERSAQRIAFGKPLALHQHTRELIAQSRMEIDQARLLTLKAAHTMDTVGNKDAKGEIAAIKVVAPNMALRVIDRAIQVYGGAGVCQDTPLAMMYAQARTLRLADGPDIVHTETVAKEELRRQGVDLRALSKR

SEQ ID NO: 23456 - protein, 258 aa, Deinococcus radiodurans
MALKELFDLSGKVALITGGSRGLGLQMAEALGEYGATVVLTARKQNELDEAKAHLEGLGVKAHVYANDLGNFESIDPLIAQIHQEVGPIDILINNAGATWGAPTAEHPFDAWMKVMNVNVNGTFLLTQSVLNRCMLPAGKGRIINVASVAGLKGNSPQMMPTMAYNTSKGAVVNFTRALASELAPKGITVNSICPGYFPTKMTRGTLAAAEQAIMSHTPMGRLGTDQDLKGLAVLLSSDASAYMTGQNIAVDGGITAI

SEQ ID NO: 23457 - protein, 524 aa, Deinococcus radiodurans
MTQPNPTQPSPTQQNHDLARQLRESRLSRGLQHFIGGEWVDAHSGKTFDAHSPVDNDFLVKVAEGDASDIDRAAKAAHDAFQTWREVSGAERRKILHKVADLIEKRAQEIAVLESVDTGQAIRFMKSAAARGAENFRFYADRAPGAQDGQSLPAPGFINYSIRQPIGPVGVITPWNTPFMLSTWKIAPALAAGCTVVHKPAEWSPVSATLLTEIMDEAGLPGGVHNLVHGFGESAGKSLTEHPLVKAVAFVGETTTGSHIMRQGADTLKRVHFELGGKNPVVVFDDADLDKALDAVVFMIYSLNGERCTSSSRVLIQEGIYDEFTRRIAERAANIRVGDPLDPDTEVGPLVHPRHFEKVMSYFECARQEGATIAAGGERVGEAGNFVRPTLFTAARNDMKIAQEEIFGPVLTAIPFKDEADALELANDVNYGLAGYLWTNDLTRAHRFAHGLEAGMIWVNSENVRHLPTPFGGVKNSGIGRDGGDYSFEFYMETKNIAISLGTHKTAKLGVGQAPAVGKKEAGE

SEQ ID NO: 23458 - protein, 180 aa, Deinococcus radiodurans
MFPMTSSSAPTDLDRQVLEFLQRAFEVARAGDAAELRVMLDQGLPLNVRNQKGDTLLMLAVYHSHLDATRLLLERGADASIANDMGQTPLQAAAFKGELPMVQLLLDHGVDVESRGPTGRTALMFAAMFARLDILELLLERGADLQARDSAGTSALDAARTMNAQPSVTWLEERLARSSG

SEQ ID NO: 23459 - protein, 772 aa, Deinococcus radiodurans
MADFHFALLKGRWLMAPKRTLSTPLSLDDAQKQVDDLSKAQDLSANTTDPGTTLTDNMGHVVSDDQNSLRAGERGPTLMEDFLFREKITHFDHERIPERVVHARGAGAHGYFQLDKSLEKYTHAKVLTEVGVKTPVFARFSTVAGSRGSADTARDVRGFAVKMYTKEGNWDIVGNNIPVFFIQDAIKFPDLIHSVKPEPHNEIPQAASAHDTFYDFIAETPEAMHMLMWIHSDRAIPRAYNMMEGFGVHTFRLVNAQGKAHLVKFHWKPVLGVKSLVWDEAQKIAGKDADFHRRSMWETIDQGGTLEWDFGVQVFTEEEAMKWDFDVLDATKIVPEDLVPVQRVGKMVLDRNVDNFFAETEQVAFMTQNVVPGIDFTNDPLLQGRNFSYLDTQLSRLGSPNWQELPINRPIIRVSNNQRDGHMRHTINKGRVAYFPNQMAANKPAQAGAAGFVTYPDKVEGTKLRVRAESFSDHYGQARLFWNSMSPVEKEHIAKSLRFELSKCETRDVRVRMLGHLAKINEVLAAQVAKGLGEKLPSTSDAKPGGQQDSASETALLAAAISPTTASGGLQKAKGLSQEEGQPKSAKGRKVAVLVADGVDAAGVKALQDALKKADVKYDIVAPHLGEIASGVMATATLSNTDPVVYDGVVVAGGAAAVRELAQHPESFNFVVGSYRHAKPIGSLGEGAEIVTGSGIGNVLRRVAADSPAKDGATAPVQNLSEVAGVRLAAGEGGAKLAALGVIVGQDKGASAAADSFVQALAEHRFWGRPQL

SEQ ID NO: 23460 - protein, 454 aa, Deinococcus radiodurans
MSIQSFEEKSVPMTVDRVLDDLGLGRFQWKLLAICGLTWAADAMEVLLMGFALPGISAAFELPKGSPAATMLLTATFAGMLFGAWFWGYLADRVGRRSVFLTTVALGVVFGLAGALAPTLTWLLVARFLTGFAIGGTLPVDYSMMAEFVPTAWRGRFLVYLESFWAVGTVVVAALAWWVSTAFAPAEGWRWLLGLAALPGLVGLIARIGIPDSPRSLLARGEEAQARAALQKVAQANGGTLPAAPLAHPEQPPRVSPAQLFRGVLARRTPLLMVTWFGLSLGYYGIFSWLPSFLRAQGLDLGAVYRSTLLLALAQVPGYLLAAYLVEKIGRRVTLVGFLTLGAVGAYLFLLAHDANTVLLTSALLSFALLGAWGSLYAYTPELFPTPLRTTGMGLVSGVARLASVVSPSIGAMLLTGNLTLALTVFAVCFALAALAAWGIGVETRGQALAETAE

SEQ ID NO: 23461 - protein, 526 aa, Deinococcus radiodurans
MSEMSRRNFLGMVGMVGGAAAAYQMMNTMGLAASSTYTKPQLTGGGKGKSVLILGGGLAGMASAYEMQKAGYDVQILEFNGRAGGRCWTIRGGDEYTELGGFKQTCEFDRGLYINPGPWRIPCHHHAYLHYAREFGVKLEPFIMENWNAYIHREGKNGQQPTRVRQAEARTDMQGHVAELLNKAASQGNLDTGLTTEDKEKLLEALHEWGFLNKDGRYVKSLETSTFRGYDRDPGARLEPGTPSQPIGLDTLLERRLWSDLNQGMWYEFRSTMFEPVGGMDAMARAFESRVGRFIKYRARVTEIKQDTDKVTATYVDADGTTKTASGDYCICTIPLSILSQIKLTGVDKDLAEAIKKVPYASSFKAGVQYKRRFWEQDDDIYGGISYTDLPNQLISYPSNNYFSTGKGVVLGAYMFGTDAVVMSGMSPEERLKKVVEYNAQLHPAAAKEFDNGVTVGWHRVPWTLGCYGLYNADTRERYYPTLCARHGRMMLAGEHTSYWNGWQEGALLAATTAVQEMHKFASSQA

SEQ ID NO: 23462 - protein, 580 aa, Deinococcus radiodurans
MPPGEDPMSHKTLPLTDHYDVKRGEDGHRYLRPLVRGFNLTRIPLLNKGTAFTAEEREAHGLDGLLAPQVDSLEVLIERAYREFSKRGAALEKHVYLRNLQDRNEVLFYALLSHHVEEMLPIVYTPTVGDAVKKFSQIYRYPRGLTLSTRTIERAEQALANVPLNDVRIIVATDSSAILGIGDQGFGGMAISIGKLSLYTVAGGVGPDKTLPVELDVGTGRADLREDPHYLGVKHERLTGEEYFAFIDKFVEATIQRYPKAIIQWEDFSKDAAFEVLARYRKVVPSFNDDIQGTGAVVLAGVLNACRIKGEALKDQVVVVHGAGAGGAGVAAAIREGMHREGLSPDEIARRVFVLDSRGLLTDDRSMEAYKQALATPRALVSGWSGTDLLGVVREAKATVLLGLSGVPGTFDEDIVKAALANTPRPLVFPLSNPTAHSEALPEDILRWTDGAAIVATGSPFAPVEHGGQTHEIGQGNNAFIFPGLGFGAILARVREITDEMVTEAAYALADYTQAHHPGRTYPPVNELSQASVQVAVAVIKQAIKDGVATEFSVRRLSDGELRAFVERKFWEPKFLPYHS

SEQ ID NO: 23463 - protein, 655 aa, Deinococcus radiodurans
MSLVHSTYGTAVCPNSVLSAVFPFSPLEAPLLKRLNPWIIVLLVLGLFLMFTNLPGSGRYTVNYNEFKSLLNQGRIERVTVREDVATVLLKERGQVSVITPQGQATKDGVESLIVRLPGNQATPDSGLIPQLEAKGVDYRFEAPSQWFAILINFLPLILLFGMMYFFFARSQGGQGGVMQFGQSKAKKYGKENRVPTKFTDVAGHEEAKRELIEVVDFLKNPAKYHQIGAEIPKGVLLVGPPGTGKTLLARAVAGEADVPFFSVSASEFMEMFVGVGASRVRTLFEDARKSAPAIIFIDEIDSIGRKRGAGIGGGHDEREQTLNQILSEMDGFDKSSSVIVLGATNRPDVLDPALLRPGRFDRQVTIDLPNLKEREAILKVHLRNKPLGEGVDVPEIAKSTPYFSGADLKNITNEAALEAARVGKTKIDMSDFYRALDKITLGLENSSLTISEPEKRAIAFHEAGHAVTAAVIPGSDKLQKVSIIPRGRALGAAFYLPEEQVLMSKERLENQLVVALGGRAAEEVFVGTITSGAADDFRKATNIARKMVLEWGMGENFRNMALQTDGGGPVFLGEDMGKPKMFSEHTAQLVDEDVKRILAAAYERSRQIVSDYKQAMQEVADALLTHELITGDVVRDAVARVGGQSVAVAPAPTV

SEQ ID NO: 23464 - protein, 577 aa, Deinococcus radiodurans
MVMTYTDSEELYLAELSRRQQESWPAGRPRVAEYPFGERPVTAYLHEWATRQPERAAIEFYGQTLTYAELDDLSDRLASWLEERGVLPGERVAVLLPNCPQFNVAFHGVLKRGAVFVPLSPLARGGELQHLLDEADPAALIVLDALWPVAEPHLAGRAVREVLHVGLAATLPDRPTLPLPDLLRAAAAQPAGQHDLFALLRGVTVRPQAEPALDSPAVINFSGGTTGLPKGCLHHHRDLIYTCASYCAVAVERSEHPVFLSFLPQFWIAGEDLGVLFPTFLGATLVLLTRWDAQAFLRAVPHYGVTITTLLVDQVDELLEHPAAAQTDFSSLRQVNAVSFMRKLNPDYRRRWAALTGSLIAEASYGMTETNTCDTFTTGFQKDDFDLLSQPTFVGLPVPGTEFKVCDFETGELRPFGEEGELCVRSPAVYKGSWRERRAESPGGWLHTGDSGIIDEQGLLHYLGRRREMIKVSGMSVFPGELEMLLGRHPAVSGVGVLGRPHERRGEEVVAFVVPRPGHDLSAAALSEWCRAEMAAYKVPTIYFLDELPLTATGKVDKKQLLPRLAELTGEAPGGGA

SEQ ID NO: 23465 - protein, 438 aa, Deinococcus radiodurans
MATGRTGPALPPGRAHPAGSCHAQSPRSPHPSQQTGQSHRDKNSRLKNVSLFAPGGRHPASRTLPLTAYLISAATAVPGTAYPQTLIRDLLRAQPQMDRLAQRLIPSAFNASGIDTRYSVIPDYLGAGGPFFDAVSGQMLSPGTGLRNEVYTREVTPLFIDAGRRALEGSGLAPEDITHVVTVSCTGFFAPGPDYLVVRALGLPATTQRFHVGFMGCYAAFPALRMARAFCDADPQANVLVICAELCTLHVKVSPDPDDIVSSAVFADGAAAVVVSAQPPVTGRTALRFDAFETALTPPDQGEKDMAWTIGDQGYQMVLSSYVPRLIETHLHGAVGPLLHTLPGELAQAGEHIEHWAVHPGGRSILDKVEGSLGLSETQMHASREELRRYGNMSSATVLFILRDLLEEVRDGERVCAMAFGPGLTVESGLMTAVGASE

SEQ ID NO: 23466 - protein, 386 aa, Deinococcus radiodurans
MFDYFKMLDLVSPDERDIHAATRKFVDAEIIPHIGDWWEHESAPTRELMRKMGSLGLLGPTTPEQYGGAGTSYTAYGLICYELERADSGLRSAASVQGSLVMHPINEYGSEEQKKQWLPGLASGELIGCFGLTEPDGGSDPGGMRTRARKDGGDYVLNGSKMWITNSPLADVAVVWAKDDEDVVRGFIVPRDARGFSTPKIGHKMSLRASTTGEIVLEDCRIPAENLLPGSRGLKSPLGCLTSARSGIAWGAMGALESVLTASLEYAGSRTTFGRPIAARQLVQEKLAWMATQHSLGSLLAWRLGNLKDGGQMNYAQVSVAKGNNVRVALEGARMAREIHGGNGITTEYPVIRHMLNLETVDTYEGTHDIHTLIVGRDLTGQNALE

SEQ ID NO: 23467 - protein, 287 aa, Deinococcus radiodurans
MSGEPSCPFGGPAPEHSAEQAHRDFSRSLSYGDYLHLDELRSAHQPITDAHDEHLFIAIHHVSEVWLSLIVRELQAAMRLLDAGITDAPLKMLTRVVRAQEQLTAAWDVLKTMTPADYLQFRGAFGQASGFQSQNYRMVEFLLGNRNSTLLRPHEHRADLHRPLAAALHAPSVYDLTLRLLAARGLPVPAEVLQRDYAQPYQTNEAVLASWLSVYCDTETYWDLYELAEKLVDVEDNFRRWRFNHLTTVERTIGFKRGSGGTSGVGYLRGALDVVLFPELWDVRTQL

SEQ ID NO: 23468 - protein, 477 aa, Deinococcus radiodurans
MTATPQASARPERPFATVNPYTGETVKTFPFLESAEIPALIERADQAYREWGQRPVTERAAIMRRAAELMLERTDELASLITLEMGKLLREAKGEVALAASILNYYGEQGPSFLEPKTIPVPQGEAAVLHAPLGVLLGIEPWNYPLYQVVRFAAPNLVVGNTVLLKHSELCPQSALALEQLFHDAGVPQGAYTNLFLRIADIEQVIAHPAVQGVSLTGSERAGASVAELAGRHLKKCVLELGGSDPFIVLDAEDLDTTVKAAATGRLSNTGQACIAAKRLMVVDDLYDEFVSRLGQTFSAFVPGDPADPSTRLGPLSSEQAARDLQAQVQDAIDKGATVVAGGQRPEHPGAFVQPTVLTDVTPDMRAYHEELFGPVAVVYRVRDEDEAVALANASTYGLGGAVFSSDLDRAQRVAERLDTGMVWINHPTSSAADLPFGGVKRSGFGRELSSMGMLEFTNQKLVRAFPTKQKPAQVAG

SEQ ID NO: 23469 - protein, 515 aa, Deinococcus radiodurans
MTVAEQQPQHQGYANPGTPGSVVTFKKRYDNFIGGQWVPPVKGQYFDNASPVDGKVFTQAARSTAEDVELALDAAHRAAPAWGRTSVTERSNILLKIADRMEQNLEMLAVAETWDNGKPVRETLAADLPLAIDHFRYFAGCIRAQEGGLSQIDDSTVAYHFHEPLGVVGQIIPWNFPLLMGVWKLAPALAAGNAVVLKPAEQTPASIMVLMELIADLLPEGVVNVVNGFGLEAGKPLASSPRIAKIAFTGETNTGRLIMGYAADNLIPVTLELGGKSPNIFFDDVMMEDDAFLDKAVEGMVMFALNQGEVCTCPSRALIQESIYDRFMERAVQRVEAITMGHPLDPGTMIGAQASTEQLDKILSYLDIGRAEGAEVLTGGERGQREGLEEGFYVKPTIFKGHNKMRIFQEEIFGPVLAAATFKDEAEALELANDTLYGLGAGLWTRDISRAYRMGRGIQAGRVWTNCYHVYPAHAAFGGYKQSGIGRENHRMMLDHYQQTKNLLVSYSPNKMGFF

SEQ ID NO: 23470 - protein, 602 aa, Deinococcus radiodurans
MTPRSGPRPAASARRDARQRDPRQLRRLLAYARPYRLPFVLGVLATLISSGLGLVFPRLFGTLIDASFLKVGSTDTGPLDRTVLSLLGIFALSACFGAAQAYLLARVGAGVVADLRRALFSHLLSLSPRFFGNHRTGDLTSRLTSDVGTVQAVTSTALAQLASQGFTLIGSVLLLVQTSPRLSLLTLAIIPLVIGTAVTIGRRIRRVSREVQDAVAAANGQAEEAISGVRVVQSFTAEGLEEERYGQGVLASFRAALRRARLQALMTGVMSFLTFGALALVLWFGGRQVMSGALTPGNLVTFLFYALQVGGTVAALTGVFNQFQEALGASSRIFELLDERSDLPGPAAPRPLSRAEGRVRFVDVGFTYAGAPALQDITFDVPAGQVVALVGPSGAGKTTLVNLIPRFWDVTAGRVEVDGHDVRAYALADLRRQVGLVPQETLLFSGTVAENILYGRPGASQAEVEAAAHAAHAHEFICELEGGYGAVVGERGVKLSGGQRQRVAIARAILKDPRILILDEATSALDNESEALVQAALERLMVGRTTFVVAHRLSTIRSADRILVMDAGRVVADGTHEGLMAAGGLYRELYELQFRQQQEARR

SEQ ID NO: 23471 - protein, 390 aa, Deinococcus radiodurans
MSRARCCRRLPTARRCAGCICVRAPRLPVAAFTACAGSTRHERRWQTSSASGSKAALSRAGPHKIRLRPLQPATPPASAHWAAGDLMTNDDKTKQANGQPETAATENMPQEVPAETQEQQPGSEAEMSLAPVVIRDDYRGSDKLKGKVALISGGDSGIGRAVAVHFAREGADVAILYLDEHQDARDTLKMVQAEGRQGLIIAGDIGDPKFCQDAVAQVMKELGKLDILVNNAAEQHPQENLTDITPEQLERTFRTNIFGMFYLTQAALPHLQKGAVIVNTTSVTAYKGSPELLDYSSTKGAILAFTRSLSQNLADKGIRVNAVAPGPIWTPLIPSTFDQKRVAEHGKKTPLERPGQPAEVAPSYVFLASEDSSYITGQVLHPNGGDVVNG

SEQ ID NO: 23472 - protein, 335 aa, Deinococcus radiodurans
MPDDALPGLVPRIPHGGPSSAAFVGLDFSVNCNPYGPNPALLAAVRGADHAHYPDPSYLGVRRRLADWHGVSPDEVVLSVGASDLLHRVVRAFLPAGDVLLSLHAPFGELARAAQLQRAKIHVMDEVPAALPPRTRLVYVGQPHNPTGRRLCAPELDILANACAAAHALLVLDLAYAPFLSLPVHHHPFTINVLSPGKAHGLVGARPAYALARAEVTARLDNLAPAWHLPAGTAALLAALPAAQDFLSETLPRVQNDAAALAHALREFGPVERRGTPFLTLEVGDAAAVARKLLPLGIRVRDCASYGLPGRVRVSTQANKNDRRLIGALQEVLYG

SEQ ID NO: 23473 - protein, 691 aa, Deinococcus radiodurans
MKANMKLLALLCALGSGAAGAASTNTMTLAGTEITNQAQATFTVGGATQTTNSDAVKIVVNAVPSYTITNDGTEASPAYTSTVNVNSNATYSYSVKNTGNTPIQVAVGATVGTGSSAITQVNYSGAATGTVPTTGAATIQTITINPDQTVTLTQTFVTPAAPGTYYVNPTGVSMQYASVAANPDGSALTTATLDQTSNRTDVNNVNKTTVLTNVPLLGSPTLTNTVVPSSPNPLPPTGTTTPGTGTGPVGSGNGPAESTGPAYTGIGSTSGTQPPVVVDASGNQYAYPKADAETVNPDSVTMTTIITNPNPTAATYELVPDLSGLPAGVTVTFTDANGNPLPDTDGNGRPEVTAGPNGGTATYRVVVTYPDTESAAAVAGPIRIPVGVDGNRDGIVDATVTYNVLLSNLKFGNTNGTALGVSDVPVTRTVTQPSVTTAVVFPMDLFNDGAYDGNYALSGSTPIGPVKYYATNPDTDGDGVLSPAELAALPAEIASTGAVPVKTEKTVYAVVTIPAGQAPGDYMVTQTATGSLSGTTKSFNTDKVTVTSPNGSLLIAKRVTTPGTTTPSLNATANPGDAVSYTVTATNNYNTSLYGLVLRDPSSNNLGSFSSSNVFGFIKPSSLRATVSGVSGATVLYRTSNLNTWAAQPTVDANTTWVEVGVDTNNNSQIDSGDVFPPNAVITLTLQGTVK

SEQ ID NO: 23474 - protein, 702 aa, Deinococcus radiodurans
MHWRTHPMERWIELNNKVLAGNVVDTQHDTDALQAYFQEKVNPNTVFFHDLREKIRYLTEHGLWDARLFERYSSEDVRQVFEKAYGYKFRFKAFMGAYKFYSEYAGMTPDRSRWLERYEDRLSITALARSERVDEALELVHHLVNQTFTPATPTLMNSGKANTGRLVSCFLLQDCTDNLDSITKTLSFVAELSKGGGGIGVEASNLRARGESLRGIQNVTKGVLGVAKMLDNMLRYADQAGQRPGAGAVYLSVMHADFSDLLNAKKIATDEDARLKTLSIGATIPDIFMEKVRCGEDIYQFYPHSFFQETGREFTSIDWTKEYQALADNPNIRKKRVSARRLLEDIAVTQGESGYPYLLFEGNANRANPIPNVGTIKMSNLCSEILQPTTPSYFHPYGQEHRDRIGLDVSCNLASLVIEQTMHGGDLGRVVGAAIRMLDNVARSTSVHEVPAVKRANDEMRSIGLGAMGLHSFLAGKELIYGSPEALEFVDVFFAAVHYHARKASMEIARDTGFVFSGFEGSRYQSGEHFAQYLERDFAPRRPEVAALFEGHTLPTRADWEQLVEDIKTHGLAHSFVMAIAPTGSISYVSHASASIMPITEKVETRTSNKARTIYPMPHLSEDTEWYYEEAYDMDQRRVLDTVAAAQKHVDQGISCTLFLPASATTRTLQSYYLYAYRLGIKTLYYTRLRKTNVQDCLSCVV

SEQ ID NO: 23475 - protein, 354 aa, Deinococcus radiodurans
MRGVNIQPDRVFGSPQPINNEVPMTPFSAANWSEPEDNFSATFYAKYTSQLWFPEEIPLTNDALAWKTLSDEERWTYIHASAGLNALDTLQGEVGMPRLRDLVDGHIRKATLQFQGMMEDIHARSYSLMNKTFLTASEEREVFEWVRTQPQLQHKIAVIQGVYRDPDVSDLGVWKKLVVSCMLETALFYSGFFYPLYLAGQGQMVSAGEIFNLIILDEALHGVYVALLAQEKFATMNAAEQADAQAWFDDTLQALYSNELAYTEQLYANVGLTGEVKKFIRFNFNVLADNLALPRPFGDEDINPIVQNGIQARGTTHDFFSAKGSSYSKMTVEPLTDADIETLWHEPAQVTVHE

SEQ ID NO: 23476 - protein, 542 aa, Escherichia coli
MKTRDSQSSDVIIIGGGATGAGIARDCALRGLRVILVERHDIATGATGRNHGLLHSGARYAVTDAESARECISENQILKRIARHCVEPTNGLFITLPEDDLSFQATFIRACEEAGISAEAIDPQQARIIEPAVNPALIGAVKVPDGTVDPFRLTAANMLDAKEHGAVILTAHEVTGLIREGATVCGVRVRNHLTGETQALHAPVVVNAAGIWGQHIAEYADLRIRMFPAKGSLLIMDHRINQHVINRCRKPSDADILVPGDTISLIGTTSLRIDYNEIDDNRVTAEEVDILLREGEKLAPVMAKTRILRAYSGVRPLVASDDDPSGRNVSRGIVLLDHAERDGLDGFITITGGKLMTYRLMAEWATDAVCRKLGNTRPCTTADLALPGSQEPAEVTLRKVISLPAPLRGSAVYRHGDRTPAWLSEGRLHRSLVCECEAVTAGEVQYAVENLNVNSLLDLRRRTRVGMGTCQGELCACRAAGLLQRFNVTTSAQSIEQLSTFLNERWKGVQPIAWGDALRESEFTRWVYQGLCGLEKEQKDAL

SEQ ID NO: 23477 - protein, 419 aa, Escherichia coli
MRFDTVIMGGGLAGLLCGLQLQKHGLRCAIVTRGQSALHFSSGSLDLLSHLPDGQPVTDIHSGLESLRQQAPAHPYSLLEPQRVLDLACQAQALIAESGAQLQGSVELAHQRVTPLGTLRSTWLSSPEVPVWPLPAKKICVVGISGLMDFQAHLAAASLRELGLAVETAEIELPELDVLRNNATEFRAVNIARFLDNEENWPLLLDALIPVANTCEMILMPACFGLADDKLWRWLNEKLPCSLMLLPTLPPSVLGIRLQNQLQRQFVRQGGVWMPGDEVKKVTCKNGVVNEIWTRNHADIPLRPRFAVLASGSFFSGGLVAERNGIREPILGLDVLQTATRGEWYKGDFFAPQPWQQFGVTTDETLRPSQAGQTIENLFAIGSVLGGFDPIAQGCGGGVCAVSALHAAQQIAQRAGGQQ

SEQ ID NO: 23478 - protein, 405 aa, Escherichia coli
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPRGALYMFPKIDAKRFNIHDDQKMVLDFLLQEKVLLVQGTAFNWPWPDHFRIVTLPRVDDIELSLSKFARFLSGYHQL

SEQ ID NO: 23479 - protein, 222 aa, Escherichia coli
MPEEARVRCKGFLFDLDGTLVDSLPAVERAWSNWARRHGLAPEEVLAFIHGKQAITSLRHFMAGKSEADIAAEFTRLEHIEATETEGITALPGAIALLSHLNKAGIPWAIVTSGSMPVARARHKIAGLPAPEVFVTAERVKRGKPEPDAYLLGAQLLGLAPQECVVVEDAPAGVLSGLAAGCHVIAVNAPADTPRLNEVDLVLHSLEQITVTKQPNGDVIIQ

SEQ ID NO: 23480 - protein, 215 aa, Escherichia coli [sequence omitted]

SEQ ID NO: 23481 - protein, 337 aa, Escherichia coli
MSEGWNIAVLGATGAVGEALLETLAERQFPVGEIYALARNESAGEQLRFGGKTITVQDAAEFDWTQAQLAFFVAGKEATAAWVEEATNSGCLVIDSSGLFALEPDVPLVVPEVNPFVLTDYRNRNVIAVPDSLTSQLLAALKPLIDQGGLSRISVTSLISASAQGKKAVDALAGQSAKLLNGIPIDEEDFFGRQLAFNMLPLLPDSEGSVREERRIVDEVRKILQDEGLMISASVVQAPVFYGHAQMVNFEALRPLAAEEARDAFVQGEDIVLSEENEFPTQVGDASGTPHLSVGCVRNDYGMPEQVQFWSVADNVRFGGALMAVKIAEKLVQEYLY

SEQ ID NO: 23482 - protein, 406 aa, Escherichia coli
MKRAVITGLGIVSSIGNNQQEVLASLREGRSGITFSQELKDSGMRSHVWGNVKLDTTGLIDRKVVRFMSDASIYAFLSMEQAIADAGLSPEAYQNNPRVGLIAGSGGGSPRFQVFGADAMRGPRGLKAVGPYVVTKAMASGVSACLATPFKIHGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMKMAMHGVDTPIDYLNSHGTSTPVGDVKELAAIREVFGDKSPAISATKAMTGHSLGAAGVQEAIYSLLMLEHGFIAPSINIEELDEQAAGLNIVTETTDRELTTVMSNSFGFGGTNATLVMRKLKD

SEQ ID NO: 23483 - protein, 361 aa, Escherichia coli
MAGNTIGQLFRVTTFGESHGLALGCIVDGVPPGIPLTEADLQHDLDRRRPGTSRYTTQRREPDQVKILSGVFEGVTTGTSIGLLIENTDQRSQDYSAIKDVFRPGHADYTYEQKYGLRDYRGGGRSSARETAMRVAAGAIAKKYLAEKFGIEIRGCLTQMGDIPLDIKDWSQVEQNPFFCPDPDKIDALDELMRALKKEGDSIGAKVTVVASGVPAGLGEPVFDRLDADIAHALMSINAVKGVEIGDGFDVVALRGSQNRDEITKDGFQSNHAGGILGGISSGQQIIAHMALKPTSSITVPGRTINRFGEEVEMITKGRHDPCVGIRAVPIAEAMLAIVLMDHLLRQRAQNADVKTDIPRW

SEQ ID NO: 23484 - protein, 436 aa, Escherichia coli
MGQVLPLVTRQGDRIAIVSGLRTPFARQATAFHGIPAVDLGKMVVGELLARSEIPAEVIEQLVFGQVVQMPEAPNIAREIVLGTGMNVHTDAYSVSRACATSFQAVANVAESLMAGTIRAGIAGGADSSSVLPIGVSKKLARVLVDVNKARTMSQRLKLFSRLRLRDLMPVPPAVAEYSTGLRMGDTAEQMAKTYGITREQQDALAHRSHQRAAQAWSDGKLKEEVMTAFIPPYKQPLVEDNNIRGNSSLADYAKLRPAFDRKHGTVTAANSTPLTDGAAAVILMTESRAKELGLVPLGYLRSYAFTAIDVWQDMLLGPAWSTPLALERAGLTMSDLTLIDMHEAFAAQTLANIQLLGSERFAREALGRAHATGEVDDSKFNVLGGSIAYGHPFAATGARMITQTLHELRRRGGGFGLVTACAAGGLGAAMVLEAE

SEQ ID NO: 23485 - protein, 564 aa, Escherichia coli
MSDQLQMTDGMHIIVEALKQNNIDTIYGVVGIPVTDMARHAQAEGIRYIGFRHEQSAGYAAAASGFLTQKPGICLTVSAPGFLNGLTALANATVNGFPMIMISGSSDRAIVDLQQGDYEELDQMNAAKPYAKAAFRVNQPQDLGIALARAIRVSVSGRPGGVYLDLPANVLAATMEKDEALTTIVKVENPSPALLPCPKSVTSAISLLAKAERPLIILGKGAAYSQADEQLREFIESAQIPFLPMSMAKGILEDTHPLSAAAARSFALANADVVMLVGARLNWLLAHGKKGWAADTQFIQLDIEPQEIDSNRPIAVPVVGDIASSMQGMLAELKQNTFTTPLVWRDILNIHKQQNAQKMHEKLSTDTQPLNYFNALSAVRDVLRENQDIYLVNEGANTLDNARNIIDMYKPRRRLDCGTWGVMGIGMGYAIGASVTSGSPVVAIEGDSAFGFSGMEIETICRYNLPVTIVIFNNGGIYRGDGVDLSGAGAPSPTDLLHHARYDKLMDAFRGVGYNVTTTDELRHALTTGIQSRKPTIINVVIDPAAGTESGHITKLNPKQVAGN

SEQ ID NO: 23486 - protein, 412 aa, Escherichia coli
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 23487 - protein, 831 aa, Escherichia coli
MLTIQFLCPLPNGLHARPAWELKEQCSQWQSEITFINHRQNAKADAKSSLALIGTGTLFNDSCSLNISGSDEEQARRVLEEYIQVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIISNMEQVCAKLSASASDYLRERVSDIRDISEQLLHITWPELKPRNKLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIAANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQDFSNKEQAIQFLCGNLGVNGRTEHPFELEEDVWQREEIVTTGVGFGVAIPHTKSQWIRHSSISIARLAKPIGWQSEMGEVELVIMLTLGANEGMNHVKVFSQLARKLVNKNFRQSLFAAQDAQSILTLLETELTF

SEQ ID NO: 23488 - protein, 471 aa, Escherichia coli
MKIKTRFAPSPTGYLHVGGARTALYSWLFARNHGGEFVLRIEDTDLERSTPEAIEAIMDGMNWLSLEWDEGPYYQTKRFDRYNAVIDQMLEEGTAYKCYCSKERLEALREEQMAKGEKPRYDGRCRHSHEHHADDEPCVVRFANPQEGSVVFDDQIRGPIEFSNQELDDLIIRRTDGSPTYNFCVVVDDWDMEITHVIRGEDHINNTPRQINILKALKAPVPVYAHVSMINGDDGKKLSKRHGAVSVMQYRDDGYLPEALLNYLVRLGWSHGDQEIFTREEMIKYFTLNAVSKSASAFNTDKLLWLNHHYINALPPEYVATHLQWHIEQENIDTRNGPQLADLVKLLGERCKTLKEMAQSCRYFYEDFAEFDADAAKKHLRPVARQPLEVVRDKLAAITDWTAENVHHAIQATADELEVGMGKVGMPLRVAVTGAGQSPALDVTVHAIGKTRSIERINKALDFIAERENQQ

SEQ ID NO: 23489 - protein, 575 aa, Escherichia coli
MISGILASPGIAFGKALLLKEDEIVIDRKKISADQVDQEVERFLSGRAKASAQLETIKTKAGETFGEEKEAIFEGHIMLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAIRIAMDRREILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 23490 - protein, 285 aa, Escherichia coli
MFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 23491 - protein, 299 aa, Escherichia coli [sequence omitted]

SEQ ID NO: 23492 - protein, 404 aa, Escherichia coli
MGERKRRGYMQNELQTALFQAFDTLNLQRVKTFSVPPVTLCGPGSVSSCGQQAQTRGLKHLFVMADSFLHQAGMTAGLTRSLTVKGIAMTLWPCPVGEPCITDVCAAVAQLRESGCDGVIAFGGGSVLDAAKAVTLLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRERFSQIGRALRTKKSDDRDAINAVSELIAEVGIGKRLGDVGATSAHYGAWAQAALEDICLRSNPRTASLEQIVGLYAAAQ

SEQ ID NO: 23493 - protein, 316 aa, Escherichia coli
MNELDGIKQFTTVVADSGDIESIRHYHPQDATTNPSLLLKAAGLSQYEHLIDDAIAWGKKNGKTQEQQVVAACDKLAVNFGAEILKIVPGRVSTEVDARLSFDKEKSIEKARHLVDLYQQQGVEKSRILIKLASTWEGIRAAEELEKEGINCNLTLLFSFAQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 23494 - protein, 667 aa, Escherichia coli
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 23495 - protein, 240 aa, Escherichia coli
MTSVKEFAMKHDHFVVQSPDKPAQQLLLLFHGVGDNPVAMGEIGNWFAPLFPDALVVSVGGAEPSGNPAGRQWFSVQGITEDNRQARVDAIMPTFIETVRYWQKQSGVGANATALIGFSQGAIMVLESIKAEPGLASRVIAFNGRYASLPETASTATTIHLIHGGEDPVIDLAHAVAAQEALISAGGDVTLDIVEDLGHAIDNRSMQFALDHLRYTIPKHYFDEALSGGKPGDDDVIEMM

SEQ ID NO: 23496 - protein, 292 aa, Escherichia coli
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 23497 - protein, 488 aa, Escherichia coli
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 23498 - protein, 143 aa, Escherichia coli
MAIERTFSIIKPNAVAKNVIGNIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 23499 - protein, 334 aa, Escherichia coli
MRENLRYVIQYHAHTIRILVRIVAQTAKSASFACRFSLNIRQFSLTPAKMEMPMSTTWFVGADWLAEHIDDPEIQIIDARMASPGQEDRNVAQEYLNGHIPGAVFFDIEALSDHTSPLPHMLPRPETFAVAMRELGVNQDKHLIVYDEGNLFSAPRAWWMLRTFGVEKVSILGGGLAGWQRDDLLLEEGAVELPEGEFNAAFNPEAVVKVTDVLLASHENTAQIIDARPAARFNAEVDEPRPGLRRGHIPGALNVPWTELVREGELKTTDELDAIFFGRGVSYDKPIIVSCGSGVTAAVVLLALATLDVPNVKLYDGAWSEWGARADLPVEPVK

SEQ ID NO: 23500 - protein, 616 aa, Escherichia coli
MALLQISEPGLSAAPHQRRLAAGIDLGTTNSLVATVRSGQAETLADHEGRHLLPSVVHYQQQGHSVGYDARTNAALDTANTISSVKRLMGRSLADIQQRYPHLPYQFQASENGLPMIETAAGLLNPVRVSADILKALAARATEALAGELDGVVITVPAYFDDAQRQGTKDAARLAGLHVLRLLNEPTAAAIAYGLDSGQEGVIAVYDLGGGTFDISILRLSRGVFEVLATGGDSALGGDDFDHLLADYIREQAGIPDRSDNRVQRELLDAAIAAKIALSDADSVTVNVAGWQGEISREQFNELIAPLVKRTLLACRRALKDAGVEADEVLEVVMVGGSTRVPLVRERVGEFFGRPPLTSIDPDKVVAIGAAIQADILVGNKPDSEMLLLDVIPLSLGLETMGGLVEKVIPRNTTIPVARAQDFTTFKDGQTAMSIHVMQGERELVQDCRSLARFALRGIPALPAGGAHIRVTFQVDADGLLSVTAMEKSTGVEASIQVKPSYGLTDSEIASMIKDSMSYAEQDVKARMLAEQKVEAARVLESLHGALAADAALLSAAERQVIDDAAAHLSEVAQGDDVDAIEQAIKNVDKQTQDFAARRMDQSVRRALKGHSVDEV

SEQ ID NO: 23501 - protein, 270 aa, Escherichia coli
MSDLHNESIFITGGGSGLGLALVERFIEEGAQVATLELSAAKVASLRQRFGEHILAVEGNVTCYADYQRAVDQILTRSGKLDCFIGNAGIWDHNASLVNTPAETLETGFHELFNVNVLGYLLGAKACAPALIASEGSMIFTLSNAAWYPGGGGPLYTASKHAATGLIRQLAYELAPKVRVNGVGPCGMASDLRGPQALGQSETSIMQSLTPEKIAAILPLQFFPQPADFTGPYVMLTSRRNNRALSGVMINADAGLAIRGIRHVAAGLDL

SEQ ID NO: 23502 - protein, 364 aa, Escherichia coli
MKINRIVNEGFMKTMLAAYLPGNSTVDLREVAVPTPGINQVLIKMKSSGICGSDVHYIYHQHRATAAAPDKPLYQGFINGHEPCGQIVAMGQGCRHFKEGDRVLVYHISGCGFCPNCRRGFPISCTGEGKAAYGWQRDGGHAEYLLAEEKDLILLPDALSYEDGAFISCGVGTAYEGILRGEVSGSDNVLVVGLGPVGMMAMMLAKGRGAKRIIGVDMLPERLAMAKQLGVMDHGYLATTEGLPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYALMASGKCGKVVINFPD

SEQ ID NO: 23503 - protein, 503 aa, Escherichia coli
MFTATEAVPVAKVVAGNKRYPGVVALDNVNFTLNKGEVRALLGKNGAGKSTLIRMLTGSERPDSGDIWIGETRLEGDEATLTRRAAELGVRAVYQELSLVEGLTVAENLCLGQWPRRNGMIDYLQMAQDAQRCLQALGVDVSPEQLVSTLSPAQKQLVEIARVMKGEPRVVILDEPTSSLASAEVELVISAVKKMSALGVAVIYVSHRMEEIRRIASCATVMRDGQVAGDVMLENTSTHHIVSLMLGRDHVDIAPVAPQEIVDQAVLEVRALRHKPKLEDISFTLRRGEVLGIAGLLGAGRSELLKAIVGLEEYEQGEIVINGEKITRPDYGDMLKRGIGYTPENRKEAGIIPWLGVDENTVLTNRQKISANGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHAPVNVDELMSAILSVH

SEQ ID NO: 23504 - protein, 324 aa, Escherichia coli
MANMFALILVIATLVTGILWCVDKFFFAPKRRERQAAAQAAAGDSLDKATLKKVAPKPGWLETGASVFPVLAIVLIVRSFIYEPFQIPSGSMMPTLLIGDFILVEKFAYGIKDPIYQKTLIETGHPKRGDIVVFKYPEDPKLDYIKRAVGLPGDKVTYDPVSKELTIQPGCSSGQACENALPVTYSNVEPSDFVQTFSRRNGGEATSGFFEVPKNETKENGIRLSERKETLGDVTHRILTVPIAQDQVGMYYQQPGQQLATWIVPPGQYFMMGDNRDNSADSRYWGFVPEANLVGRATAIWMSFDKQEGEWPTGLRLSRIGGIH

SEQ ID NO: 23505 - protein, 540 aa, Escherichia coli
MNTLPEHSCDVLIIGSGAAGLSLALRLADQHQVIVLSKGPVTEGSTFYAQGGIAAVFDETDSIDSHVEDTLIAGAGICDRHAVEFVASNARSCVQWLIDQGVLFDTHIQPNGEESYHLTREGGHSHRRILHAADATGREVETTLVSKALNHPNIRVLERSNAVDLIVSDKIGLPGTRRVVGAWVWNRNKETVETCHAKAVVLATGGASKVYQYTTNPDISSGDGIAMAWRAGCRVANLEFNQFHPTALYHPQARNFLLTEALRGEGAYLKRPDGTRFMPDFDERGELAPRDIVARAIDHEMKRLGADCMFLDISHKPADFIRQHFPMIYEKLLGLGIDLTQEPVPIVPAAHYTCGGVMVDDHGRTDVEGLYAIGEVSYTGLHGANRMASNSLLECLVYGWSAAEDITRRMPYAHDISTLPPWDESRVENPDERVVIQHNWHELRLFMWDYVGIVRTTKRLERALRRITMLQQEIDEYYAHFRVSNNLLELRNLVQVAELIVRCAMMRKESRGLHFTLDYPELLTHSGPSILSPGNHYINR

SEQ ID NO: 23506 - protein, 444 aa, Escherichia coli
MTVTTFSELELDESLLEALQDKGFTRPTAIQAAAIPPALDGRDVLGSAPTGTGKTAAYLLPALQHLLDFPRKKSGPPRILILTPTRELAMQVSDHARELAKHTHLDIATITGGVAYMNHAEVFSENQDIVVATTGRLLQYIKEENFDCRAVETLILDEADRMLDMGFAQDIEHIAGETRWRKQTLLFSATLEGDAIQDFAERLLEDPVEVSANPSTRERKKIHQWYYRADDLEHKTALLVHLLKQPEATRSIVFVRKRERVHELANWLREAGINNCYLEGEMVQGKRNEAIKRLTEGRVNVLVATDVAARGIDIPDVSHVFNFDMPRSGDTYLHRIGRTARAGRKGTAISLVEAHDHLLLGKVGRYIEEPIKARVIDELRPKTRAPSEKQTGKPSKKVLAKRAEKKKAKEKEKPRVKKRHRDTKNIGKRRKPSGTGVPPQTTEE

SEQ ID NO: 23507 - protein, 229 aa, Escherichia coli
MANELTWHDVLAEEKQQPYFLNTLQTVASERQSGVTIYPPQKDVFNAFRFTELGDVKVVILGQDPYHGPGQAHGLAFSVRPGIAIPPSLLNMYKELENTIPGFTRPNHGYLESWARQGVLLLNTVLTVRAGQAHSHASLGWETFTDKVISLINQHREGVVFLLWGSHAQKKGAIIDKQRHHVLKAPHPSPLSAHRGFFGCNHFVLANQWLEQRGETPIDWMPVLPAESE

SEQ ID NO: 23508 - protein, 857 aa, Escherichia coli
MRLDRLTNKFQLALADAQSLALGHDNQFIEPLHLMSALLNQEGGSVSPLLTSAGINAGQLRTDINQALNRLPQVEGTGGDVQPSQDLVRVLNLCDKLAQKRGDNFISSELFVLAALESRGTLADILKAAGATTANITQAIEQMRGGESVNDQGAEDQRQALKKYTIDLTERAEQGKLDPVIGRDEEIRRTIQVLQRRTKNNPVLIGEPGVGKTAIVEGLAQRIINGEVPEGLKGRRVLALDMGALVAGAKYRGEFEERLKGVLNDLAKQEGNVILFIDELHTMVGAGKADGAMDAGNMLKPALARGELHCVGATTLDEYRQYIEKDAALERRFQKVFVAEPSVEDTIAILRGLKERYELHHHVQITDPAIVAAATLSHRYIADRQLPDKAIDLIDEAASSIRMQIDSKPEELDRLDRRIIQLKLEQQALMKESDEASKKRLDMLNEELSDKERQYSELEEEWKAEKASLSGTQTIKAELEQAKIAIEQARRVGDLARMSELQYGKIPELEKQLEAATQLEGKTMRLLRNKVTDAEIAEVLARWTGIPVSRMMESEREKLLRMEQELHHRVIGQNEAVDAVSNAIRRSRAGLADPNRPIGSFLFLGPTGVGKTELCKALANFMFDSDEAMVRIDMSEFMEKHSVSRLVGAPPGYVGYEEGGYLTEAVRRRPYSVILLDEVEKAHPDVFNILLQVLDDGRLTDGQGRTVDFRNTVVIMTSNLGSDLIQERFGELDYAHMKELVLGVVSHNFRPEFINRIDEVVVFHPLGEQHIASIAQIQLKRLYKRLEERGYEIHISDEALKLLSENGYDPVYGARPLKRAIQQQIENPLAQQILSGELVPGKVIRLEVNEDRIVAVQ

SEQ ID NO: 23509 - protein, 356 aa, Escherichia coli
MQKDALNNVHITDEQVLMTPEQLKAAFPLSLQQEAQIADSRKSISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 23510 - protein, 155 aa, Escherichia coli
MKIRSLSRFVLASTMFASFTASAVPGLWQQGYGQGNAEYSVTDASGKMFTINCTGNPDQNGIYQHSVFLILAGDKTVSSHDDSTGITVVMDHKQYAIPSTLGWRNGDNAWFSFIMDIRKARQFDVYVNDQKVGSFNPDVRNAQKVLPTLADCTND

SEQ ID NO: 23511 - protein, 482 aa, Escherichia coli
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 23512 - protein, 426 aa, Escherichia coli
MNSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYASSPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFDEAKQ

SEQ ID NO: 23513 - protein, 466 aa, Escherichia coli
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 23514 - protein, 714 aa, Escherichia coli
MATTTAECLTQETMDYHALNAMLNLYDSAGRIQFDKDRQAVDAFIATHVRPNSVTFSSQQQRLNWLVNEGYYDESVLNRYSRDFVITLFTHAHTSGFRFQTFLGAWKFYTSYTLKTFDGKRYLEDFADRVTMVALTLAQGDETLALQLTDEMLSGRFQPATPTFLNCGKQQRGELVSCFLLRIEDNMESIGRAVNSALQLSKRGGGVAFLLSNLREAGAPIKRIENQSSGVIPVMKMLEDAFSYANQLGARQGAGAVYLHAHHPDILRFLDTKRENADEKIRIKTLSLGVVIPDITFHLAKENAQMALFSPYDVERVYGKPFADVAISQHYDELVADERIRKKYLNARDFFQRLAEIQFESGYPYIMYEDTVNRANPIAGRINMSNLCSEILQVNSASEYDENLDYTRTGHDISCNLGSLNIAHTMDSPDFARTVETAVRGLTAVSDMSHIRSVPSIEAGNAASHAIGLGQMNLHGYLAREGIAYGSPEALDFTNLYFYAITWHALRTSMLLARERGETFAGFKQSRYASGEYFSQYLQGNWQPKTAKVGELFTRSGITLPTREMWAQLRDDVMRYGIYNQNLQAVPPTGSISYINHATSSIHPIVAKVEIRKEGKTGRVYYPAPFMTNENLALYQDAYEIGAEKIIDTYAEATRHVDQGLSLTLFFPDTATTRDINKAQIYAWRKGIKTLYYIRLRQMALEGTEIEGCVSCAL

SEQ ID NO: 23515 - protein, 400 aa, Escherichia coli
MAIKLEIKNLYKIFGEHPQRAFKYIEQGLSKEQILEKTGLSLGVKDASLAIEEGEIFVIMGLSGSGKSTMVRLLNRLIEPTRGQVLIDGVDIAKISDAELREVRRKKIAMVFQSFALMPHMTVLDNTAFGMELAGINAEERREKALDALRQVGLENYAHSYPDELSGGMRQRVGLARALAINPDILLMDEAFSALDPLIRTEMQDELVKLQAKHQRTIVFISHDLDEAMRIGDRIAIMQNGEVVQVGTPDEILNNPANDYVRTFFRGVDISQVFSAKDIARRTPNGLIRKTPGFGPRSALKLLQDEDREYGYVIERGNKFVGAVSIDSLKTALTQQQGLDAALIDAPLAVDAQTPLSELLSHVGQAPCAVPVVDEDQQYVGIISKGMLLRALDREGVNNG

SEQ ID NO: 23516 - protein, 188 aa, Escherichia coli
MYERYAGLIFDMDGTILDTEPTHRKAWREVLGHYGLQYDIQAMIALNGSPTWRIAQAIIELNQADLDPHALAREKTEAVRSMLLDSVEPLPLVDVVKSWHGRRPMAVGTGSESAIAEALLAHLGLRHYFDAVVAADHVKHHKPAPDTFLLCAQRMGVQPTQCVVFEDADFGIQAARAAGMDAVDVRLL

SEQ ID NO: 23517 - protein, 259 aa, Escherichia coli
MNQVAVVIGGGQTLGAFLCHGLAAEGYRVAVVDIQSDKAANVAQEINAEYGESMAYGFGADATSEQSVLALSRGVDEIFGRVDLLVYSAGIAKAAFISDFQLGDFDRSLQVNLVGYFLCAREFSRLMIRDGIQGRIIQINSKSGKVGSKHNSGYSAAKFGGVGLTQSLALDLAEYGITVHSLMLGNLLKSPMFQSLLPQYATKLGIKPDQVEQYYIDKVPLKRGCDYQDVLNMLLFYASPKASYCTGQSINVTGGQVMF

SEQ ID NO: 23518 - protein, 474 aa, Escherichia coli
MSVFPESFLWGGALAANQSEGAFREGDKGLTTVDMIPHGEHRMAVKLGLEKRFQLRDDEFYPSHEATDFYHRYKEDIALMAEMGFKVFRTSIAWSRLFPQGDEITPNQQGIAFYRSVFEECKKYGIEPLVTLCHFDVPMHLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGTYPAYSARVFREKGVTINKAPGDDEILKNTVDFVSFSYYASRCASAEMNANNSSAANVVKSLRNPYLQVSDWGWGIDPLGLRITMNMMYDRYQKPLFLVENGLGAKDEFAANGEINDDYRISYLREHIRAMGEAIADGIPLMGYTTWGCIDLVSASTGEMSKRYGFVFVDRDDAGNGTLTRTRKKSFWWYKKVIASNGEDLE

SEQ ID NO: 23519 - protein, 853 aa, Escherichia coli
MSAIENFDAHTPMMQQYLRLKAQHPEILLFYRMGDFYELFYDDAKRASQLLDISLTKRGASAGEPIPMAGIPYHAVENYLAKLVNQGESVAICEQIGDPATSKGPVERKVVRIVTPGTISDEALLQERQDNLLAAIWQDSKGFGYATLDISSGRFRLSEPADRETMAAELQRTNPAELLYAEDFAEMSLIEGRRGLRRRPLWEFEIDTARQQLNLQFGTRDLVGFGVENAPRGLCAAGCLLQYAKDTQRTTLPHIRSITMEREQDSIIMDAATRRNLEITQNLAGGAENTLASVLDCTVTPMGSRMLKRWLHMPVRDTRVLLERQQTIGALQDFTAGLQPVLRQVGDLERILARLALRTARPRDLARMRHAFQQLPELRAQLETVDSAPVQALREKMGEFAELRDLLERAIIDTPPVLVRDGGVIASGYNEELDEWRALADGATDYLERLEVRERERTGLDTLKVGFNAVHGYYIQISRGQSHLAPINYMRRQTLKNAERYIIPELKEYEDKVLTSKGKALALEKQLYEELFDLLLPHLEALQQSASALAELDVLVNLAERAYTLNYTCPTFIDKPGIRITEGRHPVVEQVLNEPFIANPLNLSPQRRMLIITGPNMGGKSTYMRQTALIALMAYIGSYVPAQKVEIGPIDRIFTRVGAADDLASGRSTFMVEMTETANILHNATEYSLVLMDEIGRGTSTYDGLSLAWACAENLANKIKALTLFATHYFELTQLPEKMEGVANVHLDALEHGDTIAFMHSVQDGAASKSYGLAVAALAGVPKEVIKRARQKLRELESISPNAAATQVDGTQMSLLSVPEETSPAVEALENLDPDSLTPRQALEWIYRLKSLV

SEQ ID NO: 23520 - protein, 208 aa, Escherichia coli
MVSRRVQALLDQLRAQGIQDEQVLNALAAVPREKFVDEAFEQKAWDNIALPIGQGQTISQPYMVARMTELLELTPQSRVLEIGTGSGYQTAILAHLVQHVCSVERIKGLQWQARRRLKNLDLHNVSTRHGDGWQGWQARAPFDAIIVTAAPPEIPTALMTQLDEGGILVLPVGEEHQYLKRVRRRGGEFIIDTVEAVRFVPLVKGELA

SEQ ID NO: 23521 - protein, 201 aa, Escherichia coli
MALHDENVVWHSHPVTVQQRELHHGHRGVVLWFTGLSGSGKSTVAGALEEALHKLGVSTYLLDGDNVRHGLCSDLGFSDADRKENIRRVGEVANLMVEAGLVVLTAFISPHRAERQMVRERVGEGRFIEVFVDTPLAICEARDPKGLYKKARAGELRNFTGIDSVYEAPESAEIHLNGEQLVTNLVQQLLDLLRQNDIIRS

SEQ ID NO: 23522 - protein, 244 aa, Escherichia coli
MSKLDLNALNELPKVDRILALAETNAELEKLDAEGRVAWALDNLPGEYVLSSSFGIQAAVSLHLVNQIRPDIPVILTDTGYLFPETYRFIDELTDKLKLNLKVYRATESAAWQEARYGKLWEQGVEGIEKYNDINKVEPMNRALKELNAQTWFAGLRREQSGSRANLPVLAIQRGVFKVLPIIDWDNRTIYQYLQKHGLKYHPLWDEGYLSVGDTHTTRKWEPGMAEEETRFFGLKRECGLHEG

SEQ ID NO: 23523 - protein, 570 aa, Escherichia coli
MSEKHPGPLVVEGKLTDAERMKHESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 23524 - protein, 121 aa, Escherichia coli
MMSTTLFKDFTFEAAHRLPHVPEGHKCGRLHGHSFMVRLEITGEVDPHTGWIIDFAELKAAFKPTYERLDHHYLNDIPGLENPTSEVLAKWIWDQVKPVVPLLSAVMVKETCTAGCIYRGE

SEQ ID NO: 23525 - protein, 286 aa, Escherichia coli
MRKVTSLSRGKLPFFFFALRKLELTMSIESLNAFSMDFFSLKGKTAIVTGGNSGLGQAFAMALAKAGANIFIPSFVKDNGETKEMIEKQGVEVDFMQVGITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGIAPGYYATDITLATRSNPETNQRVLDHIPANRWGDTQDLMGAAVFLASPASNYVNGHLLVVDGGYLVR

SEQ ID NO: 23526 - protein, 492 aa, Escherichia coli
MSKKYIIGIDGGSQSTKVVMYDLEGNVVCEGKGLLQPMHTPDADTAEHPDDDLWASLCFAGHDLMSQFAGNKEDIVGIGLGSIRCCRALLKADGTPAAPLISWQDARVTRPYEHTNPDVAYVTSFSGYLTHRLTGEFKDNIANYFGQWPVDYKSWAWSEDAAVMDKFNIPRHMLFDVQMPGTVLGHITPQAALATHFPAGLPVVCTTSDKPVEALGAGLLDDETAVISLGTYIALMMNGKALPKDPVAYWPIMSSIPQTLLYEGYGIRKGMWTVSWLRDMLGESLIQDARAQDLSPEDLLNKKASCVPPGCNGLMTVLDWLTNPWEPYKRGIMIGFDSSMDYAWIYRSILESVALTLKNNYDNMCNEMNHFAKHVIITGGGSNSDLFMQIFADVFNLPARRNAINGCASLGAAINTAVGLGLYPDYATAVDNMVRVKDIFIPIESNAKRYDAMNKGIFKDLTKHTDVILKKSYEVMHGELGNVDSIQSWSNA

SEQ ID NO: 23527 - protein, 432 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 23528 - protein, 918 aa, Escherichia coli
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 23529 - protein, 450 aa, Escherichia coli
MSSLSQAASSVEKRTNARYWIVVMLFIVTSFNYGDRATLSIAGSEMAKDIGLDPVGMGYVFSAFSWAYVIGQIPGGWLLDRFGSKRVYFWSIFIWSMFTLLQGFVDIFSGFGIIVALFTLRFLVGLAEAPSFPGNSRIVAAWFPAQERGTAVSIFNSAQYFATVIFAPIMGWLTHEVGWSHVFFFMGGLGIVISFIWLKVIHEPNQHPGVNKKELEYIAAGGALINMDQQNTKVKVPFSVKWGQIKQLLGSRMMIGVYIGQYCINALTYFFITWFPVYLVQARGMSILKAGFVASVPAVCGFIGGVLGGIISDWLMRRTGSLNIARKTPIVMGMLLSMVMVFCNYVNVEWMIIGFMALAFFGKGIGALGWAVMADTAPKEISGLSGGLFNMFGNISGIVTPIAIGYIVGTTGSFNGALIYVGVHALIAVLSYLVLVGDIKRIELKPVAGQ

SEQ ID NO: 23530 - protein, 383 aa, Escherichia coli
MMANRMILNETAWFGRGAVGALTDEVKRRGYQKALIVTDKTLVQCGVVAKVTDKMDAAGLAWAIYDGVVPNPTITVVKEGLGVFQNSGADYLIAIGGGSPQDTCKAIGIISNNPEFADVRSLEGLSPTNKPSVPILAIPTTAGTAAEVTINYVITDEEKRRKFVCVDPHDIPQVAFIDADMMDGMPPALKAATGVDALTHAIEGYITRGAWALTDALHIKAIEIIAGALRGSVAGDKDAGEEMALGQYVAGMGFSNVGLGLVHGMAHPLGAFYNTPHGVANAILLPHVMRYNADFTGEKYRDIARVMGVKVEGMSLEEARNAAVEAVFALNRDVGIPPHLRDVGVRKEDIPALAQAALDDVCTGGNPREATLEDIVELYHTAW

SEQ ID NO: 23531 - protein, 482 aa, Escherichia coli
MLSGYIAGAIMKQEVILVLDCGATNVRAIAVNRQGKIVARASTPNASDIAMENNTWHQWSLDAILQRFADCCRQINSELTECHIRGIAVTTFGVDGALVDKQGNLLYPIISWKCPRTAAVMDNIERLISAQRLQAISGVGAFSFNTLYKLVWLKENHPQLLERAHAWLFISSLINHRLTGEFTTDITMAGTSQMLDIQQRDFSPQILQATGIPRRLFPRLVEAGEQIGTLQNSAAAMLGLPVGIPVISAGHDTQFALFGAGAEQNEPVLSSGTWEILMVRSAQVDTSLLSQYAGSTCELDSQAGLYNPGMQWLASGVLEWVRKLFWTAETPWQMLIEEARLIAPGADGVKMQCDLLSCQNAGWQGVTLNTTRGHFYRAALEGLTAQLQRNLQMLEKIGHFKASELLLVGGGSRNTLWNQIKANMLDIPVKVLDDAETTVAGAALFGWYGVGEFNSPEEARAQIHYQYRYFYPQTEPEFIEEV

SEQ ID NO: 23532 - protein, 443 aa, Escherichia coli
MVKERKTELVEGFRHSVPYINTHRGKTFVIMLGGEAIEHENFSSIVNDIGLLHSLGIRLVVVYGARPQIDANLAAHHHEPLYHKNIRVTDAKTLELVKQAAGTLQLDITARLSMSLNNTPLQGAHINVVSGNFIIAQPLGVDDGVDYCHSGRIRRIDEDAIHRQLDSGAIVLMGPVAVSVTGESFNLTSEEIATQLAIKLKAEKMIGFCSSQGVTNDDGDIVSELFPNEAQARVEAQEEKGDYNSGTVRFLRGAVKACRSGVRRCHLISYQEDGALLQELFSRDGIGTQIVMESAEQIRRATINDIGGILELIRPLEQQGILVRRSREQLEMEIDKFTIIQRDNTTIACAALYPFPEEKIGEMACVAVHPDYRSSSRGEVLLERIAAQAKQSGLSKLFVLTTRSIHWFQERGFTPVDIDLLPESKKQLYNYQRKSKVLMADLG

SEQ ID NO: 23533 - protein, 962 aa, Escherichia coli
MPRSTWFKALLLLVALWAPLSQAETGWQPIQETIRKSDKDNRQYQAIRLDNGMVVLLVSDPQAVKSLSALVVPVGSLEDPEAYQGLAHYLEHMSLMGSKKYPQADSLAEYLKMHGGSHNASTAPYRTAFYLEVENDALPGAVDRLADAIAEPLLDKKYAERERNAVNAELTMARTRDGMRMAQVSAETINPAHPGSKFSGGNLETLSDKPGNPVQQALKDFHEKYYSANLMKAVIYSNKPLPELAKMAADTFGRVPNKESKKPEITVPVVTDAQKGIIIHYVPALPRKVLRVEFRIDNNSAKFRSKTDELITYLIGNRSPGTLSDWLQKQGLVEGISANSDPIVNGNSGVLAISASLTDKGLANRDQVVAAIFSYLNLLREKGIDKQYFDELANVLDIDFRYPSITRDMDYVEWLADTMIRVPVEHTLDAVNIADRYDAKAVKERLAMMTPQNARIWYISPKEPHNKTAYFVDAPYQVDKISAQTFADWQKKAADIALSLPELNPYIPDDFSLIKSEKKYDHPELIVDESNLRVVYAPSRYFASEPKADVSLILRNPKAMDSARNQVMFALNDYLAGLALDQLSNQASVGGISFSTNANNGLMVNANGYTQRLPQLFQALLEGYFSYTATEDQLEQAKSWYNQMMDSAEKGKAFEQAIMPAQMLSQVPYFSRDERRKILPSITLKEVLAYRDALKSGARPEFMVIGNMTEAQATTLARDVQKQLGADGSEWCRNKDVVVDKKQSVIFEKAGNSTDSALAAVFVPTGYDEYTSSAYSSLLGQIVQPWFYNQLRTEEQLGYAVFAFPMSVGRQWGMGFLLQSNDKQPSFLWERYKAFFPTAEAKLRAMKPDEFAQIQQAVITQMLQAPQTLGEEASKLSKDFDRGNMRFDSRDKIVAQIKLLTPQKLADFFHQAVVEPQGMAILSQISGSQNGKAEYVHPEGWKVWENVSALQQTMPLMSEKNE

SEQ ID NO: 23534 - protein, 748 aa, Escherichia coli
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARAKYLLRRIDYAEAENLAQRSLEAQLATEVRHQVAAFMERRGMGGLIRGGL

SEQ ID NO: 23535 - protein, 420 aa, Escherichia coli
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 23536 - protein, 472 aa, Escherichia coli
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 23537 - protein, 253 aa, Escherichia coli
MILSAFSLEGKVAVVTGCDTGLGQGMALGLAQAGCDIVGINIVEPTETIEQVTALGRRFLSLTADLRKIDGIPALLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPIVFLASSASDYVNGYTIAVDGGWLAR

SEQ ID NO: 23538 - protein, 394 aa, Escherichia coli
MMKDVVIVGALRTPIGCFRGALAGHSAVELGSLVVKALIERTGVPAYAVDEVILGQVLTAGAGQNPARQSAIKGGLPNSVSAITINDVCGSGLKALHLATQAIQCGEADIVIAGGQENMSRAPHVLTDSRTGAQLGNSQLVDSLVHDGLWDAFNDYHIGVTAENLAREYGISRQLQDAYALSSQQKARAAIDAGRFKDEIVPVMTQSNGQTLVVDTDEQPRTDASAEGLARLNPSFDSLGSVTAGNASSINDGAAAVMMMSEAKARALNLPVLARIRAFASVGVDPALMGIAPVYATRRCLERVGWQLAEVDLIEANEAFAAQALSVGKMLEWDERRVNVNGGAIALGHPIGASGCRILVSLVHEMVKRNARKGLATLCIGGGQGVALTIERDE

SEQ ID NO: 23539 - protein, 363 aa, Escherichia coli
MLTWEQTPDELKQVLDVAAALKALRAENISTKVFNSGLGISVFRDNSTRTRFSYASALNLLGLAQQDLDEGKSQIAHGETVRETANMISFCADAIGIRDDMYLGAGNAYMREVGAALDDGYKQGVLPQRPALVNLQCDIDHPTQSMADLAWLREHFGSLENLKGKKIAMTWAYSPSYGKPLSVPQGIIGLMTRFGMDVTLAHPEGYDLIPDVVEVAKNNAKASGGSFRQVTSMEEAFKDADIVYPKSWAPYKVMEERTELLRANDHEGLKALEKQCLAQNAQHKDWHCTEEMMELTRDGEALYMHCLPADISGVSCKEGEVTEGVFEKYRIATYKEASWKPYIIAAMICPVNTPNQVHCSSNC

SEQ ID NO: 23540 - protein, 182 aa, Escherichia coli
MQTEHVILLNAQGVPTGTLEKYAAHTADTRLHLAFSSWLFNAKGQLLVTRRALSKKAWPGVWTNSVCGHPQLGESNEDAVIRRCRYELGVEITPPESIYPDFRYRATDPSGIVENEVCPVFAARTTSALQINDDEVMDYQWCDLADVLHGIDATPWAFSPWMVMQATNREARKRLSAFTQLK

SEQ ID NO: 23541 - protein, 479 aa, Escherichia coli
MIVKKLTLPKDFLWGGAVAAHQVEGGWNKGGKGPSICDVLTGGAHGVPREITKEVLPGKYYPNHEAVDFYGHYKEDIKLFAEMGFKCFRTSIAWTRIFPKGDEAQPNEEGLKFYDDMFDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAARRINPEMKVGCMLAMVPLYPYSCNPDDVMFAQESMRERYVFTDVQLRGYYPSYVLNEWERRGFNIKMEDGDLDVLREGTCDYLGFSYYMTNAVKAEGGTGDAISGFEGSVPNPYVKASDWGWQIDPVGLRYALCELYERYQRPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGEKL

SEQ ID NO: 23542 - protein, 247 aa, Escherichia coli
MAIALVTGGSRGIGRATALLLAQEGYTVAVNYQQNLHAAQEVMNLITQAGGKAFVLQADISDENQVVAMFTAIDQHDEPLAALVNNAGILFTQCTVENLTAERINRVLSTNVTGYFLCCREAVKRMALKNGGSGGAIVNVSSVASRLGSPGEYVDYAASKGAIDTLTTGLSLEVAAQGIRVNCVRPGFIYTEMHASGGEPGRVDRVKSNIPMQRGGQAEEVAQAIVWLLSDKASYVTGSFIDLAGGK

SEQ ID NO: 23543 - protein, 129 aa, Escherichia coli
MSNVPAELKYSKEHEWLRKEADGTYTVGITEHAQELLGDMVFVDLPEVGATVSAGDDCAVAESVKAASDIYAPVSGEIVAVNDALSDSPELVNSEPYAGGWIFKIKASDESELESLLDATAYEALLEDE

SEQ ID NO: 23544 - protein, 441 aa, Escherichia coli
MSEISRQEFQRRRQALVEQMQPGSAALIFAAPEVTRSADSEYPYRQNSDFWYFTGFNEPEAVLVLIKSDDTHNHSVLFNRVRDLTAEIWFGRRLGQDAAPEKLGVDRALAFSEINQQLYQLLNGLDVVYHAQGEYAYADVIVNSALEKLRKGSRQNLTAPATMIDWRPVVHEMRLFKSPEEIAVLRRAGEITAMAHTRAMEKCRPGMFEYHLEGEIHHEFNRHGARYPSYNTIVGSGENGCILHYTENECEMRDGDLVLIDAGCEYKGYAGDITRTFPVNGKFTQAQREIYDIVLESLETSLRLYRPGTSILEVTGEVVRIMVSGLVKLGILKGDVDELIAQNAHRPFFMHGLSHWLGLDVHDVGVYGQDRSRILEPGMVLTVEPGLYIAPDAEVPEQYRGIGIRIEDDIVITETGNENLTASVVKKPEEIEALMVAARKQ

SEQ ID NO: 23545 - protein, 359 aa, Escherichia coli
MSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 23546 - protein, 387 aa, Escherichia coli
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 23547 - protein, 339 aa, Escherichia coli
MTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 23548 - protein, 663 aa, Escherichia coli
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMSSTDAFDKQDAAYRESVLPKAVTARVAVEAGIADYWYKYVGLNGAIVGMTTFGESAPAELLFEEFGFTVDNVVAKAKELL

SEQ ID NO: 23549 - protein, 306 aa, Escherichia coli
MSTLGHQYDNSLVSNAFGFLRLPMNFQPYDSDADWVITGVPFDMATSGRAGGRHGPAAIRQVSTNLAWEHNRFPWNFDMRERLNVVDCGDLVYAFGDAREMSEKLQAHAEKLLAAGKRMLSFGGDHFVTLPLLRAHAKHFGKMALVHFDAHTDTYANGCEFDHGTMFYTAPKEGLIDPNHSVQIGIRTEFDKDNGFTVLDACQVNDRSVDDVIAQVKQIVGDMPVYLTFDIDCLDPAFAPGTGTPVIGGLTSDRAIKLVRGLKDLNIVGMDVVEVAPAYDQSEITALAAATLALEMLYIQAAKKGE

SEQ ID NO: 23550 - protein, 658 aa, Escherichia coli
MSDDMSMGLPSSAGEHGVLRSMQEVAMSSQEASKMLRTYNIAWWGNNYYDVNELGHISVCPDPDVPEARVDLAQLVKTREAQGQRLPALFCFPQILQHRLRSINAAFKRARESYGYNGDYFLVYPIKVNQHRRVIESLIHSGEPLGLEAGSKAELMAVLAHAGMTRSVIVCNGYKDREYIRLALIGEKMGHKVYLVIEKMSEIAIVLDEAERLNVVPRLGVRARLASQGSGKWQSSGGEKSKFGLAATQVLQLVETLREAGRLDSLQLLHFHLGSQMANIRDIATGVRESARFYVELHKLGVNIQCFDVGGGLGVDYEGTRSQSDCSVNYGLNEYANNIIWAIGDACEENGLPHPTVITESGRAVTAHHTVLVSNIIGVERNEYTVPTAPAEDAPRALQSMWETWQEMHEPGTRRSLREWLHDSQMDLHDIHIGYSSGIFSLQERAWAEQLYLSMCHEVQKQLDPQNRAHRPIIDELQERMADKMYVNFSLFQSMPDAWGIDQLFPVLPLEGLDQVPERRAVLLDITCDSDGAIDHYIDGDGIATTMPMPEYDPENPPMLGFFMVGAYQEILGNMHNLFGDTEAVDVFVFPDGSVEVELSDEGDTVADMLQYVQLDPKTLLTQFRDQVKKTDLDAELQQQFLEEFEAGLYGYTYLEDE

SEQ ID NO: 23551 - protein, 384 aa, Escherichia coli
MAKHLFTSESVSEGHPDKIADQISDAVLDAILEQDPKARVACETYVKTGMVLVGGEITTSAWVDIEEITRNTVREIGYVHSDMGFDANSCAVLSAIGKQSPDINQGVDRADPLEQGAGDQGLMFGYATNETDVLMPAPITYAHRLVQRQAEVRKNGTLPWLRPDAKSQVTFQYDDGKIVGIDAVVLSTQHSEEIDQKSLQEAVMEEIIKPILPAEWLTSATKFFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPSEQLTLLVREFFDLRPYGLIQMLDLLHPIYKETAAYGHFGREHFPWEKTDKAQLLRDAAGLK

SEQ ID NO: 23552 - protein, 464 aa, Escherichia coli
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 23553 - protein, 731 aa, Escherichia coli
MGQGFPPCPVFLLPRNGFALMKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPYRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVEIGIEARKAILARCKLFRPFIPPVVDGKLWQDYPTSVLASDRRFFSFEPGAKWHGFEGYAADQYFVDPCKLLLTTPGIDAETGEYSDFGVPATILAHYLRENGIVPEKCDLNSILFLLTPAESHEKLAQLVAMLAQFEQHIEDDSPLVEVLPSVYNKYPVRYRDYTLRQLCQEMHDLYVSFDVKDLQKAMFRQQSFPSVVMNPQDAHSAYIRGDVELVRIRDAEGRIAAEGALPYPPGVLCVVPGEVWGGAVQRYFLALEEGVNLLPGFSPELQGVYSETDADGVKRLYGYVLK

SEQ ID NO: 23554 - protein, 499 aa, Escherichia coli
MSILYEERLDGALPDVDRTSVLMALREHVPGLEILHTDEEIIPYECDGLSAYRTRPLLVVLPKQMEQVTAILAVCHRLRVPVVTRGAGTGLSGGALPLEKGVLLVMARFKEILDINPVGRRARVQPGVRNLAISQAVAPHNLYYAPDPSSQIACSIGGNVAENAGGVHCLKYGLTVHNLLKIEVQTLDGEALTLGSDALDSPGFDLLALFTGSEGMLGVTTEVTVKLLPKPPVARVLLASFDSVEKAGLAVGDIIANGIIPGGLEMMDNLSIRAAEDFIHAGYPVDAEAILLCELDGVESDVQEDCERVNDILLKAGATDVRLAQDEAERVRFWAGRKNAFPAVGRISPDYYCMDGTIPRRALPGVLEGIARLSQQYDLRVANVFHAGDGNMHPLILFDANEPGEFARAEELGGKILELCVEVGGSISGEHGIGREKINQMCAQFNSDEITTFHAVKAAFDPDGLLNPGKNIPTLHRCAEFGAMHVHHGHLPFPELERF

SEQ ID NO: 23555 - protein, 294 aa, Escherichia coli
MSHLKDPTTQYYTGEYPKQKQPTPGIQAKMTPVPDCGEKTYVGSGRLKDRKALVTGGDSGIGRAAAIAYAREGADVAISYLPVEEEDAQDVKKIIEECGRKAVLLPGDLSDEKFARSLVHEAHKALGGLDIMALVAGKQVAIPDIADLTSEQFQKTFAINVFALFWLTQEAIPLLPKGASIITTSSIQAYQPSPHLLDYAATKAAILNYSRGLAKQVAEKGIRVNIVAPGPIWTALQISGGQTQDKIPQFGQQTPMKRAGQPAELAPVYVYLASQESSYVTAEVHGVCGGEHLG

SEQ ID NO: 23556 - protein, 395 aa, Escherichia coli
MADKKLDTQLVNAGRSKKYTLGAVNSVIQRASSLVFDSVEAKKHATRNRANGELFYGRRGTLTHFSLQQAMCELEGGAGCVLFPCGAAAVANSILAFIEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNNEELANYLDNFSLFSMAYSWGGYESLILANQPEHIAAIRPQGEIDFSGTLIRLHIGLEDVDDLIADLDAGFARIV

SEQ ID NO: 23557 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 23558 - protein, 236 aa, Escherichia coli
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 23559 - protein, 487 aa, Escherichia coli
MKPSTEWWRYLAPLAVIAIIALLPVPAGLENHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 23560 - protein, 496 aa, Escherichia coli
MITEFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 23561 - protein, 1042 aa, Escherichia coli
MNGSDFSLPGGPMNRWENIQLTHENRLAPRAYFFSYDSVAQARTFARETSSLFLPLSGQWNFHFFDHPLQVPEAFTSELMADWGHITVPAMWQMEGHGKLQYTDEGFPFPIDVPFVPSDNPTGAYQRIFTLSDGWQGKQTLIKFDGVETYFEVYVNGQYVGFSKGSRLTAEFDISAMVKTGDNLLCVRVMQWADSTYVEDQDMWWSAGIFRDVYLVGKHLTHINDFTVRTDFDEAYCDATLSCEVVLENLAASPVVTTLEYTLFDGERVVHSSAIDHLAIEKLTSATFAFTVEQPQQWSAESPYLYHLVMTLKDANGNVLEVVPQRVGFRDIKVRDGLFWINNRYVMLHGVNRHDNDHRKGRAVGMDRVEKDLQLMKQHNINSVRTAHYPNDPRFYELCDIYGLFVMAETDVESHGFANVGDISRITDDPQWEKVYVERIVRHIHAQKNHPSIIIWSLGNESGYGCNIRAMYHAAKALDDTRLVHYEEDRDAEVVDIISTMYTRVPLMNEFGEYPHPKPRIICEYAHAMGNGPGGLTEYQNVFYKHDCIQGHYVWEWCDHGIQAQDDHGNVWYKFGGDYGDYPNNYNFCLDGLIYSDQTPGPGLKEYKQVIAPVKIHARDLTRGELKVENKLWFTTLDDYTLHAEVRAEGETLATQQIKLRDVAPNSEAPLQITLPQLDAREAFLNITVTKDSRTRYSEAGHPIATYQFPLKENTAQPVPFAPNNARPLTLEDDRLSCTVRGYNFAITFSKMSGKPTSWQVNGESLLTREPKINFFKPMIDNHKQEYEGLWQPNHLQIMQEHLRDFAVEQSDGEVLIISRTVIAPPVFDFGMRCTYIWRIAADGQVNVALSGERYGDYPHIIPCIGFTMGINGEYDQVAYYGRGPGENYADSQQANIIDIWRQAVDAMFENYPFPQNNGNRQHVRWTALTNRHGNGLLVVPQRPINFSAWHYTQENIHAAQHCNELQRSDDITLNLDHQLLGLGSNSWGSEVLDSWRVWFRDFSYGFTLLPVSGGEATAQSLASYEFGAGFFSTNLHSENKQ

SEQ ID NO: 23562 - protein, 444 aa, Escherichia coli
MILDTVDEKKKGVHTRYLILLIIFIVTAVNYADRATLSIAGTEVAKELQLSAVSMGYIFSAFGWAYLLMQIPGGWLLDKFGSKKVYTYSLFFWSLFTFLQGFVDMFPLAWAGISMFFMRFMLGFSEAPSFPANARIVAAWFPTKERGTASAIFNSAQYFSLALFSPLLGWLTFAWGWEHVFTVMGVIGFVLTALWIKLIHNPTDHPRMSAEELKFISENGAVVDMDHKKPGSAAASGPKLHYIKQLLSNRMMLGVFFGQYFINTITWFFLTWFPIYLVQEKGMSILKVGLVASIPALCGFAGGVLGGVFSDYLIKRGLSLTLARKLPIVLGMLLASTIILCNYTNNTTLVVMLMALAFFGKGFGALGWPVISDTAPKEIVGLCGGVFNVFGNVASIVTPLVIGYLVSELHSFNAALVFVGCSALMAMVCYLFVVGDIKRMELQK

SEQ ID NO: 23563 - protein, 286 aa, Escherichia coli
MSIISTKYLLQDAQANGYAVPAFNIHNAETIQAILEVCSEMRSPVILAGTPGTFKHIALEEIYALCSAYSTTYNMPLALHLDHHESLDDIRRKVHAGVRSAMIDGSHFPFAENVKLVKSVVDFCHSQDCSVEAELGRLGGVEDDMSVDAESAFLTDPQEAKRFVELTGVDSLAVAIGTAHGLYSKTPKIDFQRLAEIREVVDVPLVLHGASDVPDEFVRRTIELGVTKVNVATELKIAFAGAVKAWFAENPQGNDPRYYMRVGMDAMKEVVRNKINVCGSANRISA

SEQ ID NO: 23564 - protein, 890 aa, Escherichia coli
MTDVTIKTLAAERQTSVERLVQQFADAGIRKSADDSVSAQEKQTLIDHLNQKNSGPDKLTLQRKTRSTLNIPGTGGKSKSVQIEVRKKRTFVKRDPQEAERLAAEEQAQREAEEQARREAEESAKREAQQKAEREAAEQAKREAAEQAKREAAEKDKVSNQQDDMTKNAQAEKARREQEAAELKRKAEEEARRKLEEEARRVAEEARRMAEENKWTDNAEPTEDSSDYHVTTSQHARQAEDESDREVEGGRGRGRNAKAARPKKGNKHAESKADREEARAAVRGGKGGKRKGSSLQQGFQKPAQAVNRDVVIGETITVGELANKMAVKGSQVIKAMMKLGAMATINQVIDQETAQLVAEEMGHKVILRRENELEEAVMSDRDTGAAAEPRAPVVTIMGHVDHGKTSLLDYIRSTKVASGEAGGITQHIGAYHVETENGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDELLDAILLQAEVLELKAVRKGMASGAVIESFLDKGRGPVATVLVREGTLHKGDIVLCGFEYGRVRAMRNELGQEVLEAGPSIPVEILGLSGVPAAGDEVTVVRDEKKAREVALYRQGKFREVKLARQQKSKLENMFANMTEGEVHEVNIVLKADVQGSVEAISDSLLKLSTDEVKVKIIGSGVGGITETDATLAAASNAILVGFNVRADASARKVIEAESLDLRYYSVIYNLIDEVKAAMSGMLSPELKQQIIGLAEVRDVFKSPKFGAIAGCMVTEGVVKRHNPIRVLRDNVVIYEGELESLRRFKDDVNEVRNGMECGIGVKNYNDVRTGDVIEVFEIIEIQRTIA

SEQ ID NO: 23565 - protein, 447 aa, Escherichia coli
MTTILKHLPVGQRIGIAFSGGLDTSAALLWMRQKGAVPYAYTANLGQPDEEDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEYLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSENLTYKPERLTMEKGDSVFSPDDRIGQLTMRNLDITDTREKLFGYAKTGLLSSSAASGVPQVENLENKGQ

SEQ ID NO: 23566 - protein, 445 aa, Escherichia coli
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVEAALGNRGRVLLRKSGTEPLIRVMVEGEDEAQVTEFAHRIADAVKAV

SEQ ID NO: 23567 - protein, 644 aa, Escherichia coli
MAKNLILWLVIAVVLMSVFQSFGPSESNGRKVDYSTFLQEVNNDQVREARINGREINVTKKDSNRYTTYIPVQDPKLLDNLLTKNVKVVGEPPEEPSLLASIFISWFPMLLLIGVWIFFMRQMQGGGGKGAMSFGKSKARMLTEDQIKTTFADVAGCDEAKEEVAELVEYLREPSRFQKLGGKIPKGVLMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLAPDIDAAIIARGTPGFSGADLANLVNEAALFAARGNKRVVSMVEFEKAKDKIMMGAERRSMVMTEAQKESTAYHEAGHAIIGRLVPEHDPVHKVTIIPRGRALGVTFFLPEGDAISASRQKLESQISTLYGGRLAEEIIYGPEHVSTGASNDIKVATNLARNMVTQWGFSEKLGPLLYAEEEGEVFLGRSVAKAKHMSDETARIIDQEVKALIERNYNRARQLLTDNMDILHAMKDALMKYETIDAPQIDDLMARRDVRPPAGWEEPGASNNSGDNGSPKAPRPVDEPRTPNPGNTMSEQLGDK

SEQ ID NO: 23568 - protein, 323 aa, Escherichia coli
MNLEKINELTAQDMAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLEPVLEAMNACGSLEWTRQRAEEEADKAIAALQVLPDTPWREALIGLAHIAVQRDR

SEQ ID NO: 23569 - protein, 419 aa, Escherichia coli
MDKFRVQGPTKLQGEVTISGAKNAALPILFAALLAEEPVEIQNVPKLKDVDTSMKLLSQLGAKVERNGSVHIDARDVNVFCAPYDLVKTMRASIWALGPLVARFGQGQVSLPGGCTIGARPVDLHISGLEQLGATIKLEEGYVKASVDGRLKGAHIVMDKVSVGATVTIMCAATLAEGTTIIENAAREPEIVDTANFLITLGAKISGQGTDRIVIEGVERLGGGVYRVLPDRIETGTFLVAAAISRGKIICRNAQPDTLDAVLAKLRDAGADIEVGEDWISLDMHGKRPKAVNVRTAPHPAFPTDMQAQFTLLNLVAEGTGFITETVFENRFMHVPELSRMGAHAEIESNTVICHGVEKLSGAQVMATDLRASASLVLAGCIAEGTTVVDRIYHIDRGYERIEDKLRALGANIERVKGE

SEQ ID NO: 23570 - protein, 297 aa, Escherichia coli
MATNLRGVMAALLTPFDQQQALDKASLRRLVQFNIQQGIDGLYVGGSTGEAFVQSLSEREQVLEIVAEEAKGKIKLIAHVGCVSTAESQQLAASAKRYGFDAVSAVTPFYYPFSFEEHCDHYRAIIDSADGLPMVVYNIPALSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYLPELKALAQQLMQERG

SEQ ID NO: 23571 - protein, 312 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 23572 - protein, 449 aa, Escherichia coli
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRGDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 23573 - protein, 272 aa, Escherichia coli
METYAVFGNPIAHSKSPFIHQQFAQQLNIEHPYGRVLAPINDFINTLNAFFSAGGKGANVTVPFKEEAFARADELTERAALAGAVNTLMRLEDGRLLGDNTDGVGLLSDLERLSFIRPGLRILLIGAGGASRGVLLPLLSLDCAVTITNRTVSRAEELAKLFAHTGSIQALSMDELEGHEFDLIINATSSGISGDIPAIPSSLIHPGIYCYDMFYQKGKTPFLAWCEQRGSKRNADGLGMLVAQAAHAFLLWHGVLPDVEPVIKQLQEELSA

SEQ ID NO: 23574 - protein, 273 aa, Escherichia coli [sequence omitted]

SEQ ID NO: 23575 - protein, 406 aa, Escherichia coli
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPQYKGRARDFLYAGAEAGVMVLNAGPDVMRFAPSLVVEDADIDEGMQRFAHAVAKVVGA

SEQ ID NO: 23576 - protein, 462 aa, Escherichia coli
MTANSPLQRIGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 23577 - protein, 261 aa, Escherichia coli
MKTLATIGDNCVDIYPQLNKAFSGGNAVNVAVYCTRYGIQPGCITWVGDDDYGTKLKQDLARMGVDISHVHTKHGVTAQTQVELHDNDRVFGDYTEGVMADFALSEEDYAWLAQYDIVHAAIWGHAEDAFPQLHAAGKLTAFDFSDKWDSPLWQTLVPHLDFAFASAPQEDETLRLKMKAIVARGAGTVIVTLGENGSIAWDGAQFWRQAPEPVTVIDTMGAGDSFIAGFLCGWSAGMTLPQAIAQGTACAAKTIQYHGAW

SEQ ID NO: 23578 - protein, 252 aa, Escherichia coli
MNKFEDIRGVAFDLDGTLVDSAPGLAAAVDMALYALELPVAGEERVITWIGNGADVLMERALTWARQERATQRKTMGKPPVDDDIPAEEQVRILRKLFDRYYGEVAEEGTFLFPHVADTLGALQAKGLPLGLVTNKPTPFVAPLLEALDIAKYFSVVIGGDDVQNKKPHPDPLLLVAERMGIAPQQMLFVGDSRNDIQAAKAAGCPSVGLTYGYNYGEAIDLSQPDVIYQSINDLLPALGLPHSENQESKND

SEQ ID NO: 23579 - protein, 362 aa, Escherichia coli
MERIVVTLGERSYPITIASGLFNEPASFLPLKSGEQVMLVTNETLAPLYLDKVRGVLEQAGVNVDSVILPDGEQYKSLAVLDTVFTALLQKPHGRDTTLVALGGGVVGDLTGFAAASYQRGVRFIQVPTTLLSQVDSSVGGKTAVNHPLGKNMIGAFYQPASVVVDLDCLKTLPPRELASGLAEVIKYGIILDGAFFNWLEENLDALLRLDGPAMAYCIRRCCELKAEVVAADERETGLRALLNLGHTFGHAIEAEMGYGNWLHGEAVAAGMVMAARTSERLGQFSSAETQRIITLLKRAGLPVNGPREMSAQAYLPHMLRDKKVLAGEMRLILPLAIGKSEVRSGVSHELVLNAIADCQSA

SEQ ID NO: 23580 - protein, 240 aa, Escherichia coli
MVARQRACSDQICRGMGDLFSCQTRWSIEIIFSLTLAISYEVSVHVLRRSLSEAGLSLTNSLSSTEKMAEKRNIFLVGPMGAGKSTIGRQLAQQLNMEFYDSDQEIEKRTGADVGWVFDLEGEEGFRDREEKVINELTEKQGIVLATGGGSVKSRETRNRLSARGVVVYLETTIEKQLARTQRDKKRPLLHVETPPREVLEALANERNPLYEEIADVTIRTDDQSAKVVANQIIHMLESN

SEQ ID NO: 23581 - protein, 540 aa, Escherichia coli
MRVNNGLTPQELEAYGISDVHDIVYNPSYDLLYQEELDPSLTGYERGVLTNLGAVAVDTGIFTGRSPKDKYIVRDDTTRDTFWWADKGKGKNDNKPLSPETWQHLKGLVTRQLSGKRLFVVDAFCGANPDTRLSVRFITEVAWQAHFVKNMFIRPSDEELAGFKPDFIVMNGAKCTNPQWKEQGLNSENFVAFNLTERMQLIGGTWYGGEMKKGMFSMMNYLLPLKGIASMHCSANVGEKGDVAVFFGLSGTGKTTLSTDPKRRLIGDDEHGWDDDGVFNFEGGCYAKTIKLSKEAEPEIYNAIRRDALLENVTVREDGTIDFDDGSKTENTRVSYPIYHIDNIVKPVSKAGHATKVIFLTADAFGVLPPVSRLTADQTQYHFLSGFTAKLAGTERGITEPTPTFSACFGAAFLSLHPTQYAEVLVKRMQAAGAQAYLVNTGWNGTGKRISIKDTRAIIDAILNGSLDNAETFTLPMFNLAIPTELPGVDTKILDPRNTYASPEQWQEKAETLAKLFIDNFDKYTDTPAGAALVAAGPKL

SEQ ID NO: 23582 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRQQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKGKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 23583 - protein, 501 aa, Escherichia coli
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLNVYNTHFKKQLSRDDIVWTYSGVRPLCDDESDSPQAITRDYTLDIHDENGKAPLLSVFGGKLTTYRKLAEHALEKLTPYYQGIGPAWTKESVLPGGAIEGDRDDYAARLRRRYPFLTESLARHYARTYGSNSELLLGNAGTVSDLGEDFGHEFYEAELKYLVDHEWVRRADDALWRRTKQGMWLNADQQSRVSQWLVEYTQQRLSLAS

SEQ ID NO: 23584 - protein, 815 aa, Escherichia coli
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 23585 - protein, 477 aa, Escherichia coli [sequence omitted]

SEQ ID NO: 23586 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 23587 - protein, 657 aa, Escherichia coli
MTQLAIGKPAPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGSLDLVERRRDSIHALLTTLLLSQGTPMLLAGDEHGHSQHGNNNAYCQDNQLTWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 23588 - protein, 728 aa, Escherichia coli
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPVYRQYHHDKLTFGILYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNLTYRHHKAMHELDFDPYGFEWLVVDDKERSVLIFVRRDKEGNEIIVASNFTPVPRHDYRFGINQPGKWREILNTDSMHYHGSNAGNGGTVHSDEIASHGRQHSLSLTLPPLATIWLVREAE

SEQ ID NO: 23589 - protein, 367 aa, Escherichia coli
MKNVGFIGWRGMVGSVLMQRMVEERDFDAIRPVFFSTSQLGQAAPSFGGTTGTLQDAFDLEALKALDIIVTCQGGDYTNEIYPKLRESGWQGYWIDAASSLRMKDDAIIILDPVNQDVITDGLNNGIRTFVGGNCTVSLMLMSLGGLFANDLVDWVSVATYQAASGGGARHMRELLTQMGHLYGHVADELATPSSAILDIERKVTTLTRSGELPVDNFGVPLAGSLIPWIDKQLDNGQSREEWKGQAETNKILNTSSVIPVDGLCVRVGALRCHSQAFTIKLKKDVSIPTVEELLAAHNPWAKVVPNDREITMRELTPAAVTGTLTTPVGRLRKLNMGPEFLSAFTVGDQLLWGAAEPLRRMLRQLA

SEQ ID NO: 23590 - protein, 162 aa, Escherichia coli
MGVSGSGKSAVASEVAHQLHAAFLDGDFLHPRRNIEKMASGEPLNDDDRKPWLQALNDAAFAMQRTNKVSLIVCSALKKHYRDLLREGNPNLSFIYLKGDFDVIESRLKARKGHFFKTQMLVTQFETLQEPGADETDVLVVDIDQPLEGVVASTIEVIKKGK

SEQ ID NO: 23591 - protein, 732 aa, Escherichia coli
MSTPDNHGKKAPQFAAFKPLTTVQNANDCCCDGACSSTPTLSENVSGTRYSWKVSGMDCAACARKVENAVRQLAGVNQVQVLFATEKLVVDADNDIRAQVESALQKAGYSLRDEQAAEEPQASRLKENLPLITLIVMMAISWGLEQFNHPFGQLAFIATTLVGLYPIARQALRLIKSGSYFAIETLMSVAAIGALFIGATAEAAMVLLLFLIGERLEGWAASRARQGVSALMALKPETATRLRKGEREEVAINSLRPGDVIEVAAGGRLPADGKLLSPFASFDESALTGESIPVERATGDKVPAGATSVDRLVTLEVLSEPGASAIDRILKLIEEAEERRAPIERFIDRFSRIYTPAIMAVALLVTLVPPLLFAASWQEWIYKGLTLLLIGCPCALVISTPAAITSGLAAAARRGALIKGGAALEQLGRVTQVAFDKTGTLTVGKPRVTAIHPATGISESELLTLAAAVEQGATHPLAQAIVREAQVAELAIPTAESQRALVGSGIEAQVNGERVLICAAGKHPADAFTGLINELESAGQTVVLVVRNDDVLGVIALQDTLRADAATAISELNALGVKGVILTGDNPRAAAAIAGELGLEFKAGLLPEDKVKAVTELNQHAPLAMVGDGINDAPAMKAAAIGIAMGSGTDVALETADAALTHNHLRGLVQMIELARATHANIRQNITIALGLKGIFLVTTLLGMTGLWLAVLADTGATVLVTANALRLLRRR

SEQ ID NO: 23592 - protein, 894 aa, Escherichia coli
MSQHYGKTVALNNITLDIPARCMVGLIGPDGVGKSSLLSLISGARVIEQGNVMVLGGDMRDPKHRRDVCPRIAWMPQGLGKNLYHTLSVYENVDFFARLFGHDKAEREVRINELLTSTGLAPFRDRPAGKLSGGMKQKLGLCCALIHDPELLILDEPTTGVDPLSRSQFWDLIDSIRQRQSNMSVLVATAYMEEAERFDWLVAMNAGEVLATGSAEELRQQTQSATLEEAFINLLPQAQRQAHQAVVIPPYQPENAEIAIEARDLTMRFGSFVAVDHVNFRIPRGEIFGFLGSNGCGKSTTMKMLTGLLPASEGEAWLFGQPVDPKDIDTRRRVGYMSQAFSLYNELTVRQNLELHARLFHIPEAEIPARVAEMSERFKLNDVEDILPESLPLGIRQRLSLAVAVIHRPEMLILDEPTSGVDPVARDMFWQLMVDLSRQDKVTIFISTHFMNEAERCDRISLMHAGKVLASGTPQELVEKRGAASLEEAFIAYLQEAAGQSNEAEAPPVVHDTTHAPRQGFSLRRLFSYSRREALELRRDPVRSTLALMGTVILMLIMGYGISMDVENLRFAVLDRDQTVSSQAWTLNLSGSRYFIEQPPLTSYDELDRRMRAGDITVAIEIPPNFGRDIARGTPVELGVWIDGAMPSRAETVKGYVQAMHQSWLQDVASRQSTPASQSGLMNIETRYRYNPDVKSLPAIVPAVIPLLLMMIPSMLSALSVVREKELGSIINLYVTPTTRSEFLLGKQLPYIALGMLNFFLLCGLSVFVFGVPHKGSFLTLTLAALLYIIIATGMGLLISTFMKSQIAAIFGTAIITLIPATQFSGMIDPVASLEGPGRWIGEVYPTSHFLTIARGTFSKALDLTDLWQLFIPLLIAIPLVMGLSILLLKKQEG

SEQ ID NO: 23593 - protein, 680 aa, Escherichia coli
MTNPLLTPFELPPFSKILPEHVVPAVTKALNDCRENVERVVAQGAPYTWENLCQPLAEVDDVLGRIFSPVSHLNSVKNSPELREAYEQTLPLLSEYSTWVGQHEGLYKAYRDLRDGDHYATLNTAQKKAVDNALRDFELSGIGLPKEKQQRYGEIATRLSELGNQYSNNVLDATMGWTKLVTDEAELAGMPESALAAAKAQAEAKELEGYLLTLDIPSYLPVMTYCDNQALREEMYRAYSTRASDQGPNAGKWDNSKVMEEILALRHELAQLLGFENYAFKSLATKMAENPQQVLDFLTDLAKRARPQGEKELAQLRAFAKAEFGVDELQPWDIAYYSEKQKQHLYSISDEQLRPYFPENKAVNGLFEVVKRIYGITAKERKDVDVWHPDVRFFELYDENNELRGSFYLDLYARENKRGGAWMDDCVGQMRKADGSLQKPVAYLTCNFNRPVNGKPALFTHDEVITLFHEFGHGLHHMLTRIETAGVSGISGVPWDAVELPSQFMENWCWEPEALAFISGHYETGEPLPKELLDKMLAAKNYQAALFILRQLEFGLFDFRLHAEFRPDQGAKILETLAEIKKLVAVVPSPSWGRFPHAFSHIFAGGYAAGYYSYLWADVLAADAFSRFEEEGIFNRETGQSFLDNILSRGGSEEPMDLFKRFRGREPQLDAMLEHYGIKG

SEQ ID NO: 23594 - protein, 549 aa, Escherichia coli
MLNQKIQNPNPDELMIEVDLCYELDPYELKLDEMIEAEPEPEMIEGLPASDALTPADRYLELFEHVQSAKIFPDSKTFPDCAPKMDPLDILIRYRKVRRHRDFDLRKFVENHFWLPEVYSSEYVSDPQNSLKEHIDQLWPVLTREPQDHIPWSSLLALPQSYIVPGGRFSETYYWDSYFTMLGLAESGREDLLKCMADNFAWMIENYGHIPNGNRTYYLSRSQPPVFALMVELFEEDGVRGARRYLDHLKMEYAFWMDGAESLIPNQAYRHVVRMPDGSLLNRYWDDRDTPRDESWLEDVETAKHSGRPPNEVYRDLRAGAASGWDYSSRWLRDTGRLASIRTTQFIPIDLNAFLFKLESAIANISALKGEKETEALFRQKASARRDAVNRYLWDDENGIYRDYDWRREQLALFSAAAIVPLYVGMANHEQADRLANAVRSRLLTPGGILASEYETGEQWDKPNGWAPLQWMAIQGFKMYGDDLLGDEIARSWLKTVNQFYLEQHKLIEKYHIADGVPREGGGGEYPLQDGFGWTNGVVRRLIGLYGEP

SEQ ID NO: 23595 - protein, 428 aa, Escherichia coli
MKTSLFKSLYFQVLTAIAIGILLGHFYPEIGEQMKPLGDGFVKLIKMIIAPVIFCTVVTGIAGMESMKAVGRTGAVALLYFEIVSTIALIIGLIIVNVVQPGAGMNVDPATLDAKAVAVYADQAKDQGIVAFIMDVIPASVIGAFASGNILQVLLFAVLFGFALHRLGSKGQLIFNVIESFSQVIFGIINMIMRLAPIGAFGAMAFTIGKYGVGTLVQLGQLIICFYITCILFVVLVLGSIAKATGFSIFKFIRYIREELLIVLGTSSSESALPRMLDKMEKLGCRKSVVGLVIPTGYSFNLDGTSIYLTMAAVFIAQATNSQMDIVHQITLLIVLLLSSKGAAGVTGSGFIVLAATLSAVGHLPVAGLALILGIDRFMSEARALTNLVGNGVATIVVAKWVKELDHKKLDDVLNNRAPDGKTHELSS

SEQ ID NO: 23596 - protein, 368 aa, Escherichia coli
MNVLRSGIVTMLLLAAFSVQAACTWPAWEQFKKDYISQEGRVIDPSDARKITTSEGQSYGMFSALAANDRAAFDNILDWTQNNLAQGSLKERLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 23597 - protein, 739 aa, Escherichia coli
MENSLQSAVRDQVHSNTRVRFPMVRKGFLASPENPQGIRGQDEFVRVSWDEALDLIHQQHKRIREAYGPASIFAGSYGWRSNGVLHKASTLLQRYMALAGGYTGHLGDYSTGAAQAIMPYVVGGSEVYQQQTSWPLVLEHSDVVVLWSANPLNTLKIAWNASDEQGLSYFSALRDSGKKLICIDPMRSETVDFFGDKMEWVAPHMGTDVALMLGIAHTLVENGWHDEAFLARCTTGYAVFASYLLGESDGIAKTAEWAAEICGVGAAKIRELAAIFHQNTTMLMAGWGMQRQQFGEQKHWMIVTLAAMLGQIGTPGGGFGLSYHFANGGNPTRRSAVLSSMQGSLPGGCDAVDKIPVARIVEALENPGGAYQHNGMNRHFPDIRFIWWAGGANFTHHQDTNRLIRAWQKPELVVISECFWTAAAKHADIVLPATTSFERNDLTMTGDYSNQHLVPMKQVVPPRYEARNDFDVFAELSERWEKGGYARFTEGKSELQWLETFYNVARQRGASQQVELPPFAEFWQANQLIEMPENPDSERFIRFADFCRDPLAHPLKTASGKIEIFSQRIADYGYPDCPGHPMWLEPDEWQGNAEPEQLQVLSAHPAHRLHSQLNYSSLRELYAVANREPVTIHPDDAQERGIQDGDTVRLWNARGQILAGAVISEGIKPGVICIHEGAWPDLDLTADGICKNGAVNVLTKDLPSSRLGNGCAGNTALAWLEKYNGPELTLTAFEPPASS

SEQ ID NO: 23598 - protein, 484 aa, Escherichia coli
MYIGIDLGTSGVKVILLNEQGEVVAAQTEKLTVSRPHPLWSEQDPEQWWQATDRAMKALGDQHSLQDVKALGIAGQMHGATLLDAQQRVLRPAILWNDGRCAQECTLLEARVPQSRVITGNLMMPGFTAPKLLWVQRHEPEIFRQIDKVLLPKDYLRLRMTGEFASDMSDAAGTMWLDVAKRDWSDVMLQACDLSRDQMPALYEGSEITGALLPEVAKAWGMATVPVVAGGGDNAAGAVGVGMVDANQAMLSLGTSGVYFAVSEGFLSKPESAVHSFCHALPQRWHLMSVMLSAASCLDWAAKLTGLSNVPALIAAAQQADESAEPVWFLPYLSGERTPHNNPQAKGVFFGLTHQHGPNELARAVLEGVGYALADGMDVVHACGIKPQSVTLIGGGARSEYWRQMLADISGQQLDYRTGGDVGPALGAARLAQIAANPEKSLIELLPQLPLEQSHLPDAQRYAAYQPRRETFRRLYQQLLPLMA

SEQ ID NO: 23599 - protein, 676 aa, Escherichia coli
MKLAACFLTLLPGFAVAASWTSPGFPAFSEQGTGTFVSHAQLPKGTRPLTLNFDQQCWQPADAIKLNQMLSLQPCSNTPPQWRLFRDGEYTLQIDTRSGTPTLMISIQNAAEPVASLVRECPKWDGLPLTVDVSATFPEGAAVRDYYSQQIAIVKNGQIMLQPAATSNGLLLLERAETDTSAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTGYATLADMQEYQFGALYLSGDEVKKSLGERWSDWKPAAGQTWHSFNDYINFSDKTGWDKWWGKNWIRTDIGDYDNPGFDDLTMSLAFLPDIKTESTTASGLPVFYKNKMDTHAKAIDGYTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCLAQMDTTWQQMAEKLQGFNVLSYLSSHDTRLFREGGDKAAELLLLAPGAVQIFYGDESSRPFGPTGSDPLQGTRSDMNWQDVSGKSAASVAHWQKISQFRARHPAIGAGKQTTLLLKQGYGFVREHGDDKVLVVWAGQQ

SEQ ID NO: 23600 - protein, 332 aa, Escherichia coli
MKVTFEQLKAAFNRVLISRGVDSETADACAEMFARTTESGVYSHGVNRFPRFIQQLENGDIIPDAQPKRITSLGAIEQWDAQRSIGNLTAKKMMDRAIELAADHGIGLVALRNANHWMRGGSYGWQAAEKGYIGICWTNSIAVMPPWGAKECRIGTNPLIVAIPSTPITMVDMSMSMFSYGMLEVNRLAGRQLPVDGGFDDEGNLTKEPGVIEKNRRILPMGYWKGSGMSIVLDMIATLLSDGASVAEVTQDNSDEYGISQIFIAIEVDKLIDGPTRDAKLQRIMDYVTSAERADENQAIRLPGHEFTTLLAENRRNGITVDDSVWAKIQAL

SEQ ID NO: 23601 - protein, 498 aa, Escherichia coli
MTQYWLGLDCGGSWLKAGLYDREGREAGVQRLPLCALSPQPGWAERDMAELWQCCMAVIRALLTHSGVSGEQIVGIGISAQGKGLFLLDKNDKPLGNAILSSDRRAMEIVRRWQEDGIPEKLYPLTRQTLWTGHPVSLLRWLKEHEPERYAQIGCVMMTHDYLRWCLTGVKGCEESNISESNLYNMSLGEYDPCLTDWLGIAEINHALPPVVGSAEICGEITAQTAALTGLKAGTPVVGGLFDVVSTALCAGIEDEFTLNAVMGTWAVTSGITRGLRDGEAHPYVYGRYVNDGEFIVHEASPTSSGNLEWFTAQWGEISFDEINQAVASLPKAGGDLFFLPFLYGSNAGLEMTSGFYGMQAIHTRAHLLQAIYEGVVFSHMTHLNRMRERFTDVHTLRVTGGPAHSDVWMQMLADVSGLRIELPQVEETGCFGAALAARVGTGVYHNFSEAQRDLRHPVRTLLPDMTAHQLYQKKYQRYQHLIAALQGFHARIKEHTL

SEQ ID NO: 23602 - protein, 542 aa, Escherichia coli
MIAVVKLLPTGEDFASHVYPCYTSHRKETIMTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 23603 - protein, 382 aa, Escherichia coli
MAASTFFIPSVNVIGADSLTDAMNMMADYGFTRTLIVTDNMLTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHIKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVDIPAGLRDLNVKEEDFAVLATNALKDACGFTNPIQATHEEIVAIYAAR

SEQ ID NO: 23604 - protein, 339 aa, Escherichia coli
MNQRNASMTVIGAGSYGTALAITLARNGHEVVLWGHDPEHIATLERDRCNAAFLPDVPFPDTLHLESDLATALAASRNILVVVPSHVFGEVLRQIKPLMRPDARLVWATKGLEAETGRLLQDVAREALGDQIPLAVISGPTFAKELAAGLPTAISLASTDQTFADDLQQLLHCGKSFRVYSNPDFIGVQLGGAVKNVIAIGAGMSDGIGFGANARTALITRGLAEMSRLGAALGADPATFMGMAGLGDLVLTCTDNQSRNRRFGMMLGQGMDVQSAQEKIGQVVEGYRNTKEVRELAHRFGVEMPITEEIYQVLYCGKNAREAALTLLGRARKDERSSH

SEQ ID NO: 23605 - protein, 514 aa, Escherichia coli
MLVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 23606 - protein, 341 aa, Escherichia coli
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 23607 - protein, 398 aa, Escherichia coli
MRGEFYQQLTNDLETARAEGLFKEERIITSAQQADITVADGSHVINFCANNYLGLANHPDLIAAAKAGMDSHGFGMASVRFICGTQDSHKELEQKLAAFLGMEDAILYSSCFDANGGLFETLLGAEDAIISDALNHASIIDGVRLCKAKRYRYANNDMQELEARLKEAREAGARHVLIATDGVFSMDGVIANLKGVCDLADKYDALVMVDDSHAVGFVGENGRGSHEYCDVMGRVDIITGTLGKALGGASGGYTAARKEVVEWLRQRSRPYLFSNSLAPAIVAASIKVLEMVEAGSELRDRLWANARQFREQMSAAGFTLAGADHAIIPVMLGDAVVAQKFARELQKEGIYVTGFFYPVVPKGQARIRTQMSAAHTPEQITRAVEAFTRIGKQLGVIA

SEQ ID NO: 23608 - protein, 772 aa, Escherichia coli
MKISDGNWLIQPGLNLIHPLQVFEVEQQDNEMVVYAAPRDVRERTWQLDTPLFTLRFFSPQEGIVGVRIEHFQGALNNGPHYPLNILQDVKVTIENTERYAEFKSGNLSARVSKGEFWSLDFLRNGERITGSQVKNNGYVQDTNNQRNYMFERLDLGVGETVYGLGERFTALVRNGQTVETWNRDGGTSTEQAYKNIPFYMTNRGYGVLVNHPQCVSFEVGSEKVSKVQFSVESEYLEYFVIDGPTPKAVLDRYTRFTGRPALPPAWSFGLWLTTSFTTNYDEATVNSFIDGMAERNLPLHVFHFDCFWMKAFQWCDFEWDPLTFPDPEGMIRRLKAKGLKICVWINPYIGQKSPVFKELQEKGYLLKRPDGSLWQWDKWQPGLAIYDFTNPDACKWYADKLKGLVAMGVDCFKTDFGERIPTDVQWFDGSDPQKMHNHYAYIYNELVWNVLKDTVGEEEAVLFARSASVGAQKFPVHWGGDCYANYESMAESLRGGLSIGLSGFGFWSHDIGGFENTAPAHVYKRWCAFGLLSSHSRLHGSKSYRVPWAYDDESCDVVRFFTQLKCRMMPYLYREAARANARGTPMMRAMMMEFPDDPACDYLDRQYMLGDNVMVAPVFTEAGDVQFYLPEGRWTHLWHNDELDGSRWHKQQHGFLSLPVYVRDNTLLALGNNDQRPDYVWHEGTAFHLFNLQDGHEAVCEVPAADGSVIFTLKAARTGNTITVTGAGEAKNWTLCLRNVVKVNGLQDGSQAESEQGLVVKPQGNALTITL

SEQ ID NO: 23609 - protein, 361 aa, Escherichia coli
MMNVSEKMEHFDVAIIGLGPAGSALARKLAGKMQVIALDKKHQCGTEGFSKPCGGLLAPDAQRSFIRDGLTLPVDVIANPQIFSVKTVDVAASLTRNYQRSYININRHAFDLWMKSLIPASVEVYHDSLCRKIWREDDKWHVIFRADGWEQHITARYLVGADGANSMVRRHLYPDHQIRKYVAIQQWFAEKHPVPFYSCIFDNSITNCYSWSISKDGYFIFGGAYPMKDGQTRFTTLKEKMSAFQFQFGKTVKSEKCTVLFPSRWQDFVCGKDNAFLIGEAAGFISASSLEGISYALDSTDILRSVLLKQPEKLNTAYWRATRKLRLKLFGKIVKSRCLTAPALRKWIMRSGVAHIPQLKD

SEQ ID NO: 23610 - protein, 221 aa, Escherichia coli
MSRIEAVFFDCDGTLVDSEVICSRAYVTMFQEFGITLDPEEVFKRFKGVKLYEIIDIVSLEHGVTLAKTEAEHVYRAEVARLFDSELEAIEGAGALLSAITAPMCVVSNGPNNKMQHSMGKLNMLHYFPDKLFSGYDIQRWKPDPALMFHAAKAMNVNVENCILVDDSVAGAQSGIDAGMEVFYFCADPHNKPIVHPKVTTFTHLSQLPELWKARGWDITA

SEQ ID NO: 23611 - protein, 609 aa, Escherichia coli
MCGIVGAIAQRDVAEILLEGLRRLEYRGYDSAGLAVVDAEGHMTRLRRLGKVQMLAQAAEEHPLHGGTGIAHTRWATHGEPSEVNAHPHVSEHIVVVHNGIIENHEPLREELKARGYTFVSETDTEVIAHLVNWELKQGGTLREAVLRAIPQLRGAYGTVIMDSRHPDTLLAARSGSPLVIGLGMGENFIASDQLALLPVTRRFIFLEEGDIAEITRRSVNIFDKTGAEVKRQDIESNLQYDAGDKGIYRHYMQKEIYEQPNAIKNTLTGRISHGQVDLSELGPNADELLSKVEHIQILACGTSYNSGMVSRYWFESLAGIPCDVEIASEFRYRKSAVRRNSLMITLSQSGETADTLAGLRLSKELGYLGSLAICNVPGSSLVRESDLALMTNAGTEIGVASTKAFTTQLTVLLMLVAKLSRLKGLDASIEHDIVHGLQALPSRIEQMLSQDKRIEALAEDFSDKHHALFLGRGDQYPIALEGALKLKEISYIHAEAYAAGELKHGPLALIDADMPVIVVAPNNELLEKLKSNIEEVRARGGQLYVFADQDAGFVSSDNMHIIEMPHVEEVIAPIFYTVPLQLLAYHVALIKGTDVDQPRNLAKSVTVE

SEQ ID NO: 23612 - protein, 460 aa, Escherichia coli
MATGKIVQVIGAVVDVEFPQDAVPRVYDALEVQNGNERLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 23613 - protein, 287 aa, Escherichia coli
MAGAKEIRSKIASVQNTQKITKAMEMVAASKMRKSQDRMAASRPYAETMRKVIGHLAHGNLEYKHPYLEDRDVKRVGYLVVSTDRGLCGGLNINLFKKLLAEMKTWTDKGVQCDLAMIGSKGVSFFNSVGGNVVAQVTGMGDNPSLSELIGPVKVMLQAYDEGRLDKLYIVSNKFINTMSQVPTISQLLPLPASDDDDLKHKSWDYLYEPDPKALLDTLLRRYVESQVYQGVVENLASEQAARMVAMKAATDNGGSLIKELQLVYNKARQASITQELTEIVSGAAAV

SEQ ID NO: 23614 - protein, 513 aa, Escherichia coli
MQLNSTEISELIKQRIAQFNVVSEAHNEGTIVSVSDGVIRIHGLADCMQGEMISLPGNRYAIALNLERDSVGAVVMGPYADLAEGMKVKCTGRILEVPVGRGLLGRVVNTLGAPIDGKGPLDHDGFSAVEAIAPGVIERQSVDQPVQTGYKAVDSMIPIGRGQRELIIGDRQTGKTALAIDAIINQRDSGIKCIYVAIGQKASTISNVVRKLEEHGALANTIVVVATASESAALQYLAPYAGCAMGEYFRDRGEDALIIYDDLSKQAVAYRQISLLLRRPPGREAFPGDVFYLHSRLLERAARVNAEYVEAFTKGEVKGKTGSLTALPIIETQAGDVSAFVPTNVISITDGQIFLETNLFNAGIRPAVNPGISVSRVGGAAQTKIMKKLSGGIRTALAQYRELAAFSQFASDLDDATRKQLDHGQKVTELLKQKQYAPMSVAQQSLVLFAAERGYLADVELSKIGSFEAALLAYVDRDHAPLMQEINQTGGYNDEIEGKLKGILDSFKATQSW

SEQ ID NO: 23615 - protein, 177 aa, Escherichia coli
MSEFITVARPYAKAAFDFAVEHQSVERWQDMLAFAAEVTKNEQMAELLSGALAPETLAESFIAVCGEQLDENGQNLIRVMAENGRLNALPDVLEQFIHLRAVSEATAEVDVISAAALSEQQLAKISAAMEKRLSRKVKLNCKIDKSVMAGVIIRAGDMVIDGSVRGRLERLADVLQS

SEQ ID NO: 23616 - protein, 309 aa, Escherichia coli
MQNAGSLVVLGSINADHILNLQSFPTPGETVTGNHYQVAFGGKGANQAVAAGRSGANIAFIACTGDDSIGESVRQQLATDNIDITPVSVIKGESTGVALIFVNGEGENVIGIHAGANAALSPALVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 23617 - protein, 673 aa, Escherichia coli
MRLNPGQQQAVEFVTGPCLVLAGAGSGKTRVITNKIAHLIRGCGYQARHIAAVTFTNKAAREMKERVGQTLGRKEARGLMISTFHTLGLDIIKREYAALGMKANFSLFDDTDQLALLKELTEGLIEDDKVLLQQLISTISNWKNDLKTPSQAAASAIGERDRIFAHCYGLYDAHLKACNVLDFDDLILLPTLLLQANEEVRKRWQNKIRYLLVDEYQDTNTSQYELVKLLVGSRARFTVVGDDDQSIYSWRGARPQNLVLLSQDFPALKVIKLEQNYRSSGRILKAANILIANNPHVFEKRLFSELGYGAELKVLSANNEEHEAERVTGELIAHHFVNKTQYKDYAILYRGNHQSRVFEKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYESWLYETSPSPKAAEMRMKNVNQLFSWMTEMLEGSELDEPMTLTQVVTRFTLRDMMERGESEEELDQVQLMTLHASKGLEFPYVYMVGMEEGFLPHQSSIDEDNIDEERRLAYVGITRAQKELTFTLCKERRQYGELVRPEPSRFLLELPQDDLIWEQERKVVSAEERMQKGQSHLANLKAMMAAKRGK

SEQ ID NO: 23618 - protein, 421 aa, Escherichia coli
MSKTHLTEQKFSDFALHPKVVEALEKKGFHNCTPIQALALPLTLAGRDVAGQAQTGTGKTMAFLTSTFHYLLSHPAIADRKVNQPRALIMAPTRELAVQIHADAEPLAEATGLKLGLAYGGDGYDKQLKVLESGVDILIGTTGRLIDYAKQNHINLGAIQVVVLDEADRMYDLGFIKDIRWLFRRMPPANQRLNMLFSATLSYRVRELAFEQMNNAEYIEVEPEQKTGHRIKEELFYPSNEEKMRLLQTLIEEEWPDRAIIFANTKHRCEEIWGHLAADGHRVGLLTGDVAQKKRLRILDEFTRGDLDILVATDVAARGLHIPAVTHVFNYDLPDDCEDYVHRIGRTGRAGASGHSISLACEEYALNLPAIETYIGHSIPVSKYNPDALMTDLPKPLRLTRPRTGNGPRRTGAPRNRRRSG

SEQ ID NO: 23619 - protein, 420 aa, Escherichia coli
MSFATISVIGLGYIGLPTAAAFASRQKQVIGVDINQHAVDTINRGEIHIVEPDLASVVKTAVEGGFLRASTTPVEADRWLIAVPTPFKGDHEPDMTYVESAARSIAPVLKKGALVILESTSPVGSTEKMAEWLAEMRPDLTFPQQVGEQADVNIAYCPERVLPGQVMVELIKNDRVIGGMTPVCSARASELYKIFLEGECVVTNSRTAEMCKLTENSFRDVNIAFANELSLICADQGINVWELIRLANRHPRVNILQPGPGVGGHCIAVDPWFIVAQNPQQARLIRTAREVNDHKPFWVIDQVKAAVADCLAATDKRASELKIACFGLAFKPNIDDLRESPAMEIAELIAQWHSGETLVVEPNIHQLPKKLTGLCTLAQLDEALATADVLVMLVDHSQFKVINGDNVHQQYVVDAKGVWR

SEQ ID NO: 23620 - protein, 293 aa, Escherichia coli
MKGIILAGGSGTRLHPITRGVSKQLLPIYDKPMIYYPLSVLMLAGIREILIITTPEDKGYFQRLLGDGSEFGIQLEYAEQPSPDGLAQAFIIGETFLNGEPSCLVLGDNIFFGQGFSPKLRHVAARTEGATVFGYQVMDPERFGVVEFDDNFRAISLEEKPKQPKSNWAVTGLYFYDSKVVEYAKQVKPSERGELEITSINQMYLEAGNLTVELLGRGFAWLDTGTHDSLIEASTFVQTVEKRQGFKIACLEEIAWRNGWLDDEGVKRAASSLAKTGYGQYLLELLRARPRQY

SEQ ID NO: 23621 - protein, 461 aa, Escherichia coli
MADNKPELQRGLEARHIELIALGGTIGVGLFMGAASTLKWAGPSVLLAYIIAGLFVFFIMRSMGEMLSLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 23622 - protein, 246 aa, Escherichia coli
MSILVTRPSPAGEELVSRLRTLGQVAWHFPLIEFSPGQQLPQLADQLAALGESDLLFALSQHAVAFAQSQLHQQDRKWPRLPDYFAIGRTTALALHTVSGQKILYPQDREISEVLLQLPELQNIAGKRALILRGNGGRELIGDTLTARGAEVTFCECYQRCAIHYDGAEEAMRWQAREVTMVVVTSGEMLQQLWSLIPQWYREHWLLHCRLLVVSERLAKLARELGWQDIKVADNADNDALLRALQ

SEQ ID NO: 23623 - protein, 320 aa, Escherichia coli
MIMTVTSMLDNVLRIATRQSPLALWQAHYVKDKLMASHPGLVVELVPMVTRGDVILDTPLAKVGGKGLFVKELEVALLENRADIAVHSMKDVPVEFPQGLGLVTICEREDPRDAFVSNNYDSLDALPAGSIVGTSSLRRQCQLAERRPDLIIRSLRGNVGTRLSKLDNGEYDAIILAVAGLKRLGLESRIRAGLPPEISLPAVGQGAVGIECRLDDSRTRELLAALNHHETALRVTAERAMNTRLEGGCQVPIGSYAELIDGEIWLRALVGRPDGSQIIRGERRGAPQDAEQMGISLAEELLNNGAREILAEVYNGDAPA

SEQ ID NO: 23624 - protein, 275 aa, Escherichia coli
MMQFSKMHGLGNDFMVVDAVTQNVFFSPELIRRLADRHLGVGFDQLLVVEPPYDPELDFHYRIFNADGSEVAQCGNGARCFARFVRLKGLTNKRDIRVSTANGRMVLTVTDDDLVRVNMGEPNFEPSAVPFRANKAEKTYIMRAAEQTILCGVVSMGNPHCVIQVDDVDTAAVETLGPVLESHERFPERANIGFMQVVKREHIRLRVYERGAGETQACGSGACAAVAVGIQQGLLAEEVRVELPGGRLDIAWKGPGHPLYMTGPAVHVYDGFIHL

SEQ ID NO: 23625 - protein, 720 aa, Escherichia coli
MDVSYLLDSLNDKQREAVAAPRSNLLVLAGAGSGKTRVLVHRIAWLMSVENCSPYSIMAVTFTNKAAAEMRHRIGQLMGTSQGGMWVGTFHGLAHRLLRAHHMDANLPQDFQILDSEDQLRLLKRLIKAMNLDEKQWPPRQAMWYINSQKDEGLRPHHIQSYGNPVEQTWQKVYQAYQEACDRAGLVDFAELLLRAHELWLNKPHILQHYRERFTNILVDEFQDTNNIQYAWIRLLAGDTGKVMIVGDDDQSIYGWRGAQVENIQRFLNDFPGAETIRLEQNYRSTSNILSAANALIENNNGRLGKKLWTDGADGEPISLYCAFNELDEARFVVNRIKTWQDNGGALAECAILYRSNAQSRVLEEALLQASMPYRIYGGMRFFERQEIKDALSYLRLIANRNDDAAFERVVNTPTRGIGDRTLDVVRQTSRDRQLTLWQACRELLQEKALAGRAASALQRFMELIDALAQETADMPLHVQTDRVIKDSGLRTMYEQEKGEKGQTRIENLEELVTATRQFSYNEEDEDLMPLQAFLSHAALEAGEGQADTWQDAVQLMTLHSAKGLEFPQVFIVGMEEGMFPSQMSLDEGGRLEEERRLAYVGVTRAMQKLTLTYAETRRLYGKEVYHRPSRFIGELPEECVEEVRLRATVSRPVSHQRMGTPMVENDSGYKLGQRVRHAKFGEGTIVNMEGSGEHSRLQVAFQGQGIKWLVAAYARLESV

SEQ ID NO: 23626 - protein, 289 aa, Escherichia coli
MRTLQGWLLPVFMLPMAVYAQEATVKEVHDAPAVRGSIIANMLQEHDNPFTLYPYDTNYLIYTQTSDLNKEAIASYDWAENARKDEVKFQLSLAFPLWRGILGPNSVLGASYTQKSWWQLSNSEESSPFRETNYEPQLFLGFATDYRFAGWTLRDVEMGYNHDSNGRSDPTSRSWNRLYTRLMAENGNWLVEVKPWYVVGNTDDNPDITKYMGYYQLKIGYHLGDAVLSAKGQYNWNTGYGGAELGLSYPITKHVRLYTQVYSGYGESLIDYNFNQTRVGVGVMLNDLF

SEQ ID NO: 23627 - protein, 340 aa, Escherichia coli
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLADPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATPTLLLQAEEERVVDNRMHDRFCELRTAAGHPVEGGRPLVIKGAYHEILFEKDAMASVALHAIVDFFNRHNSPSGNRSTEV

SEQ ID NO: 23628 - protein, 753 aa, Escherichia coli
MTILNHTLGFPRVGLRRELKKAQESYWAGNSTREELLAVGRELRARHWDQQKQAGIDLLPVGDFAWYDHVLTTSLLLGNVPARHQNKDGSVDIDTLFRIGRGRAPTGEPAAAAEMTKWFNTNYHYMVPEFVKGQQFKLTWTQLLDEVDEALALGHKVKPVLLGPVTWLWLGKVKGEQFDRLSLLNDILPVYQQVLAELAKRGIEWVQIDEPALVLELPQAWLDAYKPAYDALQGQVKLLLTTYFEGVTPNLDTITALPVQGLHVDLVHGKDDVAELHKRLPSDWLLSAGLINGRNVWRADLTEKYAQIKDIVGKRDLWVASSCSLLHSPIDLSVETRLDAEVKSWFAFALQKCHELALLRDALNSGDTAALAEWSAPIQARRHSTRVHNPAVEKRLAAITAQDSQRANVYEVRAEAQRARFKLPAWPTTTIGSFPQTTEIRTLRLDFKKGNLDANNYRTGIAEHIKQAIVEQERLGLDVLVHGEAERNDMVEYFGEHLDGFVFTQNGWVQSYGSRCVKPPIVIGDISRPAPITVEWAKYAQSLTDKPVKGMLTGPVTILCWSFPREDVSRETIAKQIALALRDEVADLEAAGIGIIQIDEPALREGLPLRRSDWDAYLQWGVEAFRINAAVAKDDTQIHTHMCYCEFNDIMDSIAALDADVITIETSRSDMELLESFEEFDYPNEIGPGVYDIHSPNVPSVEWIEALLKKAAKRIPAERLWVNPDCGLKTRGWPETRAALANMVQAAQNLRRG

SEQ ID NO: 23629 - protein, 546 aa, Escherichia coli
MTPGEVRRLYFIIRTFLSYGLDELIPKMRITLPLRLWRYSLFWMPNRHKDKLLGERLRLALQELGPVWIKFGQMLSTRRDLFPPHIADQLALLQDKVAPFDGKLAKQQIEAAMGGLPVEAWFDDFEIKPLASASIAQVHTARLKSNGKEVVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVAALEKNGTNMKLLAERGVQVFFTQVFRDSFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWVEKMPELPELVYDSLRQGKYLQHSVDKIARELQSNHVRQGQSRYFLGIGATLVLSGTFLLVSRPEWGLMPGWLMAGGLIAWFVGWRKTR

SEQ ID NO: 23630 - protein, 233 aa, Escherichia coli
MTTLSCKVTSVEAITDTVYRVRIVPDAAFSFRAGQYLMVVMDERDKRPFSMASTPDEKGFIELHIGASEINLYAKAVMDRILKDHQIVVDIPHGEAWLRDDEERPMILIAGGTGFSYARSILLTALARNPNRDITIYWGGREEQHLYDLCELEALSLKHPGLQVVPVVEQPEAGWRGRTGTVLTAVLQDHGTLAEHDIYIAGRFEMAKIARDLFCSERNAREDRLFGDAFAFI

SEQ ID NO: 23631 - protein, 387 aa, Escherichia coli
MEQVVIVDAIRTPMGRSKGGAFRNVRAEDLSAHLMRTLLARNPALEAAALDDIYWGCVQQTLEQGFNIARNAALLAEVPHSVPAVTVNRLCGSSMQALHDAARMIMTGDAQACLVGGVEHMGHVPMSHGVDFHPGLSRNVAKAAGMMGLTAEMLARMHGISREMQDAFAARSHARAWAATQSAAFKNEIIPTGGHDADGVLKQFNYDEVIRPETTVEALATLRPAFDPVNGMVTAGTSSALSDGAAAMLVMSESRAHELGLKPRARVRSMAVVGCDPSIMGYGPVPASKLALKKAGLSASDIGVFEMNEAFAAQILPCIKDLGLIEQIDEKINLNGGAIALGHPLGCSGARISTTLLNLMERKDVQFGLATMCIGLGQGIATVFERV

SEQ ID NO: 23632 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 23633 - protein, 443 aa, Escherichia coli
MESLASLYKNHIATLQERTRDALARFKLDALLIHSGELFNVFLDDHPYPFKVNPQFKAWVPVTQVPNCWLLVDGVNKPKLWFYLPVDYWHNVEPLPTSFWTEDVEVIALPKADGIGSLLPAARGNIGYIGPVPERALQLGIEASNINPKGVIDYLHYYRSFKTEYELACMREAQKMAVNGHRAAEEAFRSGMSEFDINIAYLTATGHRDTDVPYSNIVALNEHAAVLHYTKLDHQAPEEMRSFLLDAGAEYNGYAADLTRTWSAKSDNDYAQLVKDVNDEQLALIATMKAGVSYVDYHIQFHQRIAKLLRKHQIITDMSEEAMVENDLTGPFMPHGIGHPLGLQVHDVAGFMQDDSGTHLAAPAKYPYLRCTRILQPGMVLTIEPGIYFIESLLAPWREGQFSKHFNWQKIEALKPFGGIRIEDNVVIHENNVENMTRDLKLA

SEQ ID NO: 23634 - protein, 181 aa, Escherichia coli
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 23635 - protein, 300 aa, Escherichia coli
MTMIRVACVGITVMDRIYYVEGLPTESGKYVARNYTEVGGGPAATAAVAAARLGAQVDFIGRVGDDDTGNSLLAELESWGVNTRYTKRYNQAKSSQSAIMVDTKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVALATSGDLAESVRFASGVAALKCTRPGGRAGIPDCDQTRSFLSLFV

SEQ ID NO: 23636 - protein, 1016 aa, Escherichia coli
  unsure (1)..(1016): unsure at all Xaa locations
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 23637 - protein, 489 aa, Escherichia coli
MTFRNCVAVDLGASSGRVMLARYERECRSLTLREIHRFNNGLHSQNGYVTWDVDSLESAIRLGLNKVCEEGIRIDSIGIDTWGVDFVLLDQQGQRVGLPVAYRDSRTNGLMAQAQQQLGKRDIYQRSGIQFLPFNTLYQLRALTEQQPELIPHIAHALLMPDYFSYRLTGKMNWEYTNATTTQLVNINSDDWDESLLAWSGANKAWFGRPTHPGNVIGHWICPQGNEIPVVAVASHDTASAVIASPLNGSRAAYLSSGTWSLMGFESQTPFTNDTALAANITNEGGAEGRYRVLKNIMGLWLLQRVLQEQQINDLPALISATQALPACRFIINPNDDRFINPETMCSEIQAACRETAQPIPESDAELARCIFDSLALLYADVLHELAQLRGEDFSQLHIVGGGCQNTLLNQLCADACGIRVIAGPVEASTLGNIGIQLMTLDELNNVDDFRQVVSTTANLTTFTPNPDSEIAHYVAQIHSTRQTKELCA

SEQ ID NO: 23638 - protein, 320 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAKKLY

SEQ ID NO: 23639 - protein, 255 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 23640 - protein, 502 aa, Escherichia coli
MTEKKYIVALDQGTTSSRAVVMDHDANIISVSQREFEQIYPKPGWVEHDPMEIWATQSSTLVEVLAKADISSDQIAAIGITNQRETTIVWEKETGKPIYNAIVWQCRRTAEICEHLKRDGLEDYIRSNTGLVIDPYFSGTKVKWILDHVEGSRERARRGELLFGTVDTWLIWKMTQGRVHVTDYTNASRTMLFNIHTLDWDDKMLEVLDIPREMLPEVRRSSEVYGQTNIGGKGGTRIPISGIAGDQQAALFGQLCVKEGMAKNTYGTGCFMLMNTGEKAVKSENGLLTTIACGPTGEVNYALEGAVFMAGASIQWLRDEMKLINDAYDSEYFATKVQNTNGVYVVPAFTGLGAPYWDPYARGAIFGLTRGVNANHIIRATLESIAYQTRDVLEAMQADSGIRLHALRVDGGAVANNFLMQFQSDILGTRVERPEVREVTALGAAYLAGLAVGFWQNLDELQEKAVIEREFRPGIETTERNYRYAGWKKAVKRAMAWEEHDE

SEQ ID NO: 23641 - protein, 386 aa, Escherichia coli
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAEKPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 23642 - protein, 810 aa, Escherichia coli
MSVIAQAGAKGRQLHKFGGSSLADVKCYLRVAGIMAEYSQPDDMMVVSAAGSTTNQLINWLKLSQTDRLSAHQVQQTLRRYQCDLISGLLPAEEADSLISAFVSDLERLAALLDSGINDAVYAEVVGHGEVWSARLMSAVLNQQGLPAAWLDAREFLRAERAAQPQVDEGLSYPLLQQLLVQHPGKRLVVTGFISRNNAGETVLLGRNGSDYSATQIGALAGVSRVTIWSDVAGVYSADPRKVKDACLLPLLRLDEASELARLAAPVLHARTLQPVSGSEIDLQLRCSYTPDQGSTRIERVLASGTGARIVTSHDDVCLIEFQVPASQDFKLAHKEIDQILKRAQVRPLAVGVHNDRQLLQFCYTSEVADSALKILDEAGLPGELRLRQGLALVAMVGAGVTRNPLHCHRFWQQLKGQPVEFTWQSDDGISLVAVLRTGPTESLIQGLHQSVFRAEKRIGLVLFGKGNIGSRWLELFAREQSTLSARTGFEFVLAGVVDSRRSLLSYDGLDASRALAFFNDEAVEQDEESLFLWMRAHPYDDLVVLDVTASQQLADQYLDFASHGFHVISANKLAGASDSNKYRQIHDAFEKTGRHWLYNATVGAGLPINHTVRDLIDSGDTILSISGIFSGTLSWLFLQFDGSVPFTELVDQAWQQGLTEPDPRDDLSGKDVMRKLVILAREAGYNIEPDQVRVESLVPAHCEGGSIDHFFENGDELNEQMVQRLEAAREMGLVLRYVARFDANGKARVGVEAVREDHPLASLLPCDNVFAIESRWYRDNPLVIRGPGAGRDVTAGAIQSDINRLAQLL

SEQ ID NO: 23643 - protein, 726 aa, Escherichia coli
MSTSDDIHNTTATGKCPFHQGGHDQSAGAGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGANFDGSKNGVFTDRVGVLSNDFFVNLLDMRYEWKATDESKELFEGRDRETGEVKFTASRADLVFGSNSVLRAVAEVYASSDAHEKFVKDFVAAWVKVMNLDRFDLL

SEQ ID NO: 23644 - protein, 380 aa, Escherichia coli
MPHLALLISKGAIMDRIIQSPGKYIQGADVINRLGEYLKPLAERWLVVGDKFVLGFAQSTVEKSFKDAGLVVEIAPFGGECSQNEIDRLRGIAETAQCGAILGIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENAPVEEIETVAALSHAVGLPITLAQLDIKEDVPAKMRIVAEAACAEGETIHNMPGGATPDQVYAALLVADQYGQRFLQEWE

SEQ ID NO: 23645 - protein, 711 aa, Escherichia coli
MCSGSAGGILTPISSLDLNALGNLPAAKGVDAEQSALENGLTLVLKNIEFRLLDSDGATSAILEAHRSLAGDTSLREHLLAGVSAGLSCAEAIVASANHFCEEFSRSSSSYLQERALDVRDVCFQLLQQIYGEQRFPAPGKLTQPAICMADELTPSQFLELDKNHLKGLLLKSGGTTSHTVILARSFNIPTLVGVDIDALTPWQQQTIYIDGNAGAIVVEPGEAVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRKLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPVRWGDDEAQFIIMLTLNKHAAGDQHMRIFSRLARRIMHEEFRNALVNAASADAIASLLQHELEL

SEQ ID NO: 23646 - protein, 883 aa, Escherichia coli
MNEQYSALRSNVSMLGKVLGETIKDALGEHILERVETIRKLSKSSRAGNDANRQELLTTLQNLSNDELLPVARAFSQFLNLANTAEQYHSISPKGEAASNPEVIARTLRKLKNQPELSEDTIKKAVESLSLELVLTAHPTEITRRTLIHKMVEVNACLKQLDNKDIADYEHNQLMRRLRQLIAQSWHTDEIRKLRPSPVDEAKWGFAVVENSLWQGVPNYLRELNEQLEENLGYKLPVEFVPVRFTSWMGGDRDGNPNVTADITRHVLLLSRWKATDLFLKDIQVLVSELSMVEATPELLALVGEEGAAEPYRYLMKNLRSRLMATQAWLEARLKGEELPKPEGLLTQNEELWEPLYACYQSLQACGMGIIANGDLLDTLRRVKCFGVPLVRIDIRQESTRHTEALGELTRYLGIGDYESWSEADKQAFLIRELNSKRPLLPRNWQPSAETREVLDTCQVIAEAPQGSIAAYVISMAKTPSDVLAVHLLLKEAGIGFAMPVAPLFETLDDLNNANDVMTQLLNIDWYRGLIQGKQMVMIGYSDSAKDAGVMAASWAQYQAQDALIKTCEKAGIELTLFHGRGGSIGRGGAPAHAALLSQPPGSLKGGLRVTEQGEMIRFKYGLPEITVSSLSLYTGAILEANLLPPPEPKESWRRIMDELSVISCDVYRGYVRENKDFVPYFRSATPEQELGKLPLGSRPAKRRPTGGVESLRAIPWIFAWTQNRLMLPAWLGAGTALQKVVEDGKQSELEAMCRDWPFFSTRLGMLEMVFAKADLWLAEYYDQRLVDKALWPLGKELRNLQEEDIKVVLAIANDSHLMADLPWIAESIQLRNIYTDPLNVLQAELLHRSRQAEKEGQEPDPRVEQALMVTIAGIAAGMRNTG

SEQ ID NO: 23647 - protein, 334 aa, Escherichia coli
MLNTLIVGASGYAGAELVTYVNRHPHMNITALTVSAQSNDAGKLISDLHPQLKGIVDLPLQPMSDISEFSPGVDVVFLATAHEVSHDLAPQFLEAGCVVFDLSGAFRVNDATFYEKYYGFTHQYPELLEQAAYGLAEWCGNKLKEANLIAVPGCYPTAAQLALKPLIDADLLDLNQWPVINATSGVSGAGRKAAISNSFCEVSLQPYGVFTHRHQPEIATHLGADVIFTPHLGNFPRGILETITCRLKSGVTQAQVAQVLQQAYAHKPLVRLYDKGVPALKNVVGLPFCDIGFAVQGEHLIIVATEDNLLKGAAAQAVQCANIRFGYAETQSLI

SEQ ID NO: 23648 - protein, 258 aa, Escherichia coli
MMNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRHAEQLPALFNGMPMGTRILA

SEQ ID NO: 23649 - protein, 457 aa, Escherichia coli
MALWGGRFTQAADQRFKQFNDSLRFDYRLAEQDIVGSVAWSKALVTVGVLTAEEQAQLEEALNVLLEDVRARPQQILESDAEDIHSWVEGKLIDKVGQLGKKLHTGRSRNDQVATDLKLWCKDTVSELLTANRQLQSALVETAQNNQDAVMPGYTHLQRAQPVTFAHWCLAYVEMLARDESRLQDALKRLDVSPLGCGALAGTAYEIDREQLAGWLGFASATRNSLDSVSDRDHVLELLSAAAIGMVHLSRFAEDLIFFNTGEAGFVELSDRVTSGSSLMPQKKNPDALELIRGKCGRVQGALTGMMMTLKGLPLAYNKDMQEDKEGLFDALDTWLDCLHMAALVLDGIQVKRPRCQEAAQQGYANATELADYLVAKGVPFREAHHIVGEAVVEAIRQGKPLEDLPLSELQKFSQVIDEDVYPILSLQSCLDKRAAKGGVSPQQVAQAIAFAQARLG

SEQ ID NO: 23650 - protein, 444 aa, Escherichia coli
MGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 23651 - protein, 1342 aa, Escherichia coli [sequence omitted]

SEQ ID NO: 23652 - protein, 1407 aa, Escherichia coli [sequence omitted]

SEQ ID NO: 23653 - protein, 354 aa, Escherichia coli
MTELKNDRYLRALLRQPVDVTPVWMMRQAGRYLPEYKATRAQAGDFMSLCKNAELACEVTLQPLRRYPLDAAILFSDILTVPDAMGLGLYFEAGEGPRFTSPVTCKADVDKLPIPDPEDELGYVMNAVRTIRRELKGEVPLIGFSGSPWTLATYMVEGGSSKAFTVIKKMMYADPQALHALLDKLAKSVTLYLNAQIKAGAQAVMIFDTWGGVLTGRDYQQFSLYYMHKIVDGLLRENDGRRVPVTLFTKGGGQWLEAMAETGCDALGLDWTTDIADARRRVGNKVALQGNMDPSMLYAPPARIEEEVATILAGFGHGEGHVFNLGHGIHQDVPPEHAGVFVEAVHRLSEQYHR

SEQ ID NO: 23654 - protein, 449 aa, Escherichia coli
MSEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFE

SEQ ID NO: 23655 - protein, 549 aa, Escherichia coli
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 23656 - protein, 491 aa, Escherichia coli
MNTQYNSSYIFSITLVATLGGLLFGYDTAVISGTVESLNTVFVAPQNLSESAANSLLGFCVASALIGCIIGGALGGYCSNRFGRRDSLKIAAVLFFISGVGSAWPELGFTSINPDNTVPVYLAGYVPEFVIYRIIGGIGVGLASMLSPMYIAELAPAHIRGKLVSFNQFAIIFGQLLVYCVNYFIARSGDASWLNTDGWRYMFASECIPALLFLMLLYTVPESPRWLMSRGKQEQAEGILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQAPGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 23657 - protein, 397 aa, Escherichia coli
MFQKVDAYAGDPILTLMERFKEDPRSDKVNLSIGLYYNEDGIIPQLQAVAEAEARLNAQPHGASLYLPMEGLNCYRHAIAPLLFGADHPVLKQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDAVIEILKARELIPFLDIAYQGFGAGMEEDAYAIRAIASAGLPALVSNSFSKIFSLYGERVGGLSVMCEDAEAAGRVLGQLKATVRRNYSSPPNFGAQVVAAVLNDEALKASWLAEVEEMRTRILAMRQELVKVLSTEMPERNFDYLLNQRGMFSYTGLSAAQVDRLREEFGVYLIASGRMCVAGLNTANVQRVAKAFAAVM

SEQ ID NO: 23658 - protein, 652 aa, Escherichia coli
MSQIHKHTIPANIADRCLINPQQYEAMYQQSINVPDTFWGEQGKILDWIKPYQKVKNTSFAPGNVSIKWYEDGTLNLAANCLDRHLQENGDRTAIIWEGDDASQSKHISYKELHRDVCRFANTLLELGIKKGDVVAIYMPMVPEAAVAMLACARIGAVHSVIFGGFSPEAVAGRIIDSNSRLVITSDEGVRAGRSIPLKKNVDDALKNPNVTSVEHVVVLKRTGGKIDWQEGRDLWWHDLVEQASDQHQAEEMNAEDPLFILYTSGSTGKPKGVLHTTGGYLVYAALTFKYVFDYHPGDIYWCTADVGWVTGHSYLLYGPLACGATTLMFEGVPNWPTPARMAQVVDKHQVNILYTAPTAIRALMAEGDKAIEGTDRSSLRILGSVGEPINPEAWEWYWKKIGNEKCPVVDTWWQTETGGFMITPLPGATELKAGSATRPFFGVQPALVDNEGNPLEGATEGSLVITDSWPGQARTLFGDHERFEQTYFSTFKNMYFSGDGARRDEDGYYWITGRVDDVLNVSGHRLGTAEIESALVAHPKIAEAAVVGIPHNIKGQAIYAYVTLNHGEEPSPELYAEVRNWVRKEIGPLATPDVLHWTDSLPKTRSGKIMRRILRKIAAGDTSNLGDTSTLADPGVVEKLLEEKQAIAMPS

SEQ ID NO: 23659 - protein, 437 aa, Escherichia coli
MKNIKFSLAWQILFAMVLGILLGSYLHYHSDSRDWLVVNLLSPAGDIFIHLIKMIVVPIVISTLVVGIAGVGDAKQLGRIGAKTIIYFEVITTVAIILGITLANVFQPGAGVDMSQLATVDISKYQSTTEAVQSSSHGIMGTILSLVPTNIVASMAKGEMLPIIFFSVLFGLGLSSLPATHREPLVTVFRSISETMFKVTHMVMRYAPVGVFALIAVTVANFGFSSLWPLAKLVLLVHFAILFFALVVLGIVARLCGLSVWILIRILKDELILAYSTASSESVLPRIIEKMEAYGAPVSITSFVVPTGYSFNLDGSTLYQSIAAIFIAQLYGIDLSIWQEIILVLTLMVTSKGIAGVPGVSFVVLLATLGSVGIPLEGLAFIAGVDRILDMARTALNVVGNALAVLVIAKWEHKFDRKKALAYEREVLGKFDKTADQ

SEQ ID NO: 23660 - protein, 715 aa, Escherichia coli
  unsure (1)..(715): unsure at all Xaa locations
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 23661 - protein, 500 aa, Escherichia coli
MLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEANFLDWGWRIPFFIALPLGIIGLYLRHALEETPAFQQHVDKLEQGDREGLQDGPKVSFKEIATKYWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFTGVMASTLPAMFPTHIRYSALAAAFNISVLVAGLTPTLAAWLVESSQNLMMPAYYLMVVAVVGLITGVTMKETANRPLKGATPAASDIQEAKEILVEHYDNIEQKIDDIDHEIADLQAKRTRLVQQHPRIDE

SEQ ID NO: 23662 - protein, 756 aa, Escherichia coli
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEVTPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 23663 - protein, 451 aa, Escherichia coli [sequence omitted]

SEQ ID NO: 23664 - protein, 715 aa, Escherichia coli
MNVIAILNHMGVYFKEEPIRELHRALERLNFQIVYPNDRDDLLKLIENNARLCGVIFDWDKYNLELCEEISKMNENLPLYAFANTYSTLDVSLNDLRLQISFFEYALGAAEDIANKIKQTTDEYINTILPPLTKALFKYVREGKYTFCTPGHMGGTAFQKSPVGSLFYDFFGPNTMKSDISISVSELGSLLDHSGPHKEAEQYIARVFNADRSYMVTNGTSTANKIVGMYSAPAGSTILIDRNCHKSLTHLMMMSDVTPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLINGSIERAIKFRKEIKRLRTESDGWFFDVWQPDHIDTTECWPLRSDSTWHGFKNIDNEHMYLDPIKVTLLTPGMEKDGTMSDFGIPASIVAKYLDEHGIVVEKTGPYNLLFLFSIGIDKTKALSLLRALTDFKRAFDLNLRVKNMLPSLYREDPEFYENMRIQELAQNIHKLIVHHNLPDLMYRAFEVLPTMVMTPYAAFQKELHGMTEEVYLDEMVGRINANMILPYPPGVPLVMPGEMITEESRPVLEFLQMLCEIGAHYPGFETDIHGAYRQADGRYTVKVLKEESKK

SEQ ID NO: 23665 - protein, 493 aa, Escherichia coli
MCLKQIIGSLKKKVHMSNNIRIEEDLLGTREVPADAYYGVHTLRAIENFYISNNKISDIPEFVRGMVMVKKAAAMANKELQTIPKSVANAIIAACDEVLNNGKCMDQFPVDVYQGGAGTSVNMNTNEVLANIGLELMGHQKGEYQYLNPNDHVNKCQSTNDAYPTGFRIAVYSSLIKLVDAINQLREGFERKAVEFQDILKMGRTQLQDAVPMTLGQEFRAFSILLKEEVKNIQRTAELLLEVNLGATAIGTGLNTPKEYSPLAVKKLAEVTGFPCVPAEDLIEATSDCGAYVMVHGALKRLAVKMSKICNDLRLLSSGPRAGLNEINLPELQAGSSIMPAKVNPVVPEVVNQVCFKVIGNDTTVTMAAEAGQLQLNVMEPVIGQAMFESVHILTNACYNLLEKCINGITANKEVCEGYVYNSIGIVTYLNPFIGHHNGDIVGKICAETGKSVREVVLERGLLTEAELDDIFSVQNLMHPAYKAKRYTDESEQ

SEQ ID NO: 23666 - protein, 244 aa, Escherichia coli
MAEMKNLKIEVVRYNPEVDTAPHSAFYEVPYDATTSLLDALGYIKDNLAPDLSYRWSCRMAICGSCGMMVNNVPKLACKTFLRDYTDGMKVEALANFPIERDLVVDMTHFIESLEAIKPYIIGNSRTADQGTNIQTPAQMAKYHQFSGCINCGLCYAACPQFGLNPEFIGPAAITLAHRYNEDSRDHGKKERMAQLNSQNGVWSCTFVGYCSEVCPKHVDPAAAIQQGKVESSKDFLIATLKPR

SEQ ID NO: 23667 - protein, 602 aa, Escherichia coli
MQTFQADLAIVGAGGAGLRAAIAAAQANPNAKIALISKVYPMRSHTVAAEGGSAAVAQDHDSFEYHFHDTVAGGDWLCEQDVVDYFVHHCPTEMTQLELWGCPWSRRPDGSVNVRRFGGMKIERTWFAADKTGFHMLHTLFQTSLQFPQIQRFDEHFVLDILVDDGHVRGLVAMNMMEGTLVQIRANAVVMATGGAGRVYRYNTNGGIVTGDGMGMALSHGVPLRDMEFVQYHPTGLPGSGILMTEGCRGEGGILVNKNGYRYLQDYGMGPETPLGEPKNKYMELGPRDKVSQAFWHEWRKGNTISTPRGDVVYLDLRHLGEKKLHERLPFICELAKAYVGVDPVKEPIPVRPTAHYTMGGIETDQNCETRIKGLFAVGECSSVGLHGANRLGSNSLAELVVFGRLAGEQATERAATAGNGNEAAIEAQAAGVEQRLKDLVNQDGGENWAKIRDEMGLAMEEGCGIYRTPELMQKTIDKLAELQERFKRVRITDTSSVFNTDLLYTIELGHGLNVAECMAHSAMARKESRGAHQRLDEGCTERDDVNFLKHTLAFRDADGTTRLEYSDVKITTLPPAKRVYGGEADAADKAEAANKKEKANG

SEQ ID NO: 23668 - protein, 322 aa, Escherichia coli
MLNSFKLSLQYILPKLWLTRLAGWGASKRAGWLTKLVIDLFVKYYKVDMKEAQKPDTASYRTFNEFFVRPLRDEVRPIDTDPNVLVMPADGVISQLGKIEEDKILQAKGHNYSLEALLAGNYLMADLFRNGTFVTTYLSPRDYHRVHMPCNGILREMIYVPGDLFSVNHLTAQNVPNLFARNERVICLFDTEFGPMAQILVGATIVGSIETVWAGTITPPREGIIKRWTWPAGENDGSVALLKGQEMGRFKLGSTVINLFAPGKVNLVEQLESLSVTKIGQPLAVSTETFVTPDAEPAPLPAEEIEAEHDASPLVDDKKDQV

SEQ ID NO: 23669 - protein, 432 aa, Escherichia coli
MGNNVVVLGTQWGDEGKGKIVDLLTERAKYVVRYQGGHNAGHTLVINGEKTVLHLIPSGILRENVTSIIGNGVVLSPAALMKEMKELEDRGIPVRERLLLSEACPLILDYHVALDNAREKARGAKAIGTTGRGIGPAYEDKVARRGLRVGDLFDKETFAEKLKEVMEYHNFQLVNYYKAEAVDYQKVLDDTMAVADILTSMVVDVSDLLDQARQRGDFVMFEGAQGTLLDIDHGTYPYVTSSNTTAGGVATGSGLGPRYVDYVLGILKAYSTRVGAGPFPTELFDETGEFLCKQGNEFGATTGRRRRTGWLDTVAVRRAVQLNSLSGFCLTKLDVLDGLKEVKLCVAYRMPDGREVTTTPLAADDWKGVEPIYETMPGWSESTFGVKDRSGLPQAALNYIKRIEELTGVPIDIISTGPDRTETMILRDPFDA

SEQ ID NO: 23670 - protein, 470 aa, Escherichia coli
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 23671 - protein, 212 aa, Escherichia coli [sequence omitted]

SEQ ID NO: 23672 - protein, 332 aa, Escherichia coli
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 23673 - protein, 551 aa, Escherichia coli
MTHLPHWWQNGVIYQIYPKSFQDTTGSGTGDLRGVIQHLDYLHKLGVDAIWLTPFYVSPQVDNGYDVANYTAIDPTYGTLDDFDELVTQAKSRGIRIILDMVFNHTSTQHAWFREALNKESPYRQFYIWRDGEPETPPNNWRSKFGGSAWRWHAESEQYYLHLFAPEQADLNWENPAVRAELKKVCEFWADRGVDGLRLDVVNLISKDPRFPEDLDGDGRRFYTDGPRAHEFLHEMNRDVFTPRGLMTVGEMSSTSLEHCQRYAALTGSELSMTFNFHHLKVDYPGGEKWTLAKPDFVALKTLFRHWQQGMHNVAWNALFWCNHDQPRIVSRFGDEGEYRVPAAKMLAMVLHGMQGTPYIYQGEEIGMTNPHFTRITDYRDVESLNMFAELRNDGRDADELLAILASKSRDNSRTPMQWSNGDNAGFTAGEPWIGLGDNYQQINVEAALADDSSVFYTYQKLIALRKQEAILTWGNYQDLLPNSPVLWCYRREWKGQTLLVIANLSREIQPWQAGQMRGNWQLVMHNYEEASPQPCAMNLRPFEAVWWLQK

SEQ ID NO: 23674 - protein, 898 aa, Escherichia coli
MFKEIFTRLIRHLPSRLVHRDPLPGAQQTVNTVVPPSLSAHCLKMAVMPEEELWKTFDTHPEGLNQAEVESAREQHGENKLPAQQPSPWWVHLWVCYRNPFNILLTILGAISYATEDLFAAGVIALMVAISTLLNFIQEARSTKAADALKAMVSNTATVLRVINDKGENGWLEIPIDQLVPGDIIKLAAGDMIPADLRILQARDLFVAQASLTGESLPVEKAATTRQPEHSNPLECDTLCFMGTTVVSGTAQAMVIATGANTWFGQLAGRVSEQESEPNAFQQGISRVSMLLIRFMLVMAPVVLLINGYTKGDWWEAALFALSVAVGLTPEMLPMIVTSTLARGAVKLSKQKVIVKHLDAIQNFGAMDILCTDKTGTLTQDKIVLENHTDISGKTSERVLHSAWLNSHYQTGLKNLLDTAVLEGTDEESARSLASRWQKIDEIPFDFERRRMSVVVAENTEHHQLVCKGALQEILNVCSQVRHNGEIVPLDDIMLRKIKRVTDTLNRQGLRVVAVATKYLPAREGDYQRADESDLILEGYIAFLDPPKETTAPALKALKASGITVKILTGDSELVAAKVCHEVGLDAGEVVIGSDIETLSDDELANLAQRTTLFARLTPMHKERIVTLLKREGHVVGFMGDGINDAPALRAADIGISVDGAVDIAREAADIILLEKSLMVLEEGVIEGRRTFANMLKYIKMTASSNFGNVFSVLVASAFLPFLPMLPLHLLIQNLLYDVSQVAIPFDNVDDEQIQKPQRWNPADLGRFMIFFGPISSIFDILTFCLMWWVFHANTPETQTLFQSGWFVVGLLSQTLIVHMIRTRRVPFIQSCASWPLMIMTVIVMIVGIALPFSPLASYLQLQALPLSYFPWLVAILAGYMTLTQLVKGFYSRRYGWQ

SEQ ID NO: 23675 - protein, 153 aa, Escherichia coli
MTHDNKLQVEAIKRGTVIDHIPAQIGFKLLSLFKLTETDQRITIGLNLPSGEMGRKDLIKIENTFLSEDQVDQLALYAPQATVNRIDNYEVVGKSRPSLPERIDNVLVCPNSNCISHAEPVSSSFAVRKRANDIALKCKYCEKEFSHNVVLAN

SEQ ID NO: 23676 - protein, 311 aa, Escherichia coli
MANPLYQKHIISINDLSRDDLNLVLATAAKLKANPQPELLKHKVIASCFFEASTRTRLSFETSMHRLGASVVGFSDSANTSLGKKGETLADTISVISTYVDAIVMRHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVL

SEQ ID NO: 23677 - protein, 237 aa, Escherichia coli
MGAFTGKTVLILGGSRGIGAAIVRRFVTDGANVRFTYAGSKDAAKRLAQETGATAVFTDSADRDAVIDVVRKSGALDILVVNAGIGVFGEALELNADDIDRLFKINIHAPYHASVEAARQMPEGGRILIIGSVNGDRMPVAGMAAYAASKSALQGMARGLARDFGPRGITINVVQPGPIDTDANPANGPMRDMLHSLMAIKRHGQPEEVAGMVAWLAGPEASFVTGAMHTIDGAFGA

SEQ ID NO: 23678 - protein, 334 aa, Escherichia coli
MSGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAEYASVPVWNGLTNEFHPTQLLADLLTMQEHLPGKAFNEMTLVYAGDARNNMGNSMLEAAALTGLDLRLVAPQACWPEAALVTECRALAQQNGGNITLTEDVAKGVEGADFIYTDVWVSMGEAKEKWAERIALLREYQVNSKMMQLTGNPEVKFLHCLPAFHDDQTTLGKKMAEEFGLHGGMEVTDEVFESAASIVFDQAENRMHTIKAVMVATLSK

SEQ ID NO: 23679 - protein, 254 aa, Escherichia coli
MNDLFSLAGKNILITGSAQGIGFLLATGLGKYGAQIIINDITAERAELAVEKLHQEGIQAVAAPFNVTHKHEIDAAVEHIEKDIGPIDVLVNNAGIQRRHPFTEFPEQEWNDVIAVNQTAVFLVSQAVTRHMVERKAGKVINICSMQSELGRDTITPYAASKGAVKMLTRGMCVELARHNIQVNGIAPGYFKTEMTKALVEDEAFTAWLCKRTPAARWGDPQELIGAAVFLSSKASDFVNGHLLFVDGGMLVAV

SEQ ID NO: 23680 - protein, 343 aa, Escherichia coli
MQVKTQSCVVAGKKTVAVTEQTIDWNNNGTLVQITRGGICGSDLHYYQEGKVGNFMIKAPMVLGHEVIGKVIHSDSSELHEGQTVAINPSKPCGHCKYCIEHNENQCTDMRFFGSAMYFPHVDGGFTRYKMVETSQCVPYPAKADEKVMAFAEPLAVAIHAAHQAGELQGKRVFISGVGPIGCLIVSAVKTLGAAEIVCADVSPRSLSLGKEMGADVLVNPQNDDMDHWKAEKGYFDVSFEVSGHPSSVNTCLEVTRARGVMVQVGMGGAMAEFPMMTLIGKEISLRGSFRFTSEFNTAVSWLANGVINPLPLLSAEYPFTDLEEALRFAGDKTQAAKVQLVF

SEQ ID NO: 23681 - protein, 187 aa, Escherichia coli
MAGESFILMGVSGSGKTLIGSKVAALLSAKFIDGDDLHPAKNIDKMSQGIPLSDEDRLPWLERLNDASYSLYKKNETGFIVCSSLKKQYRDILRKGSPHVHFLWLDGDYETILARMQRRAGHFMPVALLKSQFEALERPQADEQDIVRIDINHDIANVTEQCRQAVLAIRQNRICAKEGSASDQRCE

SEQ ID NO: 23682 - protein, 353 aa, Escherichia coli
MLYTSQTTPEKDQKMSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 23683 - protein, 319 aa, Escherichia coli
MGWDTETKMSTYEKETEVMKKFSGIIPPVSSTFHRDGTLDKKAMREVADFLINKGVDGLFYLGTGGEFSQMNTAQRMALAEEAVTIVDGRVPVLIGVGSPSTDEAVKLAQHAQAYGADGIVAINPYYWKVAPRNLDDYYQQIARSVTLPVILYNFPDLTGQDLTPETVTRLALQNENIVGIKDTIDSVGHLRTMINTVKSVRPSFSVFCGYDDHLLNTMLLGGDGAITASANFAPELSVGIYRAWREGDLATAATLNKKLLQLPAIYALETPFVSLIKYSMQCVGLPVETYCLPPILEASEEAKDKVHVLLTAQGILPV

SEQ ID NO: 23684 - protein, 453 aa, Escherichia coli
MEKENITIDPRSSFTPSSSADIPVPPDGLVQRSTRIKRIQTTAMLLLFFAAVINYLDRSSLSVANLTIREELGLSATEIGALLSVFSLAYGIAQLPCGPLLDRKGPRLMLGLGMFFWSLFQAMSGMVHNFTQFVLVRIGMGIGEAPMNPCGVKVINDWFNIKERGRPMGFFNAASTIGVAVSPPILAAMMLVMGWRGMFITIGVLGIFLAIGWYMLYRNREHVELTAVEQAYLNAGSVNARRDPLSFAEWRSLFRNRTMWGMMLGFSGINYTAWLYLAWLPGYLQTAYNLDLKSTGLMAAIPFLFGAAGMLVNGYVTDWLVKGGMAPIKSRKICIIAGMFCSAAFTLIVPQATTSMTAVLLIGMALFCIHFAGTSCWGLIHVAVASRMTASVGSIQNFASFICASFAPIITGFIVDTTHSFRLALIICGCVTAAGALAYIFLVRQPINDPRKD

SEQ ID NO: 23685 - protein, 345 aa, Escherichia coli
MESRIMSTMNVLICQQPKELVWKQREIPIPGDNEALIKIKSVGICGTDIHAWGGNQPFFSYPRVLGHEICGEIVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPLLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 23686 - protein, 555 aa, Escherichia coli
MAQFVYTMHRVGKVVPPKRHILKNISLSFFPGAKIGVLGLNGAGKSTLLRIMAGIDKDIEGEARPQPDIKIGYLPQEPQLNPEHTVRESIEEAVSEVVNALKRLDEVYALYADPDADFDKLAAEQGRLEEIIQAHDGHNLNVQLERAADALRLPDWDAKIANLSGGERRRVALCRLLLEKPDMLLLDEPTNHLDAESVAWLERFLHDFEGTVVAITHDRYFLDNVAGWILELDRGEGIPWEGNYSSWLEQKDQRLAQEASQEAARRKSIEKELEWVRQGTKGRQSKGKARLARFEELNSTEYQKRNETNELFIPPGPRLGDKVLEVSNLRKSYGDRLLIDDLSFSIPKGAIVGIIGPNGAGKSTLFRMISGQEQPDSGTITLGETVKLASVDQFRDSMDNSKTVWEEVSGGLDIMKIGNTEMPSRAYVGRFNFKGVDQGKRVGELSGGERGRLHLAKLLQVGGNMLLLDEPTNDLDIETLRALENALLEFPGCAMVISHDRWFLDRIATHILDYQDEGKVEFFEGNFTEYEEYKKRTLGADALEPKRIKYKRIAK

SEQ ID NO: 23687 - protein, 215 aa, Escherichia coli
MLQVYLVRHGETQWNAERRIQGQSDSPLTAKGEQQAMQVATRAKELGITHIISSDLGRTRRTAEIIAQACGCDIIFDSRLRELNMGVLEKRHIDSLTEEEENWRRQLVNGTVDGRIPEGESMQELSDRVNAALESCRDLPQGSRPLLVSHGIALGCLVSTILGLPAWAERRLRLRNCSISRVDYQESLWLASGWVVETAGDISHLDAPALDELQR

SEQ ID NO: 23688 - DNA, 915 bp, Aquifex aeolicus
atgggtgttagaaagttaaaacctgtaacaaacgggacgaggcacgcagttctttacgactttgaagaaatagaaaaattagtaagaaaaggaaaagaatgggttctactaaagaaaaaccaagtagaacctgaaaaatccctcctcaagtggtggcacagggcaaaaggacgctctagacagagggggaacatcaccgcaagacacaggggaggaggacacaagaaactttacagaattatagacttcaagagggacaagagcttagttcccgcgaaggtagtttcaatagaatatgaccccttcaggagtgccaggatttgtctccttcactacgctgacggtgagaagaggtacataatctggccagaagggttgaaggtgggagacaccgtaatgtccataagctgggaagacgcggaagccggaaagccccttcccgagataaaacccggaaacgcaatgcccctcaagtacatacccgaaggtaccatagtccataacatagagttcattcctggaaagggaggacagatagcaagggctgccggaacatgggctcaggttctcgggcgttccacgaggaagggatacgtcctcgtcagaatgccttctggtgaagttcgtatgatacacgagaggtgtatggctacggtcggaagagttggacttgcggaacacgaactcgttaaacttggaaaggcgggaagagcaaggtggctcggatggagacctcacacgaggggaaccgctatgaacccagttgaccacccgcacggtggtggtgaaggaagaacgagaggtaaacaccccgaatccccttggggatggaagaccaaaggatacaagactagaagaggtaagaagtactccgatcaatttatcgtaacgagaagggacggaagacccttataa

SEQ ID NO: 23689 - DNA, 660 bp, Aquifex aeolicus
atgctcatcgccgttccccttgatgatacaaacttttccgaaaacttaaaaaaggctaaggaaaagggtgcggatattgtagaactccgtgtggaccagttctcagacacttccttaaattacgtaaaggaaaaactggaagaagtacattcgcaaggtttgaaaacgatactgactatacgctctcccgaggagggaggaagggaagttaaaaacagggaagagctctttgaagaactttctcccctcagcgattacacggatatagaactctcttccagagggcttttggtaaaactttacaatataacgaaagaagcgggaaaaaagttgataatctcctaccacaactttgagctcacaccccctaactggataataagggaagttttaagggagggatacaggtacggaggaataccgaagatagcggtaaaggcaaactcctacgaagatgttgcaaggcttttatgtatttccagacaggttgagggagaaaagatattaatttccatgggtgattacggaaagatttcaaggctcgcgggatacgtttttgggtccgtaataacctactgctccttagaaaaggctttcgctcctggtcaaattcctttagaagagatggttgagctcagaaagaagttctacaggctttaa

SEQ ID NO: 23690 - DNA, 1131 bp, Aquifex aeolicus
atgacatacttaatgaacaattacgcaaggttgcccgtaaagtttgtaaggggaaaaggtgtttacctgtacgatgaggaaggaaaggagtatcttgactttgtctccggtataggcgtcaactccctcggtcacgcttacccaaaactcacagaagctctaaaagaacaggttgagaaactcctccacgtttcaaatctttacgaaaacccgtggcaggaagaactggctcacaaacttgtaaaacacttctggacagaagggaaggtatttttcgcaaacagcggaacggaaagtgtagaggcggctataaagctcgcaaggaagtactggagggataaaggaaagaacaagtggaagtttatatcctttgaaaactctttccacgggagaacctacggtagcctctccgcaacgggacagccaaagttccacaaaggctttgaacctctagttcctggattttcttacgcaaagctgaacgatatagacagcgtttacaaactcctagacgaggaaaccgcggggataattattgaagttatacaaggagagggcggagtaaacgaggcgagtgaggattttctaagtaaactccaggaaatttgtaaagaaaaagatgtgctcttaattatagacgaagtgcaaacgggaataggaaggaccggggaattctacgcatatcaacacttcaatctaaaaccggacgtaattgcgcttgcgaagggactcggaggaggtgtgccaataggtgccatccttgcaagggaagaagtggcccagagctttactcccggctcccacggctctaccttcggaggaaaccccttagcctgcagggcgggaacagtggtagtagatgaagttgaaaaactcctgcctcacgtaagggaagtggggaattacttcaaagaaaaactgaaggaactcggcaaaggaaaggtaaagggaagaggattgatgctcggtcttgaacttgaaagagagtgtaaagattacgttctcaaggctcttgaaaagggacttctcataaactgcaccgccggaaaagttctcaggttcttaccgcccttgataattcagaaggaacacattgacagggctatatctgttttgagggaaatactttga

SEQ ID NO: 23691 - DNA, 1314 bp, Aquifex aeolicus
atgaaactctccgtaataggcggcggatacgtaggattagttacggcagcttgtttttcccacctcggacacgaagtactcgtagtcgaaaagatacccgaaaaggtagaactcctaagaaggggaaagagccccatatacgaaccaggactggaagagctcctgagggaagggataaatgaaggaagacttagctttaccacggatataaaggaggggattgagttttcggaggtgatatttatatgcgtaggaactccgtctaacccggacggttcagcggatctctctcaggttgaagaagttgcaaggttcacggcaaagtatatggatagctacaaactcctcgtaaataagtccaccgttcccgtagggacgcaaagaaaggttaagagaaccgtaagactatacttgaaaaacaaagaactggaatttgacgtagcttcaaatccggaatttttaagggagggtcacgccgtaaaagacttcttagaacccgacagaatagtagtaggcgttgagagcgaaagggcaaaggaagtattactggagatttacaaacctataaccgataaaggctttcccatcctcattacaaacccgcccacagcggaaataataaagtacgcttctaatacattcttggcaacgaagatatccttcataaacatgatttctgacctgtgtgaaaaggtgggggcaaacgtagaggaagtggcccagggaatgggttacgacaagaggataggtaaagaattcctaagagcgggcttgggatggggaggaagttgcctcccgaaagacacaaaagcctttataaggatacttgaagaattgggagtagatgctacaatcctcaagggtgcactcggtataaacgaaagcagagtggacagattacttcaaaagttaaaagatgcactctggatactcaaaggcaagacaattgcgatctggggactttccttcaagccgaacacggacgacataagggaagctccctcgctcaaagttgttgaaagactcttaagggaaggggcaaaaataagggcttacgaccctaaagctactgaaaacttcaaaagggtatttattgaaggggaggatctcaggtattttgatgacaagtacaaggctgttgagggagcagaagctctgctaatcctgaccgagtgggacgagttcaagagggcaaacctcgaaagagtaaaaagattgatggaacttccaataataatagacggaaggaatatatacgatcctcaagaggttagaaacttaggctttgagtattacagcatgggaagaccatga

SEQ ID NO: 23692 - DNA, 579 bp, Aquifex aeolicus
atgcgggaagcggaagtcttcagggaaacgagagagacaaagataaagctatacataaacctagacggaagcgggaattacgaagtgaacacacctgtgggatttttaacccatatgcttgagtcctttgcaaaacacggaaggtttgacctgaaggttgaggccgagggagacgttcacgtttcccaccaccacacagtggaggactgcggtatagttctcggtcaggcggtactaaaagccctcggagataaaaaaggaataaggaggtacggatactccataattcccatggacgaggctctggtactctcttctatagacatctcgggaagaccgctattcttttacgaagacaaggacttaaggggaaagataacggagtttgattttgagcttatatgggaattctttaaaggttttgcccttgagagcaggagcacgctacatataaaggtccttgacgggaaaatactccaccacgtggcggaagcttgctttaagtcctttgcgattactttaaaagaagcggtaaaagtagagggaagcggagtgccctcaacgaaaggcgttatttag

SEQ ID NO: 23693 - DNA, 921 bp, Aquifex aeolicus
atggacctgagcgtggaactcttcggcatacgctttaagaatcccgtctgggttgcaagcgggacctttggctacggcgtggaagctgcggaaatctacgatatatcaaaactcggagcagtagtcacaaaaggtctctcactcaaggaaaggctcgggaacgaaaccccgagaattgtggaaaccccctgtggcatgctcaactccataggtcttcaaaatccgggagtggaaaagttcctaaaagagatttaccccaagataaaagacgtggacactcacttcatagctaacgtcttcggtgaaacggaagaggagtacgtggaagtttgtatggctctggaagatgctgacaagattgtggcttacgagctgaatgtttcctgtcccaacgtgaagaagggaggaatcctcttcggacacgaccctgtaatcctcggaaatctcgttgacagaataaaggcgaaaataaaaaaacccctccttgtaaaactctctccaaatgtgaccgacgttaccgagtttgcgaaggtatgtatagaaaacggagctgatggactcgttttgataaacacattaatgggaatgaagataaacatatggaagaggaaaccagaccttgccaccaaaacgggaggactatccggacctgcgatactgcccatagcggtgaggatgatttatcaggtttacgagaagttcggcgacagaattcccataataggagtgggagggataaccacatgggaagacgccatggaacacgtaatggcgggggcaagtgcagttcaggtgggaaccgcaaacttctacgagcccttagcacccttaaaggtcatagaagggattgaaaactttatgaaatctcagaatatcaaagacttcaaagaattaatcgggattgcccacagagtagaataa

SEQ ID NO: 23694 - DNA, 453 bp, Aquifex aeolicus
atggatattcaagagataatggaaatacttccgcacaggtatcccattctcttagtagataaaatccttgaaatagaagaaggaaaaaggatcattggtttaaagaacgtgagcgttaacgagccggtttttcaggggcactttcccggctttcccctctttccgggggtttacatactggaggctatggctcaggtgggggggattttaatgataaagtcccttaaccttgaaattggaaagtacgcagttgtttttgcaggtatagacgacgcgaggtttaaaaaacccgtttacccgggagaccagcttatactcgagcttgaagttatatctcttaaaaaggcactttcaaagatgaagggggttgcaaaggtggacggggaagttgtggcacaggctacgctgatggcagccgcgagaaaacttgaagacattaaaaggaatgcctga

SEQ ID NO: 23695 - DNA, 969 bp, Aquifex aeolicus
atgcttacggacttagggctactgacactcgggtttttcttactggtaaaaggagctgatatgctcatagaaggagctggagggcttgcgaggcgcttcgggatacccgaattcgtaataggtctgacgctcgtggctttcggaacatcccttcccgagtttaccgtgaacgtaagtgcagcactcaaagacgcttcgggtatttctctcggaaacgttataggttcaaatatagcaaacattcttcttatcctcggtgtagcttcattgataaagccccttactgttcacgccacattcgtaaaaaaggaaattccagtgaacttttttcttacgttaacgctcatagtcatggcaaacgacgttatcttaaatcacgctccagtttctttgatatcccgtggggacggacttgtcctgataataacttttctgggatacatgtacttcctcgtggcttacttggaaagggacagcattcttgaaggagagatgaaagaaagcatttctccttttaagggctttatctacttcattctcggacttacaggtctttctctgggagcagactggacggtagacggcgcagtcggactcgctaaagctctcggagttagtgaagctgtaatcgggctgtttgtcgttgcaataggaacatctcttccggaactctttgcctccgcggtatcagcctataaaggaaacccggatatcgctctcgggaacgttgcgggttcaaacattttcaacgcgactctagtccttggaacgagctccgttataagggacattcccgttccagaaagggctaacgtggatttgggagttttgttcattgccacactcttacttctgatatcctccatctggggtaaaaggaagtacacgctcgacagaatggaaggaggaatatttttactggcttactttatttacgttatagcttcttggtacagggaactcagctga

SEQ ID NO: 23696 - DNA, 513 bp, Aquifex aeolicus
atgaagcgtcctataatgctcatagacctggacaggtgcataggctgcctttcctgtgaagtagcctgcgttcaggagaagggactggagagcctgtatataagacccatgaaagttttcagggtagaaggtatatctgaagaaccgggagctttttactaccccatgaactgctttcactgcgacccagctccctgtgtggttgcatgccctacatccgcaatgagaaagagggagaaggacggtatagtttacgtggaacaaactctgtgcataggctgtaaagcgtgcataatagcctgcccctacggagctataactttcaatcccgctacacaaaaagtagaaaagtgcgattactgctacaaaagggttgataaaggactgcttccctcctgcgttgagaagtgtgtaacgaactgtttatacttcgttgaggtagacgaagttccaaaagaaagacacaaattaaagaggatagacgagaaactttacgaggaaatcttcagctga

SEQ ID NO: 23697 - DNA, 1197 bp, Aquifex aeolicus
atgtctttaaggtatttgagatttctgacagccggagagtcccacggtaagggtttgaccgcaatactggagggtatacccgcaaacttacccctttccgaagaggaaataaaccacgaactcaggagaaggcaaaggggatacgggcgcggcggtcgtatgaagatagaaaaggacaccgcggaaatactctcgggtgtcaggttcggaaaaaccctcggctctcccatagccctctttataaggaacagggactgggaaaactggaaggaaaagatggcgatagagggggaaccctccccttccgttgttcccttcacgagaccccgcccggggcacgctgacctctccggagggattaagtacaaccagagggatttgaggaacattttagagagggcttctgcaagagagacagctgcaagagttgcggtaggagctgtttgtaaaaagttcctctctgaatttggtataaagatcgggagtttcgttgtaagcataggccaaaaggaagtggaggagttaaaagacaaaagctactttgccaatcctgaaaaactcctttcttaccacgagaaagcggaagattcggaactcaggattcccttcccggagaaggacgaggagtttaaaacctacatagacgaggtgaaggaaaagggagagagtttaggaggagttttcgaagtttttgccctgaacgtccctccgggactcggttctcacatccagtgggacagaaggattgacggaaggatagctcaggcgatgatgagcattcaggccattaaaggcgttgagataggacttggttttgaagccgcgaggaggttcggctctcaggttcacgacgagataggctggagtgaagggaagggctacttcaggcattctaacaacctcggaggaacggaaggagggatcacaaacggcatgccgatagttgtgagagtcgcgatgaaacccataccgactttaaagaaccctttaaggagtgttgatatagaaacaaaggaagagatgaaagcaggaaaggagaggacggatatagtagcagttcccgcggcatctgtcgtgggagaagctatgctcgccatagttctcgcggatgcactccttgaaaaactcggcggagactttatggaagaagtaaaaaagaggtttgaggattacgtgaaccacgttaagagtttctaa

SEQ ID NO: 23698 - DNA, 2406 bp, Aquifex aeolicus
atgacaatgtatgtaatcaagagaagcgggaggaaagaaaaattagatatcaacaagataaggatagccattaagtttgcgtgcgaggggctgaacgttgaccccttagaactcgaagctgatgcccagatacagttcagggacggcataactacgaaagaaatacaacagcttttaataaagactgcagcggagaaagtttccgccgaaaggccggactggacgtacaccgcggcgagacttcttctctacgatctctacaaggacgttgcacacctgagaggttattctcttagggacgacctcgggaagtacaagccctataacagaaagaacttttacagttttgttaaagaatacgttgagaagggaatatacggggagtacctccttgagaattattccgaagaggacttcaataagctcgccaactacataaagccggaaagagacctttacttcacctacacagggataaagatactctacgacagatatctggtaagggacgaagaggggagagtaatagaacttccccaagaaatgtacatgctcattgccatgacacttgcagttcctgaaaaaccggaagaaagactaaagtgggcgaaaaaattttacgacgtcctttctgagcacaaagtaaccgttgcaacgcctaccctaatgaacgcgagaagacccttcacacaactttcctcctgcttcgtgcttacagtggacgatgacctctttgacatatttgacaacgtaaagaaagcgggaatgatatccaagtttgcggggggactcggggtatacctcggaaagataagggcaacgggagcacccataaggaagttcaagggagcttcttcgggagtaatccccgtagtaaagctcataaacgacacgatgacctacgtggaccaactcggaatgaggaagggttccgcttccatcactctggacatctggcacaaggacatacttgactttctggaagtaaagacaaacgttggagacgagagaaagaaagcccacgacatacaccccgcagtatcaatccctgacctctttatgaaaagactcaaaaacagggaagactggaccttgatagacccatattgggcaaggcagtacataacgagaaagatttacgacggaaagtacaaggaagtaaaaccccttcccggaagtcactactacgtaggcataaaggaagacggaactcaggatatcttagaacctaaagggcttgaggatttctacggagaggaatttgagaagtggtatcttgaacttgaggaaaacctaccttcttatgcgaagaagaaggtaaacagcttcgaactgtggaagagacttctcacggtagcctttgagacgggagaaccttacatcttcttcagggatgaggcaaacaggaagaatccaaataaacacacgggaatggtttacagtagtaacttatgccatgaaatagtacaaacaatgtctccctctaaacacgaaaagcccgtattagatccagaaaccggagagataacttacaaaaaggaggcgggagatcttccagtctgcaacctcggttccgtaaacctcggtaaagttcatacggaagaagagataaaagaagttcttccactccttgtgagaatgcttgacaacgtaatagagatgaacttctacgccatacccgaagctgagtacactaacaagcgctacagagccataggaataggagtttctaattaccactactgtttagttaagaacgggataaagtgggaaagtgaagaacaccttaagtttgcggacaagctctttgaactaatagccttctatgcactgaaaggttctctggagcttgcaaaggaaaggggcaggtacaagctctttgatggttcaaactggagcaaggggatactcttcggaagaagtgttgaggaaatagaggaaaactcaagacagaacggaaataacctgccttggagggaactcgcggaggagataaagaagtatggaataaggaacgcgtacctcctcgctcttatgcctactggttcaacttccctgatactcggggcaactccttcaatagacccgatattcgcaaggttctacaaagaggagaacatgtccgggatactccctcaggtacctcctgaggtagacaggttctactggcactacaaaaccgcctacactatagaccacgagtggaccataagggcggcggcggtaaggcagaagtggatagaccaggctcagagcctgaacctatttgtggatcctcaaaacatagacgggccgaggctttccagactctacgaacttgcctgggaactcggactaaagacgatatactacctcaggagccgttcggctatggatattgaggaatgcgaggcgtgcagtgtctaa

SEQ ID NO: 23699 - DNA, 1194 bp, Aquifex aeolicus
atgcttagaaaaaagaccttaagggacgttgacgtaaaggggaagagagttctcgtaagggttgattacaacgttccactagacgaacagggaaacatagtagacgacacgcgtataagggcttcccttcccacagttgagtacctccttgacgcaaacgcaaaggtaattttgatgtcccatctaggaagacctaaaaacagggatccaaagtacagtttggcaccggtagccaaaagactttcaaggtatataaacaaggaggtaaaactcgccccggactgcgtgggagaagaagtaaagcgaattgtaaactccatgaaagagggagacgtagttctccttgaaaaccttaggttccataaagaagaaacggagtgcgatgagaactttgcgagagagcttgcgagtctgggagaagtttacgttgcggacgccttcggaacctgtcacagaaagcacgcaagcgtgtacctcgttcccaagtttttaaaacccgccgtaatgggatttttactggaaaaggaaatcacttactttgaaaaggcgatggtagcaccccagagacccgtggtcgctatcctgggaggtgctaaagtttcctccaaactcgaagtgataaagaacctaataaggagggtagacaaactatttataggcggcgctatggcctttaccttcctcaaagctatgggctacaaggttggaaattccctcgtggaggacgacctacaggacgttgcaagggatttaatagatgttgcaaaaaagctagagattaaactctaccttcccgttgactttgtgatagggcaggaagtctcggaaaacactcccacgaaagtagtaccctggcaggagataccagacgggtggatggggcttgatatcggacccgtttccgttgaactcgtaaaggaaataatttccgatgcccagacaattgtgtggaacgggcccatgggagtgtttgaaatagacaagttcaaacatggaacaatagaggtcgcgaaattactcgcccaatcttcagccctcacgatagcgggcggaggagatacggaccacgccattcacaaggcgggagtttatcacgcctttgacttcgtctccacaggaggaggagctttcctggaacttctcgcggggaaagaactgccctgtctcgttaaccttgacgacaaggaggcttaa

SEQ ID NO: 23700 - DNA, 1029 bp, Aquifex aeolicus
atgaagtacgacgttgcgatagtaggtgcggggcccggaggctccacctgtgcctacgtacttgcaaaaaagggagttagggtcctgcttatagattcaaggaaggaagtaggctatcccgttcagtgtgccgagtttgttcccgtccagctctcttacgaatttcccgagttctttcccgaggagacaatagcacaaaaggtaaaagacatggttcactacacaccctggggggaaatcgttagtatgtactcggaaggcttcatccttcacagggaaaagtgggacaaaggaatagccaagctcgcagaaaaggagggtgcgcacttaagaacaaaaacgaagtttatcggttttgagggaaagtatttaatcctaaaagatttaaataaaagggaagtttttaaggtaaaagcggatatcgtggtcggggcggacggggcacgttcgctcgttgcaaaactcacgggagaacacactaaggaatttttaataactgctcagtacacacttaaactgaaaaagcctttaaatgaccttctcatattctttagggactacataccaggaggttacggctggatatttccgaaacaggaacttgcaaacgtaggcgtcggcgttgacctctcttacggtgtgaacgtggtagaagttctaaacaagtttgtaaaagaagttaaggactttgtagaacccgaacctatttacggaagaaccggaggttttattcccggcgaggggataaagaatcctttcaggggaaacgtgcttttggtaggagatgcgggaggattctgccaccccattacgggcggaggtatagcgaacgcggtgattacgggctcaatagctgcaagggcgatacttgagggagaccttgaagaattcgaagaagaagctctggataccttaggtccttctataaacagggctgcacagaagaggaaaaaactcatgaaggagtgggataaccttgagtggcggataccgagaacgtggatagctttcgaggagtattacaagtga

SEQ ID NO: 23701 - DNA, 948 bp, Aquifex aeolicus
atgaaagtattcataaccggagcgactggatttgttgggaggcacatcgtaagggaactattaaacagagggtatgaggtccacgctggtgtaaggaacttaagcaaactcgaaagactcttcggaaatcaggtaaagggctacatagtgaactttgacgaaaaggactctataagggaagcattaggaaaagtaaatcccgacttcgtaattcacctaataggcatactctatgaagaaaagaaaaaaggaataacttttgaaagggttcactacggccacacgaaaaaccttgtagaagtttcaaaggggttcaacgtaaagaagttcctattcatgagcgccctcggaacccacgacgaagcaccctcccgttaccaccagaccaaaaggtgggcggaaagggaagtcataaactccggtctcaattacacgattttcagaccttctataatcctggggcctgaacaaaaactcttttttgatatgtacaaaataaccaaatacattcccgtagtagcccttcccgatttcgggaattaccagttccagcccgttgacgtgagagacgtggcgtgtgcttacgcggaagcccttaaaaatcccgaaaccgacaggaagatttacgagctttgtgggactaaggttgtaacctttaaagaactccttgcggacatattctcctactgggacagaaaggttctcatgataccgatgcccaaaaagcttatgtacttcgcgggcttgattgtggaaaagataatagaaccccctcccttttcttctgaccagataaagatgatgtggaaacctaacgtgtgcggagtgttaaaagatgaggctatttccaacggaattaaatctatttgcaaaagagaacccataccttatgaagagagtttaaagtggtctctcgaaaattttgatataataattaaaggaaaataa

SEQ ID NO: 23702 - DNA, 798 bp, Aquifex aeolicus
gtgcatgctattatcttaactatgcgcgtagggatagtgggttttgggaatatgggacaggcttttgccttgtgcttttcaaaaaaactcggtaaagaaaacataatagtcacggacaaggttcaggaaaagagaaacctcgcaacggagatgggaatagcttttgcaagtgatgtaaaattcttggcggacaactcagacgttgttctcgtagcggtaaagcccaaggactcgcaggaggttttacaaaaactaaaggattacaaagggataattctcagcataatggcgggagtgagtattgagaaaatggaaaaaatcttaggaaaggataaaaagatagtaagggtaatgccaaacgtaaacgtggccgtgggaagcggtgttatggcgataaccgacaacgggaacctgagcgaagaagaaagaagtaaagtagaggaacttctgctttcctgcggaactctttaccgtatagaggaaagattatttgacgcctttaccgcacttgcaggaagcggacccgctttcgttttctcctttatagacgctctggcacttgcgggagtccatcaaggtttttcttacgaacaagccctcaggatagcccttgacacggttatgggtagtgcaaaactcttgaaagagtttcaggtaaatcctaacgagctcatagctaaggtcacctctcccggcggaacgactattgaagggataaagtaccttgaggaaaagggatttaaaggcacggttatggaatgtataaacaggacttcccagaaggcaaagaagctttga

SEQ ID NO: 23703 - DNA, 1362 bp, Aquifex aeolicus
atgtgggaattagaccctaaaacgctcgaaaagtgggacaaggagtacttctggcatccatttacccagatgaaagtctacagagaagaagaaaacctgatatttgaacgcggagaaggcgtttacctgtgggacatatacggcaggaagtatatagatgccatatcttccctctggtgcaacgtccacggacataaccaccctaaactgaacaacgcagttatgaaacagctctgtaaggtagctcacacaactactctgggaagttccaacgttcccgccatactccttgcaaagaagcttgtagaaatttctcctgaaggattaaacaaggtcttttactccgaagacggtgcggaagcagtagagatagcgataaagatggcttatcactactggaagaacaagggagttaaagggaaaaacgttttcataacgctttccgaagcctaccacggggatactgtaggagcggttagcgtagggggtatagaactcttccacggaacttataaagatctccttttcaagactataaaactcccatctccttacctgtactgcaaggaaaagtacggggaactctgccctgagtgcacggcagatttattaaaacaactggaagatatcctgaagtcgcgggaagatatcgttgcggtcattatggaagcgggaattcaggcagccgcgggaatgctccccttccctccgggatttttgaaaggcgtaagggagcttacgaagaaatacgacactttaatgatagttgacgaggttgccacgggatttggcaggacgggaacgatgttttactgtgagcaggaaggagtcagtccggactttatgtgtctaggtaagggtataaccggagggtacctcccgcttgctgcgacactcacaacggacgaggtgttcaatgcctttttaggtgagttcggggaggcaaagcacttttaccacgggcacacctacactggaaataacctcgcctgttccgttgcactcgcaaacttagaagtttttgaggaagaaagaactttagagaagctccaaccaaagataaagcttttaaaggaaaggcttcaggagttctgggaactcaagcacgttggagatgttagacagctaggttttatggctggaatagagctggtgaaggacaaagaaaagggagaacctttcccttacggtgaaaggacgggatttaaggtggcttacaagtgcagggaaaaaggggtgtttttgagaccgctcggagacgttatggtattgatgatgcctcttgtaatagaggaagacgaaatgaactacgttattgatacacttaaatgggcaattaaagagcttgaaaaagaggtgtag

SEQ ID NO: 23704 - DNA, 1431 bp, Aquifex aeolicus
atgatagagaaaaagatgttaataggcggagagtgggtagacaaagaggaaaagatagaagtaatttatccctacacgagaaaaccgataggtagggttccgaagggagacgaaaaggacgtagaaaaggcgatagagagagcaaaggaaggtttcaaagagattttttccctcaccgcttacgagcgctacgagatattaatgagggctgcccagctcctgaaggagagggccgaagagtttgcaaaaaccttggttctggaagtcgggaaaaccatcagggaagcgagaacagaggttcaaagggctatacagactcttatattttccgctgaagaggcaaagagagtaaacggggagacctttccaatagacgcccatcctaacggaaagggaaaattaggtttttacataagagtgccggtgggtatagtttctgcaataacgccctttaactttcccctgaacctttccatgcacaaggtagcacccgccttggctgcgggaaacgctgtaatccttaagccttccgaaaggacacctttaactcccttaatgcttggagagatactcctggaagcgggagttccaccaaaggcactttccgtaatacccgggtacggggacgtgggaaaagctatgactacgcacccggacgtcagggtggtctcctttacgggaagcaggaaagttggagatattatagcgaggcaggtgggtataaagaagctcgttcttgaactcggctctaactctgcgataatcctccacaaggacggaaacctcgaaaaggctgttgagaagacggttcaaggtggttacgcgatagcgggacaggtttgcatatccgttcagagggttttcgtccacgaggacctctacgatgaattcattaaaagactaaaagaaagagtaagtaaactaaaagtcggtgatcctatgaacgaggacacggatttaggccccatgatagcaccctcggagctggaaaggatacaggagtggatatcggaagctgttcaaaaaggagcgaaaattgaagcgggcgggctcaggtgtgcagaggatgagacaatattctctcccacgatagtttccttggttcctgaagactctaaactcttcaaagaagaagccttcgcccccgtggttgcggtaaatccctacaaggacatagaagaagccataaggtgggtaaactcctccgattacggtcttcaggtgggagtattcacgaacgacgtgaagctcgcctggaagtgcataaaggagatagaggcgggaggagtactcataaatgagggacccactttcagggcggatcacatgccctacggcggagtaaagtactctggaataggtagggaaggaccaaagttcgcaatagaagactacacagagataaagaccgtgatatttgacctcacatga

SEQ ID NO: 23705 - DNA, 2001 bp, Aquifex aeolicus
atgaagaggtttcaatgtccttactgcggtgtaggatgcggtctttacataaacgagaagggtaaggtgaaaggggattttgaacatcccgctaatctcggggacatctgtaagaagcccttgtatttaccgaaggtactgaataggggaaggatagcgaagcccatgtacagggaaaataagagtcacagcttcagggaaataagttgggaggaagcttacgagatactaaaagagaagctcatctccttttctcccgacgaaacttacttttatctttcgggacaacttttaacggaggatatatacgtagcaaacaagttcgttaaaggttttctcagaaccaataacgttgacgcaaactcaagactttgtatggcttctgcagttaccgcttacaaactcgcttttggttccgacggtgttccctgtacgtacgaggacgtggacgatgcggatgccttcctttttataggttctaacgctgccgtagctcatcctgttctttttaaaagggttctgaagaggaggaaggaagaagaaaaagtaattatagtaaccgtagatccgctggaaacggaaaccgccaaaaggagcgatgttttcattcaaataaaagctggaacggatacggttttcctcaactccgttttatacgttctgcataaggaggggtggatagattaccgctttatttacaactacacggagggatttgaagaggctctggaagttgccatgaaattccctccagatgtggccgccagcatttgtagcgtcaaaccggaagacgtatacctcgtagcggagctctttgcccacagtaaaaaacttatctccttctggtgtcaagggttaaatcagtccttaaatgggactatgaaaaatctggctttgataaacctccacttggccaccggaaggctcaacgaaaagggatgtcccttttccttaaccggtcaaccgaacgccatgggaggtagagaagtaggttatctcacaaacggtcttcccggatacagagatgtcaggaataaggcggacagagcatttatggagaaattctggggcgttaaaggtataaagaaagagccgggacccacaattacggaagcgatagacatgattctaaaagacagaataaagtttctctgggtggtatgcacaaatcccgcggtgtctttacccaacttagaaaaagttaaaagggctcttgagaaggttttcttagtagttcaggacgcttactggaatgacacctgcgagtttgcaaatttaatactgcccgccgcacaactgggagaaaaagaaggagttatgactggttccgatagaactgttacattttgtgagcgtttttccgagccttttggtgaatcaaagccagactggctcatatttactgagcttgcaagaaagatgggagccgaagagcttttcccttactcttctccaaaggaaatatttgaggaatttaaagcctcaaccaaggggagattgtgcgacatgagtaatttatcctacgaaaaccttcccgcaaggtggggcaaaagatggctctatgaagacctaaaattcccaacggaaagcggaaaagcaagatttcaccccgcacgggtagatgtggcagctgaagaagggatgtttatacttctgacgggaagattaaagaacaactggcacactatgacgagaactggaaagagcccggaactgttgaaaggtgaaattccaccttttgtgataatgaatcccagagacgcggaggaactgggaatagaggaaggagaggaagtgatactgagtgcaaagggaaaagaaataaccagagttgtcaggttcggaaacgtaaaaagaggacacatattcgcacctttcggttatccttccgaatacggagagcctactaatttgttaacgtccgacagaacggatccttactcaaaggagccggatcttaagtactcaggggtagatgtgtttgtaaaagtaaataggtga

SEQ ID NO: 23706 - DNA, 555 bp, Aquifex aeolicus
atggctatcgataaggaaaagatcaagcaggctgtaagactgtttttggaaggaataggagaagatcccgacagggaaggactgaaagagacccccgaacgcgttgcgagaatgtgggaagagtttgagaggatgagaaactttgacatgaagttatttgaggagttcgggggatacaacgaaatggttctcgtaaaagacataaagttttacagtctatgtgagcaccatcttttacctttcttcggtaaagttcacatagcgtacattcccgataaaaaaatctccggactttccaaactcgtgagaacggtgagagcttttgccctgagaccgcaggttcaagagaggctaaccgaagagatagcggactttctggaaaaggaactagaacccaaaggtgtgggagtagttatagaggcagaacacctctgtatgtccatgagaggggttatgtctcccggacacctcacggtcacctcagccctgaggggtgtgtttttaaaggacataaaaacgagggaagagtttttaaagctcgttaaaggcgtttaa

SEQ ID NO: 23707 - DNA, 2388 bp, Aquifex aeolicus
gtgaacgaactatttcaaacccctcaggtagaagcgggaattaaagaataccccttaatgcctttaagggacatagttatcttccccacaatggttcagcctctctttgtaggaaggcgtttctcaataagagctattgaggaggcgaacaaaaaggacaaacttatattcttagttcttcaaaaggacaaagatgtagaagaacctaaggaagaggacatatacaaagtcggtgtggttgcctacatattaagaacagttcccatagaggacgcaagagtaaaggttctcgttcagggattaaagagaggggttataaagaagctcgagtggaaagaagaccactacgtagcccaggtagacgttatagaggaaagggacatcccgcccgaaagccaaacgatagaggacaaagccctcataaaggccgtaaaggaatccatagacaaactcgtcagccttggaaaacagataattcccgacctcgtagttctcataaaggaactcgaagaacccggaaagctcgcggatatggtagcctccatccttgatataaaatcctcacaggctcaggagatactggaaactttcgaccccagagaaagacttaagaaggtttacaaattcctacaggacgaaataggactcctagaagtaaaacaaaggataagcgagatagcaagggagagaatggaaaaggaacagagggagtactacctcagacagcaactcaaagccatacaggaggaactcggagaagcaggcggaataaaggctgaaatagaggagtacacaaagaagtttgaagaagtcaaagagtgtatgcctgaagaaggggtaaaggaagtagaaaagaacataaagagactagagagactgcaccccgagtccgcggaagctggagttataagaacgtggctcgactgggttctggaccttccctggtgtacgaggactgaggacaattacgaccttgaaagggcaagggaaattttagacagagatcactacgaccttgaaaaggtaaaggacaggataatagagtacctcgccataaggaagttaactcaaggtaaagaagccccaactcagatacttgcctttgtaggacctccgggtgtaggtaagacttccctaggacgctcaatagcggaggccctcggaaggaagttcgtaaggatagctttgggaggtataagggacgaggcggaaatcaggggacacaggagaacttacgtcggggcaatgcccggaaggattattcaagccataaaacaggccggaacgaaaaaccctgtaataatgctggatgagatagacaagctcgccatatccttccagggagaccccgcggctgcactcctcgaagtccttgatccggagcaaaataagaagttcacggacctctacatagggattccctttgacctctcagaagtgatattcatttgtacgggaaacagggcggatactattcccacaccgctcctcgacaggatggaactcataatgctttcaggatactccgaagaggagaaactcttcatagcaaagaaacacttgattcccaagttaattcccctccacggctttagcccggaagagatcgagtttacggacgaggctattctggagataataaggggctacacgagagaggcgggagtgagaaaccttcaaaggcagatttccgcagtcctgagaaaaatagctgtaaagaaactacagggtgagaaaggtccgtttaatataacccctgagctcgtcagaaaactcctcggagttccgaggtacagacctgaaagggaaaagaaacctctcgttggggttgccacaggactcgcatggaccgaagtaggcggagagataatgttcatagaagccacgaagatgaaggggaaaggctcgcttgttctcacaggttcactgggagacataatgaaagaaagtgctcaggcagctctctcttacatccgctcaaaggcggaagactacggcatagatccggatatattctcacaggttgacgttcacgtgcacgttcccgagggagcggttccgaaggacggaccatccgcgggtgttgcgatagcgaccgcactcctatctctgtttacggacattcccgtgaggatggacgttgccatgacgggagaaattaccttaaggggaagagtgctccccgtaggtggtctgaaggaaaagatactcgcggcaaagagagcggaaatctacgaggtaatcctgcccgctaaaaacaaagacgaggttatggaagaactcccagagtacgtaagggaaaagatgactctacactttgtagataacttagaagaagtgttcaagatagcattagtgagagagccaaagcccctcaaagaggcgtga

SEQ ID NO: 23708 - DNA, 1095 bp, Aquifex aeolicus
atgaaaaaatacaagatagcagtactcaaaggagacgggataggtccagaaatagtggaacaagccctcagagttcttgacaaaataggtgagatttacggcgttgagtttgagtatagagaggggctaataggcggtgaggcgatagacaaaacgggagatcctcttcccgaagaaactctgaagatatgcaaagaatcggacgctatactccttggtgcagtcgggggaccgaagtgggacaaccttcctaccgataaaagaccggagaagggacttttaaggattagaaaggaactcgacctttacgcaaatctcagacctgcaaaagtctgggacgcactgatatcctcttctcctttaaaagaagaagtcgtaaaaggaacggacatgatcgttataagggaacttacctctggaatatactatggagagccgagggggatttttgaagaaaacggaaagaggtacgcgataaacactatgaagtacacagaagacgaaataaggaggatagttagaaaaggatttgaaattgcaaggaaaaggagaaagaagttaacgagcgtggataaggcaaacgtccttgaagtaagtgccctttggagacagattgtagaggaagaaaaagaaaactacccggacgttgaactggaacacctctacattgacaactgtgctatgcaactcgtaaggagaccaacaagctttgacgttatagtcacgggaaatatcttcggtgatatcctatccgacgaagcgggagttgttgtgggaagcctcggaatgcttccttctgcgagcataggggacaggtacgcactttacgagccggttcacggctctgctcccgacatagcgggtaaaggtatagcaaatccgatagccactatactttccgccgccatgatgctcaagtactcctttaacatggacaaggcccacgacctgatagagaaggcaatagaggaaacactaaatcagggctacagaacgccggatatatactctgagggttgcataaaagtcggcacgaaggaaataactgacaagattttagaaaacttagagaggttaaaagatgcgtacacttag

SEQ ID NO: 23709 - DNA, 972 bp, Aquifex aeolicus
gtgtaccccgtttggggtaccgagggttcgaatccctccccttccgccattcccgctatgaaaatcaggattggaactaggaagagtaaactcgccctgtggcaggcgaattacgtaaaagatttcttagaaaaacactggggtgttgaagtagaactcgtaaagataacaacaacgggagacaaaattaccgatgttccccttgcaaaaataggaggaaaaggactttttgttaaggagatagaaaaagcgttgctcgagggtagtatagaccttgcggtccactccttgaaggacgtccctatggttatacccaaaggtctgaaactcggagctataacaaagagggaaaacccctacgacgttttaatatcgcgaagcggaaagaaactttatgaacttccctcgggttctgttataggtacttcttctctaaggagacaggttcagataaagaaaaggagaagggatttaaaggtagaagtcctaaggggaaacgtggacactagaatgaggaaactgaaggaaggactctacgacgcagtaatcctagcatacgcaggtgtaaagaggatgggttacgaaagtgagataacggaagtgcttgaagacttcatccctgcggtaggacagggctctctcgcaatagaaatcagagaaggagataaaaggatagaggagttaataaaacctctaaacaacgaggagagttttctctgcgcaattgcggaaaggacgttcttaaggaggcttgagggaggatgtcaggttcccgtgggagcctttgctaagatagaaaacggaactcttaagatgaaagcctttatatctgacattgaggctgaaaggtatatagaagggtatagagaaggaaatcccgaggaggcagaaaaactgggactttcacttgcagaagaactcttgaaaaaaggcggggaggaaatattgaaggaaatatactcttcccaatga

SEQ ID NO: 23710 - DNA, 1164 bp, Aquifex aeolicus
gtgtttgagttttcggacaggttaaaggttctcccgccttacctttttgcagaactcgataggaagaaacaggagaagatagaacagggtgtggacgttatagacctcggtgtgggagacccggacatgcccacaccaaaacccatagttgaagctgcaaaaaaagccttagaaaatcctgaaaatcacaagtacccttcttacgtagggaagtacgagttcaggaaggcggttgcagactggtacaagagaaggtttgacgttgatcttgatccaaacaccgaagttataacccttatcggttcaaaggaagggatagcacactttcccttagccttcgtaaatcccggagacatagttctctgtccagaccctgcgtatcccgtttacagaattggagcaatatttgccggaggaactccatacacggttcccttaaaagaagagaacaacttcctccccgaccttgattcaattccagaagacgtggcgaaaaaggcaaagattatatggattaattaccctaataaccccacttccgcaccacctacccttgagttttacaaaaaactcgttgactgggctaaggagtacaacgttataatagcctccgacaacgcttactccgagatttatacgggacaggaaaagcccccttccatactccaagttcccggagccaaagacgtagccatagagtttcactccctctccaaaacttacaatatgacgggatggcgtataggcatggctgtagggaataaggaactcgttgcgggattaggaaaggtaaaaacgaacgtggacagcggtcagttcggagctgttcaggatgcgggaatagtagccctgaacctgcccgaagaagaggtggaaaagataagggacgtttacagggaaagaaagaagataatgacggaagcccttgaaaagataggactcgagatttacaggagcgattacaccttctacctctggataaaagtaccggaaggatacacttccgcagagttcgtgggaagactcatagacgaggcgggtatagtttgcacccccggaaacggtttcggagagtacggagagggttattttaggatttccttaacagttcccaccgagagactccttgaggctgcggaaagaattaaaaatttaaaactgtaa

SEQ ID NO: 23711 - DNA, 1779 bp, Aquifex aeolicus
atgtgcgggatagtcggatacgtagggagggatttagcccttcctatagtcctcggagctcttgagagactcgaatacaggggttacgactccgcgggagttgcccttatagaagacgggaaactcatagttgaaaagaagaagggaaagataagggaactcgttaaagcgctatggggaaaggattacaaggctaaaacgggtataggtcacacacgctgggcaacccacggaaagcccacggacgagaacgcccacccccacaccgacgaaaaaggtgagtttgcagtagttcacaacgggataatagaaaactacttagaactaaaagaggaactaaagaaggaaggtgtaaagttcaggtccgaaacagacacagaagttatagcccacctcatagcgaagaactacaggggggacttactggaggccgttttaaaaaccgtaaagaaattaaagggtgcttttgcctttgcggttataacggttcacgaaccaaacagactaataggagtgaagcaggggagtcctttaatcgtcggactcggagaaggagaaaacttcctcgcttcagatattcccgcaatacttccttacacgaaaaagattattgttcttgatgacggggaaatagcggacctgactcccgacactgtgaacatttacaactttgagggagagcccgtttcaaaggaagtaatgattacgccctgggatcttgtttctgcggaaaagggtggttttaaacacttcatgctaaaagagatatacgaacagcccaaagccataaacgacacactcaagggtttcctctcaaccgaagacgcaataccctttaagttaaaagacttcagaagggttttaataatagcgtgcgggacctcttaccacgcgggcttcgtcggaaagtactggatagagagatttgcaggtgttcccacagaggtaatttacgcttcggaattcaggtatgcggacgttcccgtttcggacaaggatatcgttatcggaatttcccagtcaggagagaccgctgacacaaagtttgcccttcagtccgcaaaggaaaagggagcctttaccgtgggactcgtaaacgtagtgggaagtgccatagacagggagtcggacttttcccttcacacacatgcgggacccgaaataggcgtggcggctacaaagaccttcaccgcacagctcaccgcactctacgccctttcggtaagggaaagtgaggagagggaaaatctaataagactccttgaaaaggttccatcactcgttgaacaaacactgaacaccgcagaagaagtggagaaggtagcggaaaagtacatgaaaaagaaaaacatgctttacctcggaaggtacttaaattaccccatagcgctggagggagctcttaaacttaaagaaatttcttacatacacgcggaaggttatcccgcaggggagatgaagcacggtcccatagccctcatagacgaaaacatgccggttgtggtaatcgcaccgaaagacagggtttacgagaagatactctcaaacgtagaagaggttctcgcaagaaagggaagggttatttctgtaggctttaaaggagacgaaactctcaaaagcaaatccgagagcgttatggaaatcccgaaggcagaagaaccgataactcctttcttgacggtaatacccctgcaactctttgcctactttatagcgagcaaactgggactggatgtggatcagccgagaaatctcgccaaaacggtcacggtggaataa

SEQ ID NO: 23712 - DNA, 2580 bp, Aquifex aeolicus
atggagaaatctgagaaagagctcactcccatgctctcacaataccactacttcaaaaatcagtaccccgactgtttgcttctcttcagactcggagacttttacgagctcttttacgaagacgcttacataggctctaaagaactgggacttgttctcacctcaagacccgcgggaaagggaaaggaaaggatacccatgtgcggagttccctaccactccgcaaactcctacatagctaaactcgtaaacaagggatacaaagtagccatatgcgagcaggtggaggatccttctaaggcaaaaggtatcgtaaagagggaggtagtaagggtaatcactcccggaactttctttgaaagggacacgggaggactcgcatcactctacaaaaaaggaaatcattactacgtaggttatctaaaccttgcggtaggggagttcttgggagctaaggtaaagatagaggaactccttgaccttctctcaaagttaaacataaaagaaatactcgtaaaaaaaggggaaaaattaccagaagaactggaaaaagttttgaaggtttacgtaagcgagctggaagaggagttctttgaagaagggagtgaagaaattttaaaggatttcggggttttgagccttcaagccttcggttttgaagaggacacttattcccttcccttgggagctgtttacaagtacgcaaaaacgacacaaaagggctacacacctctcattccgagaccaaaaccttacagagatgaaggcttcgtaagactcgacataaaagcgataaaagggcttgaaattctggaaagccttgagggtagaaaggacatatctctcttcaaggtaatagacagaaccttaacggggatgggaaggaggaggctaaagttcaggcttctttctccctttcgtagcagggaaaagattgaaaggatacaggaaggtgtgcaggagttaaaagaaaacagggaagcgcttttgaagataaggcagatactggagggaatggcggacctagaaagactcgtttccaagataagctctaacatggcaacaccgagggagctcgtttacctcaaaaactccctgaaaaaagtggaagaactcagactcctccttttggaattaaaggctcccatcttcaaggaaatcttacaaaactttgaagacacaaaaaagataataaacgacatagaaaagacgctcgttgaggaccctccccttcacgtaaaagagggcgggctcataagggaaggtgtgaacgcgtatcttgacgaactcaggttcatcagggacaacgctgaaacttacctcagggagtacgaaaaaaaactgaggcaagagacgggcatccagagcctgaagattggctacaacaaggttatgggctactacatagaagtgacaaagccaaacctaaagtacgtcccttcctacttcaggagaaggcaaactctttctaactccgagcgtttcaccacggaagaactccagagacttgaggagaaaatactttccgcccagacacgcataaacgaccttgagtacgaactctataaagagctcagggaaagagtagtaaaggaactggacaaagtaggaaacaacgcaagtgcggttgcggaagttgacttcattcagtcccttgcacaaatagcttacgagaaggactgggcaaaaccccaaatccacgaaggttatgagctgataatagaggagggaaggcatcccgtaatagaagagttcgtagaaaactacgtccctaacgacacgaaattggacagagactccttcatacacgtgataacaggtccgaacatggcgggcaaatccagttatataaggcaggtgggagtcctcacactcctttcccacatcggtagttttatccctgcaaggagagcaaaaatacccgtcgttgacgccctatttacgaggataggttcgggagatgttctggctttaggagtttcaacctttatgaacgagatgcttgaggtttctaatatcctgaacaacgcaaccgaaaaaagtttagtaatcctggacgaggtgggaaggggaacttccacctacgacggcatagctatatcaaaagccatagtaaagtacataagcgaaaagttaaaggcaaaaactcttctcgccacacactttctggaaataaccgagctggaaggaaaaatagaaggagtaaaaaattaccacatggaagtggagaagacccccgaaggaataaggtttttatatattctcaaggaaggaaaggctgaaggcagtttcggtatagaggtagcaaaactcgcaggacttcctgaagaagtggtagaagaggcgaggaaaattttaagagagcttgaagaaaaggaaaacaagaaggaggatatcgttcccttgcttgaggaaaccttcaaaaaatccgaagaggctcaaagacttgaggagtacgaggaaataatcaaaaagattgaagaaatagacatagggaacacaactccccttcaggcactccttatacttgcggagctaaaaaagaagtgcagtttctctaaaaaggagtccggagcttga

SEQ ID NO: 23713 - DNA, 1017 bp, Aquifex aeolicus
atgccgaaaaacgacctccttttgagaagcctccgcggagaacccatagggcgatttcccgtctggttaatgagacaggcaggcaggtacatgcctgagtacaggaaaataaggaacagagttaaaaactttcttgaactctgtaaaaacgtagaccttgccaccgaaatctcgctccttcctttaaaaattcttggtgttgatgcgataatcatcttttccgatatcctcgttcccttggaacccttaggtgtaaaggtcgagttcgtagagggagaaggtccgaagctctcttggagcggaaaggtttctgatttgaaaaagtacgacccgtctcaaaacgcatacgtttacgaaattattaaaagggttaaggaagctcaggacgaagttcccgttataggttttgccggagcaccctttacactcctctcgtacctgatagaaggcggggcgagcaaagacttcaaaagtactaaactctttatgtgggaaaatcccaaggagtacaaaaggttgatggacatacttacggaaactgtactggcttacttgaaggaacagataaaggctggagcggatgtggttcaaatattcgatagctgggtcaacaacctgagccttgaggattacggtgagtacgtttacccttacgtgaattacttaatttctgagctgaaagacttttcggatacacccgttatatacttcttcagaggttcttcctcatttatagacctggcggtggactacagagctgatgccctttctgtggactggagcgttgatatacccgaactctttaaaatctacgataaaggctttcagggaaatcttgaacctgcggttctgtacgcaagcgaggaggttatagaagaaaagactttaggactcctcagaagaattcccgtaaaaactaggtacgtttttaacttggggcacgggcttgcccccgacatggaacttgagaaagttaagtacctcgtggatctggtcaagtcctttcctttaacataa

SEQ ID NO: 23714 - DNA, 744 bp, Aquifex aeolicus
atgagaagattaatagccgcaaactggaagatgaacaaaacggtaaaggaaaccgaagagtacattaacaccttcctgaagttcgttgaacaccccgaaagcagggagatactcatatgtcctccttttacttccctctacgttgcgggtaaaatgcttcagggaacgggtgtaaagcttggagctcaaaactgtcactacgaaaagaggggagcctttacgggagagatatcaatacccatgctccaagaagttgggtgtgagtacgtgatagtgggacactcagagagaaggcacatattcggtgagagtgacgagttaattcacaagaagatagttgcgtgcttagagatgggaataagacccattttatgcgttggggaaaagaaagaagagagggaagctgggatgacctttaaggtcattgaaacacagataaaactcgcactcacaggtgtggaagagcatacggataaaatagacatagcgtacgaacccgtgtgggctatcggaaccggaacacccgcaacccccgaagatgctgttgaggttcacaccttcataaggaacttaataaaccagctcaatcccaaaaacgaagggaagacccgtatcctctacggaggaagtgtaaacccacagaacgcaaaagagttcatgaaacacgaagagataaacggactactcgtaggaactgcaagcctagaccctgaatcctttgcgaagatcgtatactccttttaa

SEQ ID NO: 23715 - DNA, 876 bp, Aquifex aeolicus
atgaggagcttgataagttctttggacctgacgagggaagaagtagaggaaatactaaaatacgcaaaggagttcaaggaaggaaaagaagaaaccataaaagcgtccgcggttttgtttttctccgaaccctccacgagaacacgcctatcctttgaaaaggcagcaagggaactggggattgaaacttacttagttagcggttcggaaagttctacggtaaagggagagagtttctttgatacgttgaaaacttttgagggactcggatttgattacgttgtgttcagagtgcctttcgtgtttttcccttacaaagaaatcgttaaatccttgaacttgagactcgtaaacgcaggggacggaactcaccagcacccttctcagggacttatagacttcttcacaataaaagagcacttcggagaagtaaaagacttaagagtcctttacgtgggtgatatcaaacacagcagagtttttcgttcaggagctcctcttttgaacatgtttggtgcaaagataggagtttgcggaccaaaaacgttgataccgagggacgtggaagttttcaaagtagacgtttttgacgacgttgataaaggcatagattgggcagacgtggtcatatggcttagacttcaaaaggaaagacagaaggaaaactatattccttcagaaagcagttatttcaaacaattcggtctaacaaaagaaaggtttgaaaaggtaaagctctacatgcacccgggacctgtaaacaggaatgtggacatagaccacgagcttgtctatacggaaaaatcccttatacaggaacaggtaaagaacggtattcctgtgaggaaggctatatacaaattcttatggacctag

SEQ ID NO: 23716 - DNA, 1116 bp, Aquifex aeolicus
atgcggaaaactgccattttggcgcttgaggacggttcttactttgtcggttattcctttggggctgaaggagaaacaggcggagaactcgtattcaacacatccatgacgggatatcaggaaatcctcacagacccttcctacaagggacagatagtcgtaatgacctacactcagataggaaactacggcgtgaacgatgaagatattgagagcaaaagcgttcaggtgaacggatttgtagtaaaggaagccttcttcaggtactcaaactggagggcaaaaaagagcttagacgaatacctgaaggaaaacaacgtagtcggaatatacgggatagacacgagggcacttgttaaaaagataagggaaaaggggagtatgaaaggtgttatctcaacggtggaaaaagacccaaaaaagctcgttcagaaggcaagagaactgcctgacatttctgaacagaacctcgtggaagaagtttccgctaaagatatttactactggaatcagggagattatgacccgaggagaggattcctatacagagaaaatgaaaaacctctcgtagcggtaatagactttggtgtaaagtttaacattttaaggagactcgttagtgaaggggcaaaggttgtcgtagttcctcccgaaaatgcaaaagaagccattgagaagataaatccagacgctatatttctatcaaacggtcctggggatccagaaagagttatatcaggaataagactcactcgcgagtacatggaaaagaaacccataatggggatatgcttgggttgtcaaattatcggtcttgccctcggcgggaaaacctataaactcaagttcgggcatcacggaggaaatcatcctgtaaaagacctaagaacgggaaagatagagataaccgctcagaatcacaattttgcaattgaccctgaaagcttgccggaagatgttgaagttacccacttaaatctcctggacaacactgttgaaggaataaaacacaagcaccttcccatattcgccgttcagtaccaccccgaaaactctcccggccctcatgactcttactacttatttaaagaattcgttaaaatggctcagggatga

SEQ ID NO: 23717 - DNA, 1122 bp, Aquifex aeolicus
atggacaggcttgaaaaagtatcacccttcatagtaatggatatcctagctcaggcccagaagtacgaagacgtagtacacatggagataggagagcccgatttagaaccgtctcccaaggtaatggaagctctggaacgtgcggtgaaggaaaagacgttcttctacacccctgctctgggactctgggaactcagggaaaggatatcggagttttacaggaaaaagtacagcgttgaagtttctccagagagagtcatcgtaactaccggaacttcgggagcgtttctcgtagcctacgccgtaacactaaatgcgggagagaagataatcctcccagacccctcttacccctgttacaaaaactttgcctacctcttagacgctcagccggttttcgtaaacgttgacaaggaaacgaattacgaagtaaggaaagagatgatagaagacattgatgcgaaagcccttcacatttcctcgcctcaaaaccctacgggcacactctactcacctgaaaccctgaaggaacttgcggagtactgcgaagagaagggtatgtacttcatatccgacgagatttaccacggactcgtttacgaaggtagggagcacacagcacttgagttctctgacagggctattgtcataaacgggttttctaagtacttctgtatgccaggtttcaggatagggtggatgatagttccggaagaactcgtgagaaaggcggaaatagtaattcagaacgtatttatatctgccccgacgctcagtcagtacgccgcccttgaggcttttgattacgagtatttggagaaggtaagaaaaacctttgaagagaggaggaacttcctttatggggaactgaaaaaactcttcaagatagacgcgaaacctcagggagctttttacgtatgggcaaacataagtgattactccacagatagctacgaatttgctttaaaacttttaagggaggcgagggtggcggtaacgcccggggtggactttggaaaaaacaaaacgaaggagtatataaggtttgcttatacgagaaagatagaagaacttaaggagggcgttgaaaggataaagaagttcttagagaagcttagctga

SEQ ID NO: 23718 - DNA, 1479 bp, Aquifex aeolicus
atgagtgttgttatttcaatagatgtagggacaactagagtaaaagttatcgcattttcaaaaaatggaaaaatagttgcaatttctgacagggaagtttcacagatatatccagaacctggatgggtagaacaagatcctcttgagctttgggaagccgttagaaagtctttgagcgaggttattcaacaggttgggttaaaggaaataaattcaattggaattacaaaccagagggaaactgttatcctttgggataaggaaaccggaagaccggtttacaacgcaatactctggcaggatttaagaactgaggatatatgtagaaaactctccgaatactctgaatacataaaggaaaatacaggccttctcttacatccttatttttccgcaagcaaagtaaactggataatagaaaacgtaaacggggtaaagaaagacattgagaggggaaaggtaatatttggaacagttgatacgtggattctctggaacttaacaggaggaaaggttcacaaaactgaaccgagtaacgcttcaagaacccttctattcaacattaaaagacttgaatacgatgatgaactgttaaaaatattcaggatacctaaaaatatactcccggaggtgaatgaaagttcttcccttttcggatacacggataaaagtattacaggtgttgaaatacctattacaggaattctgggtgatcagcaggcctcacttttcgctcacggaataagggaattagaggaggttaaaaacacttatggaacaggtttattccttatgcttttaacgggaagtaaaccgataatacccgaaaggttacttggaacagtagcctgggttataaatggtaaggtaaattacgcaattgaaggaagtgtactgaccggaggagcctgtataaagtggttaatggacaggcttaaattaataaagcaggctgccgatacggaatacctggcaaaatccatcagctcaaatgaaggtgtttacttcgttccagctttttcgggtcttggagctccttactgggatgcgtcagcaaggggaataataatagggattacgggaaggacaagaatagaacacatagcaagagctgcattagaagcaatagcgtatcaaacaagggatgtaattgaagaaatggaaaaggaaacgggagtgaagataaaaatcttaaaagcggatggaggagcttctcagaacaatttcctaatgcagtttcaggctgacattcttggcatacctgttgaaagacctaggcatgtagaacttacagctctgggagcggctggaattgcaggtatatactcaggaatgtggaagagtaaagaggaattcattgaggatacaagggaagttgaattaactttcagtccagaaatgaaaaaagaggaaagggagctttactactccaagtggaaggatgctgtaaagagagccatgaaatggagtatgttatga

SEQ ID NO: 23719 - DNA, 1281 bp, Aquifex aeolicus
atgtcaaggataaaaagggttcacggaagagaagttcttgactccagaggaaaccctaccgttgaggtggaggtggaattagagagcggagccctcggaagggctatagtcccgagcggtgcttcaacgggtgaaagggaggctttagagctcagggacggagaccccaaaaggtatctggggaagggagttttaaaggcggttgacaacgtaaacggagttatagcaaaggcactggtgggacttgagccctacaaccagagggagatagaccagatacttatagaacttgacggaacggagaataaaagcaaacttggggcgaacgccatcctcggaacgagcatggccgtggcaagggctgcggcaaacgaactgggaattcccctatacgaatacctcggagggaagttcggttacagacttcccgttcccttgatgaacgttataaatggtggagcccacgcggataacaacctagacattcaggagttcatgatcgttccggtgtgcggaggagctttcagggaagccctgagggcaggagtggagaccttccaccatctcaagaaaatactgaaggagaagggatactcaacgaatgtgggagacgagggcggatttgctccgaacctaaattcctccgaggaagctttagatatactaatgcaggctatagaaaaggcgggctacaaacctggtgaggacattctcctcgcacttgacgttgcatcttcagagttttacgaaaacggagtttacaagtttgaaggaaaggaaagaagtgctgaagaaatgatagagttctacgaaaagttaatacagaagtacccgataatttcaatagaagacccgatgagtgaaaacgactgggagggctggaaggagataacaaaaagactcggggataaagttcagctcgtgggagacgacctcttcactacaaacccgaaaatcttgaggaagggtatagaggaaggagttgcaaacgcaatcttagtgaaactgaaccagatagggactgtttctgaaaccctggacacggtaatgctcgcaaaggaaagaaattactcagcaataatctcccaccgttccggagaaacagaagacaccttcatctctcaccttgcggtggcgacgaacgcgggtcagataaaaacgggttctgcttccagaacggacaggatagcgaagtacaacgaactgttaaggatagaggagagactgggaaatggagcagtcttctggggaagggaagagttctacaggttcacttcctaa

SEQ ID NO: 23720 - DNA, 1296 bp, Aquifex aeolicus
atgagttcgggagacacagagttaagaaaaaggattgaatttataatcttcggcggaaccggggatctgagcagaaataaattaattcccgcaatcctgaaactgaaagacaaaatagatttaaagaagatttacattttaggcaggaataggaaaaagtttgaagaaataaaagaaaagtttaaggatttttcagagttattcgtgttcgtagaattcctcgcggagagggaagagagttataaaaatatatcaagtattttaggaaaagaatctttaaaagttttttaccttgcggtacctcccgacctattcaaggaaattctagaaaacgtaggaaaatacctgaactttccagaaaaacgtattgttattgaaaaacctttcggcctcagcttaaagcacgcaaaggacttaaacaaaataatttccgtttatttcaaagaagaagaaatcttcagaatagatcactacctcggaaagccgcaggttcaaaatatactcgcctttaagttctcaaattacgtgttttccgaagtcttaaacaagtgtcttgtagagaaggtggaggtaattgcccttgaagaggtgggagtagagggcagaaaagcttattacgagaaagtgggagtcataagggacatgctacagaatcacatgttgctcctctcctctttaatcgttatgagactccctccaagggcggaggacttccactttgagctgaagaacgccttaaagcgtgccgagtttgagtccgagagcttgatactcggaaagtacaaaagttatcaaggaaaagctcccacttttgcccttgtaaaactccactttgacgacgagcgtttcaccggagtgcctttcgtactcgccacgggaaaaaagttaaagaaaaaattgacgagggtgtgcatccactttaagaacttcccgaaggagattgaacggcttctcggctgcgttcctgagagaaatttactcgtttttgaactctatccagagcaggaagtttcctttagggtaaacgttatatctccacttggctttttgaggtgtacggaaagtattaactggagagtttccctcaaagacgttctgggagaaattcccgaagcttacgagtccctccttctggacgtcataaggggagacaagacgctctttctggacgcagaggagacggagatactctgggaaaaaacagaacctctattgaaaaaagaaaaggaagttttgacttacgatgacagagtccttattccagaatttgcagaggatttcatttcctgcctttga

SEQ ID NO: 23721 - DNA, 1500 bp, Aquifex aeolicus
ttggagcagggatataggacaattagcaggaagacccttcgacctttacagaaagatatacgaaaaattacctttctatgtaaagcagaatgcagcagaaaaagaataatacaatattccattatgattaagttcgggacggatgggtggagggcaaggatagcggaagagtttaactttgataatgtaaggagagttgcaaaggcgcacgcggaagttttaaaggaaaaaggggtaaaacgtgtaatagtcgggtacgactggcgttttcgttctgaagattttgctaaagctgtttacgacgtatttagaagtgagggacttgaggcgaaactagttggaagtgcctgtactacgcctatggtttctttcgctgtaaagtatctcggatatgaaaacggggttatgattacggcttctcacaatccaccggcttacaacgggtacaagattaaagaaagtttcggaggttccgcaactccggaatttgtaaaaaacgttgaagaaaaagtcaaggatatagaaagtgtagagataaaagagttcgagcccgaatatcaggaagtcaggaaaaagtacgtggaaaaaataagggaattcttcgatatggatttattcaaagagaagaaaacgcttgtagttcacgattccatgcacggcacgtcttctggacttctcgattttgtactcagggatacgaaggtcagcgtaataaacataaggaaggatagagatcctctctttgggggacatccacctgagccgatagagaagtatatggaaattacaaaagagaaagttagggctcttggtgcggagctcgggattgcaaacgacggggacggagacaggatagcacttgtggacgataagggaaattacgtaaacacccagctcatatacgcaatgctcctcctccaccttcttgaaaataagggaaagaggggaaaagtggtaaagacggtttcaacaacttatctggcggacaggatctgtaaggagtttggagttccgttaatagaagtcggagtcggttttaaaaacataaacgaaataatccttaaagaaggaggagttatattcggaggagaggagtcaggaggctacggtatacctgaataccttccggagagagacggaatattttctgctctgaacattttagaactcctttatcttaaggacaaaaaagtctcggaggttgttgcggagatattcgaacgtttcggagaggcgtattacaagagggtggatttgagagttaaggaaaagataaagggaagaataaaagagctgaaggaaaatccgccggaaaggataggggagtttaaggtaagggaagtgaaaactatagacggtgttaagtttgtgtttgaggacgattcttggcttcttatgagaccttcgggaacggaaccgctaataagggtttacgcagaaactccaaccaaggaagaggtggaaaagattatccagaagggtttagaactcttaaaataa

SEQ ID NO: 23722 - DNA, 537 bp, Aquifex aeolicus
atgaaggagataaggggaaagaagttaaaacttctcttgaaggaagaggacataaagagaagggtaaaggaactcgctaaagagattgagagctcttattcctgggaggagcccatagtcgtggtcgggctcctcaagggcgcttttatattcttggcagacctagtcagggcttttgacaggttcgtgttcgtggagtttatgcaagtctcaagctacggtaagggaatgaagagttctggaacgataaagatagtaaaggatttagatatggacatagaaggaaaggaagttctcctcgtggacgacatactagacaccggactcactatgaaagaaattcacgactaccttctgatgaagaagccgaaagttttaaagacgtgcgtgtttttagacaaaaaggagaggaggaaggtggattttaacgcggactttgtaggttttgaagttccagataaatttttagtgggatacggattggattggggagaatacgggagaaacctccccgaagtttacatggtagaagattga

SEQ ID NO: 23723 - DNA, 693 bp, Aquifex aeolicus
atgttatttatgcatttgaagttgaaggtcttcaggtataaccccgaaacgggagagaggaaatacgattactttgaagttccatacgaagaaggaatgacgttcttaagggcttttcaaaagataaaggaagagatagatccgagcttttcttttagggctttttgcagagcgggaatttgcggaacgtgcaccgtttttatagacggatttccaaagcttgcttgcaaagagcaaacgctcccttacgtcctttcggaacaaattgtaaccgttgagcctctcgataaattcgaggtgataagggacctcgtcgtggacaacgaagaagtcataaacagaatgaagaagttcagaacgtggataaaggagtatcagggagaggtaagaataccacccgaagtcaataaaaagatagaaaagggggcggactgcatactctgctccgcctgccagtcctactgccctcaggttctggaagaggaatacgccggtcccttattttttgcaaagatatacaggtttttggaggacccaagagaagaagacaaagaattcaggataaaagaagcccttgaaggacacctttaccactgtctttcgtgtaacaagtgtaacaacgcgtgcccgaaggaagttgagcctgcaacacttataagggaattgatgcttgtgaaaagcgaaatatcttaa

SEQ ID NO: 23724 - DNA, 948 bp, Aquifex aeolicus
atgctatccgaagaaagggtaaaggaacttcttaaaaaactcaaagatttaaaaatcctcgtggtgggagacgtaatccttgacacctacctttacgggaatgtggagaggatttcgcccgaagctcccgttcccgttttggaagtagaaggggaagagttcagactgggaggagccggaaacgtagcgaaaaacttatcttctttaggcgtggagacttacctttgcggtgtagtaggaaaggacgaagcggggaaaagattaagggaattaatagagggaaattccataaggagttttttaattgaggacgagagaccaacgaccaagaaaactagggtggtatcgagaaaccagcaacttcttagaattgattgggaagacaggagctacatttccggaaaagcccttgagaaaattctggacgttataaagaacttgcaggttgacgggataatcgtttcagactacgccaagggcgttatcacggaagaggtaataaagactatcagagagaaaggcgttttttactcagtggacccgagaccaaagcacagggaactctacagaaaagcatatcttatgacacccaacgaaaaggaattgagagaaatgtcaaaatttgaaggaagtgttgaagaactcggtaaaaaattaaaagaggagctggaacttgaaacgcttatagttacccgcggggaaaaagggatgagtttatttacggagaaaggagttaagcactttccagctagggcgagaaaggtttacgatgtcacgggagcaggggacacggtaattgcaagcataacagcctttaaactcgcgggggctacatgggaggagtgttgtgaactcggaaacgtgtgcggcggtatagtggtgggtgagtttggaacggcaaccgtcacaccggaaaaactcctgaaagccgtaaaactaaattcttaa

SEQ ID NO: 23725 - DNA, 816 bp, Aquifex aeolicus
atggaagactttaaatcgggagaccttatactcggttactacaaggttctggaaaagctaggagaagggaatttcgggaaagtttacaaggttgaagctctgaaagggaggtataaaggaaaagtctttgccctgaaggtagcttccaacccttactcggttcactacctctggaaggaagcccagaccttaatcctctttcaccaccagaacatagtttcccttcagagttatctctacaaaaaggataaaaaggaactctacctcatatacgagtacatggacttcgggacgttaaaagattacgtggagaaaaaggggaagctctcccctgaggaagccctgaaagttttaaggcacgtcgttaacgcccttgaatacctccactcaaggggatacatccacagcgacctcaagccggagaacgtattcggtaaaagggttctgggtggagttttgtggaagctcggagactttagcctagtcaggataaggggcgacgtttctataatagatgtgaaaggaactatcggttttatagctcccgaaattttcaggggagaaattcacaggagcagcgatatatactctctcgggtgtctaaccctttacatgctaacgggcaaggttcccttcgaagggaaagattttaaagagagaaaggaaaagaacaaaaggggagaggttgagattcccgaggaaattccgggtaaactaaaggatttactggagagaatgctggaagtggattacaaaaggaggttcagaaccgcaagagaactgaaagagtacatggttaaggagggcttgatttga

SEQ ID NO: 23726 - DNA, 1716 bp, Aquifex aeolicus
atggaaattaagaaatacgacgtagtagttatcggcggcggtggtgccggactgagaaccgcaatagaagtggcgaaagatccgaatataagcgttgctctcgtttcaaaggtttacccgacccgttcccacacgggagccgcacagggcggaatgaacgcagctctcggaaacgtaatccccgacgacagccctgaagttcatgcctacgacacgataaagggttccgactttttggcggatcaggatgcggttttctttatgaccgaaaaagccccggagattatatacgagctggacaggtggggagttcccttttcgagactgcccgacggcagaattgcccagagacctttcggtggggcttccttcccaagaaccgtgtttgctgcggacaaaacggggcacgttctccttcacaccttatttgaacaggcacttgcaagggacaacattacctttttcaacgagtactttctcctggacctcatccacgacggagagagggtaaagggtgtaacgatttacgatatcaggaacggtgaagttttatttttacaagcgaaggctgtagttcttgcaactgggggttttgcaaggatttactggttcaggagcacaaatgcaataggaaacacgggagacggacaggcggtagccctgagagcaggagttccattgaaggacatggaatttatccagttccaccccaccggactcgcaaaaacgggaatactcttatcagaagcctgcaggggagaaggcggatacctccttaacaaagaaggggaaaggtttatgaagagatacgctccagacaaaatggagctcgccccgagggacatagtctcaagggcaatagaaacagagataagagaaggaaggggagtcggcgaaggagcgagggcctatgtttacctggatttaagacacctaggagaagagaaaataaaggaaaggcttcctcaggtaagacagctcgccatagactttgaaggtgtagatcccgcaaaggaactcgttccgataagaccttctgcccactactgtatgggtggtattcacgttgagaattacaaaacctctgaaactccgttgaagggcctttacgcggtaggcgagtgtgcctgcgtttccgtgcacggggcaaacagactcggaggaaactcactcactgaactcgtagtttttggaaagtactgcggaatggctgtaagggaattcgtaaaagaaacggattttgccccagtaagcgaaagtgaaccaaaaaaatctgaggaatttatagaggaattgatgaagagggaaggaaatgaaagcttggctcaggtgcgtgcccagatgggtgaaataacctgggcaaaaatgggaatattcagagatgaaaagtccttaaaagaagcctacgatgaactctcggaactcctagaaaggtggaacaacatacctgtcgttgacaaagcaaaagtctttaacactaacctgatagaagttcttgagctaagaaacatgctcgaactcgcgagggtggttgcatactccgccctccacagaagggagtcaagaggcggacattccagagaggactatccccagagagacgacaaaaacttcttaaaacactccctcgtctattacgacaaaaacggcaatttaaagcttgaatacattcccgtaaggataacaaagtacaaaccagaagagagaaagtactaa

SEQ ID NO: 23727 - DNA, 1314 bp, Aquifex aeolicus
atgatagagcgctacaccagaaaggaaatgggcgatgtctggagtgaggttaataagtttaaaaagtggttggacgttgagatagcggtatgcagggcttgggcaaaactcggtaagatcccccgagatgccttaaaaaagatagaagaaaaaacttacgttgacaaaaaggttgttgagaaaattaaggaaaaggaaaaggtttttaaacacgacgttctggcgttcgtttctgtaatcgccgagcaggtaggagaagagggaaggtacatacacatgggtcttacctcttctgacgttgttgacacagccctcgcactcctcataagagaggcgattgacataatcctgaaggatatagacaaggtaatggaagagataaagagacttgcctttgaacacaaggataccctaatgatgggaagaactcacggagttcacgcagagccctacactttcggtctcaagatgtgcgtgtggtacgacgaaatgaggaggcaaaaggagagacttctctttgcaagggaaaatgtcctttacgggaaaatttcaggagctgttggcacttactccaacatcccacctgaggttgaaaagttagcccttgaagaactcggtcttaaaatagaacctgcatctactcaaatagtccacagagacaggcacgcccagctcctaacaaccctcggactaatagcgagttccttagaaaagtttgcaacggaaataagacacctccagaggacagaagttttggaagttttagaaccctttacgaaaggtcaaagaggctcttcggccatgccccacaagaagaacccaatacactcggaaagaatatgcggactcgcaagggttataagagccaactcaatacccgctatggaggacgtagttctgtggcacgagagggacatttcccactcttccgttgaaagggtaatacttccggactccttcatagcccttgactacatcctgaacctcttttacgaaatactgaaaggacttgtggtgaacaaggagagaatgagaaaaaatatggaactctcaaaagggctctacgcctcttcaaagatactcgtcctcctgacccaaaaagggctttcaagagattacgcctacgatatagttcagagatgtgcaatgaaggcttgggaaagcgataaaacttttaaagaaacactcttagaggaccccgaagttacgaaataccttacagaggaggaaatagagaaggctctggacccatgggagtttctgaagaacagggattacgtttatgaaaaggtttttggggatgaaatgggatag

SEQ ID NO: 23728 - DNA, 882 bp, Aquifex aeolicus
atgaccattcccgtagctcttcaaggaagggattgcttaattcaggcaaaaacggggacgggaaagacggcagcttttggacttccgatactgaattcccttaaagaaggcgaaaaggctcttatacttgcgcctaccagagaactcgccctccaaataagggacaacttcagggattttgcaaggtatctgaacgtcagaacatttgctttttacggcggaacgaaggttttcggagaccttaaagtactcagaggtggaaaagtagacgtagttatcggaacacccggaaggattaaagacctcatagagagaggagcacttaagacagatgacgtcaggtactttgtcctcgatgaagttgacgtaatgctcgatatgaacttcaaggaagatattgactttatttattctcaacttcccgaagaaaaacaggtattcttcgtatctgccactttcccgaaagaagtgagggagttgtcccacaggtacacaaaaaaacccgagtttataaaagtggaaagcagagaactggaacctcaaattgaagagagactcctcagggtttactcaataagggaaaaaatagaattacttgaagacgttttaagggacttcaacaaagttatagttttcgtaaacaggaaaagggatgccaagtttttaggagaaaagttatccacaaaaggttttagagttggggctcttcacggagatcttccacaaaggagaagggaagaaatacttaagaagttcaggagaggttttattaatgtactcgttgccaccgatgtagcctccagagggctcgatataagcgaagtggaagcagtagtgaacttccaccttccggaagatccgaagtttaccttcacagaatag

SEQ ID NO: 23729 - DNA, 1122 bp, Aquifex aeolicus
atgaggtggattgaggaggaattaaagagaattaaggaagcaaacctttacagggaaaggatactccttgagggagtaaaggatttctgctccaatgattacttgggacttagaaaacacccagaagttgtagaagaaagtataagggttttaaaggaagcaggactaggttcaggtgcttctcaactggtttccggatacacaaagcaccacagggaacttgaggaaaaacttgcggagtttaagggaactgaaagctgtgttctcttcggaagcggttttttagcaaacgtaggaacgataccggcccttgtggaagaaggagatctcgtcctgagtgacgaattaaatcacgcatctataatagacggagtaagactttctaaagctcaaaaaagggtttttaagcataaagattacgaggaacttgaggagtttttaaagaaaaacaggaaaaagtttagaagagttctaataattacggacaccgtgttcagtatggacggagatgtagcggatttgaaaagattaacacagatatgtgaagagtacgactgtatgctttacatagacgaggcgcacacaacgggaacgataggaaaaggcggacttgattactttggaatagaacacaaagagtacataatcgttatgggaacattatcaaaggctttaggaagttacggagcttttgtctgcggaacaaaattactgatagattaccttgtgaacaaagcgaggagtttaatattctcaacctctttaccgccttccgtgtgtgcaggtgctaaaaaagctattgagataatagaagaaaatccaaaattaattgagtttttaagaaaaaaagaaaaggaaattttagaaattttggaacaattttctttagattacaaatattacagcacacctataattcccataatggtttacgacgaaaaagaaacagtaaggataaaagaagaacttctaaaggaaggtgtgtttattcaagctataaggtaccccacagttcctaaaggaaaggcgaggctcagattaacagcttccttaaattacacaaggaaagatttagaatttctgaaaaatgctttagaaaaagttttaaaaggaagggcttag

SEQ ID NO: 23730 - DNA, 3471 bp, Aquifex aeolicus
atggaaaaaagggcgtacatagaaaagatagtagtggagggatttaaatcctacgggacaaaaaggaaagaaatacctctcggtgaaggatttatagcggtagtaggcccgaacggtgcgggaaaaagtaacataggggacgcaatatcctttgcactcgggcttagcagtgcaaaagcactcagggcaaagaacttaagttacttaattttttccaaaaacggtcagaaagcagatcacgcctacgtggaagttcacttcaaaaacctaggagcgtttcctgtagaagatgaagaagttgtaatatccagaaaggtttcaaaagacggaaggagcattttcaaaataaacggtcaggtagtaagagagagggatttgaaggatttcctcgcaaaagcgggtatatacgagaccgcttacaacgtggtgtatcagggagacatcgtcaagttccttaagatgactcccgtagagaggaggaaaataattgaagaaatttcgggaataggggaatacgagaggaaaaaggaaaaagccttagaagaactcgcggaagtagaactgaaaataaaggaaatagacctcatactcgaagagatatctaatcaattgaaaagactaaaggaagaaaaagaaaaacttgagaaatttaaggaactacaaaggataaagagggaaacagaagcaaaaatacttctaaaagaaaaggaaaaactcctgaaagaaagggaaagaattttaaacgaactcagctccttgagagaaagtttggaagatataactttccaaatacaggaaaatgaaaaggaattaaatgaaagagaaagacttttaaaggaagtaaacgaaaagataatgcccttcaaagaaaaagtgggaaagtttaccgcggaaattgaaaacgcagagaggagtataaaggaaaaagaaagggaattaaaagagagcgaaaatagagttaaaaatcttgaagaattaataaacaaccttttgagtgataaggaaaatcttgaaagagaggtaggaactttacaacttgaactcgaaaaactcaaagaagagtataagtctttaaaagaagttgagagggaaaaattgagagaacttgaagaagaagaagaaagactaaagataaccttcgacgaggttaaaaaacttgaagaagaaaaggagaaattaacggaaaaattgaactctcttaacaaagaaaaacaagagttagaaattcaaagagcaaacttaaaaaacaaaatagaaaggataaaggaagatataaacaagttaatatcggaaagagaagagaaaatcaaggaaattaaggaaaaggaacaggaaatcaaaaggctaaaagcaattaaaaagaaagaagaagaagagttaagaaatctcacgcaagaactcaacatttacgaaaaaagattaagcgaagtcaggaaaaaacttgaagaagtactcaaggaaaagggtgcgatagaaagggaagtaagaagtttttcggacgtttcagatgtttttaaagatattaaaggcgtttacggaagcgtaagtgaacttataagggtcaaaaatccagagcacataaccgccatagaggtagccggcgggggaaggctaaagttcatagttgtagaagacgaagaggttgcaaaggagtgcatacaacttgcaaagagaatgaacttaggaaggtttagttttattcccctgaatagagtcagggttgaggaaagacctctcaggtatccgaggacaaagggggctgtggactttgcggtaaacctcgtggagtacgatccgaagtttgagaaagtcgttaagttcgtcttcggagacacgctgatagttgaaaactttgaaagtgcaaaggcaataggtatagggaattacagaatggtaacgcttgaaggcgagctttttgaaaaaagcggtgtgattacgggaggagccgtaaagccttcgggagaactcaataaacgctactatgaagaagaactccagagactaaatgcagaagaggaaaagctcaaaaatgaagaaagcataatccagaaaaaaataagggaaataagaaacttaatttcggaaaagacagcgcttttaaaggtaagtgaaaggaaaatagaagaactatcttctgaaggcttagagcaatacgaagaaaagtttaaagaaaagctcgaaaattcaaaagaatacttaaaaatactcgaagaaaagcttttaaatgtagaagataagttaaaggaattggcggaagaaatagagtactacgaggagaagctgaataatttaaagctcaaagaaggagatataaagaggcactactccagagaaggggttgaggaaaagaggagggagtactcaaaggtaaggaaacaggtttcagaaatagaaaagtctttaaacgaaattgaaagggaactgaataaaaaaacctacgagcttgaatacttggagaaagaaatacaggaaaaagaaagggaaagagagtacctgacggaaagaataaagtctctaaagaaagaaatagaaaacttgatcctttttaaagaaaaaaccttacaggaagtaaaggaagcagaggtaaaggtttacgattacataaaacaaaaggaagaactcgagaaggaaatacttaatttaaaatcaaaactcggaaaattaaaaataaaagaagaagaattaaaagagaaaatctttgaaaaagagaaaaaccttaaggtactagaagaaaaaatagagaacttaaacgaagaacttaaagaatacgaggacttaaaactcggagcggatgaagaaagtattcccaagcttaaagagaagttaaaaagagttacggaagaaatacaaaagctggggagtgtgaacttcagggcggaggaagactacgcggaagaattaaaacgctttaacgactacaaagaaaagcaacaaaaactaaaggaagagagcaaagctataaagaagttaatagaagagacggaaaacaaaaagagaaaagtcttcttagaagcctttaaccagataaataaaagcctgaaaaggatattctcttttctctcaccgggaggtaaagctcagatgttcttggacaatcccgaagatcccttttcgggaggtgttcagttaaccgtaaaaccgagggggaaagacgtccagtacctcgaagcgatgtcgggaggggagaaaactttagcagctctttctcttatatttgcccttcaggagtacaaaccttctccattttactactttgacgaagtagacgcccaccttgacgaggttaacgctaagaaagtgggtgagttgataagagaaaagtcaaaagaagcccagtttatagtggtaaccttaagagaagttgtgacctcctttgcggataagattgtaggcgtgagtgcaaggggaggtatttccgaggttttcttccttaaaaatgaaggattggaagaaataataaaggaggcttaa

SEQ ID NO: 23731 - DNA, 693 bp, Aquifex aeolicus
atgaaggtaaagataaagcgttattcggacggtgattttcggtgggaggagtacgaagtagacggagagggaaaaacggttctggaaattttacaaaacattaaggaaatagatcctacactttccttcagggcgatgtgcagggcaggaatttgcgggacgtgtgtggtaaaggtaaacggagaacacaaactcgcgtgcaacaccagagtgtacgacgacataactttagagcccgttgatgtagctcctcccataaaggatttagtagttgaacatgaatttatatatgaaaaattaaaaaaaggaagagtctggtttgagccccttcccacgaacatacccttgaagcccgacgaactcaaaaacaccgagaagagctgggactgtatcctttgcggtatatgtaattacgtatgtccggccattcaggcggataaaaacttcgggctaccctccactttcacgaaagcttacggagttgtctttgacaagaggaataaaaaaggtctggacaaactcaaggatttggttcccctgaacatccagagctgtactcactgcaagaactgtaccttttcctgtcccaaggactgcaaccccgaactcctgataaagattctcgagaacaatatggttcaacgtggtttaatacagaggaaggagcaagattttggatttttaggattctaa

SEQ ID NO: 23732 - DNA, 1623 bp, Aquifex aeolicus
atggaactctttatagtggagtctccaacgaaggcaaaaaccattcagaagttcctcggaaaaggcttcttagttaaagccacactgggacacgtaaaggatcttcccgaaaaggaactcggcgttgacctcagaaccctgaaggcaaagtacgtatacaaaaggggaaagaaaaaactcgtggaacaactcaaaaaattgtcaagaaggtcaagtatagtctatctgggaacggaccccgaccgtgaaggggaagccattgcctactttttaaagaaagatctcgaaaaggtaaataaaaacataaagagagctgtcttttacgaaataacgccggaagccataagggaaagcataagaaacgcgggcgacgtgaacatgaacttagtttacgcccagtttgcaaggaggatactcgacagactcataggttacttaatatccccaatactctggaaggagttcaagaactacaaactctcggcgggaagagtgcagtcgcctgccctcagacttatagtggaaagggaaagggaaattcagaactttaaagttaagaagtattactacgtaaaggccttactcagaaaggggagtgaagagttttgggctatttacgattaccgctacgaaaacccctcggacgcaaaaatcatagccaaaaagctggagaagggatatttcagcgtttacaaagtggaaaagaaaaaggaaaaagtgtcacctcccaagccctttataacctccgatctccagtcagaagcaaatgcaaagttcggattttcgagtgagaggacacagaagttggctcaggaactctacgaaaagggatacataacctatcccagaacggacagctacaggatgaacgaaaaaaaggcaaaggaatttatgaactacatagaaaagaagtacggaaaggaatacgtgggaaggttgaggaggttcagggaaaaggcaaccgcgcagggtgcccacgagtgtatcagaccaacaagcctgagggaagaaattcctgaaagggaagaattgagacttctttacgacttgattttcaggagaacgatagcgagtcttatgaaagaaatgctcctggaaagggaaaaggttacggtagaggcgattacaccagaactcaagcaccctgtttacctcgtggcaaagggattgaaaatcgtctttgacggatggagcagagtttacccgagtgagataaccgaagagaaacttccagaactttacgaaggggatctattagatctcgtgaaaacgacacttgaggaaaggaagacccagccacctccgagatacacggaaggaactctcataaagacccttgagaaactgggaataggaagaccttccacctacgcaactatagtgaaaacactgaaagagagagggtacgttgaagtaaagaaaaaagctttagtaccaaccgagatagcctttcaggtcgttgaatttttaatggaaagatttcccacacttatggattacaagtttaccgcccagatggaggaaaaactcgatctcgttgaagaaggaaagctcaattggaagtctgtagtttacgagttcatggaaaagatcttcggtaaggagttggaaatggtaagatag

SEQ ID NO: 23733 - DNA, 1512 bp, Aquifex aeolicus
atggctacactgacttatgaggaagcccttgagatactaagacaacagataaaggatttcgaacctgaagccaaaatggaagaagtaggtgtagtttactacgtcggtgatggtgtagcaagggcttacggtcttgaaaacgtaatggcgatggaaatagtagagtttcagggagggcaacagggaatagccttcaacctcgaagaggacaacgttggtatcataatcctcggttctgaaacgggaatagaagaagggcacatagtaaagagaacgggcaggatattggacgctcccgttggagaaggactcgttggaagggttatcgaccccctcggaaaccccctcgatggtaaaggacccattcagtttgaataccgttccccagttgaaaagatcgcacccggtgttgtaaagagaaaacccgttcacgaaccccttcaaacaggtattaaagctatagacgctatgattccaataggaaggggacagagagagcttatcatcggtgacagggctacgggtaagaccactgttgcgatagacaccatactcgctcaaaagaacagtgatgtttactgtatttacgtagccgtaggacagaaaagagcggcgatagcgagactcattgagctccttgaaagagaaggagctatggaatacaccacagttgttgtagcttcagcatcagatcccgcatcactccagtacctcgcaccctttgttggatgtacgataggggagtacttcagagacaacggaaagcacgcactcatcatatacgacgacctgtccaagcacgcggaagcttacagacagctctcactcctcatgagaagacctcccggtagagaagcttaccccggtgacgtgttctacctccactcaagactccttgaaagagctgcaaaacttaacgacgacctcggggcaggttctctcacggcattgcccataattgaaacgaaagcgggtgacgtcgcggcttacattcccacgaacgttatctccattacagacggacagatatacctcgaagcggacctcttcaacaaaggtataagacctgctattaacgtaggtctttcggtttccagagtcggtggtgcggcacagataaaggctatgaaacaggttgcgggaaccctcagactcgaacttgctcagttcagagaacttgaagctttcgttcagttcgcttcggaacttgataaggcaacccagcaacaaatcaacagaggtctgagactcgtagaactcctgaagcaagaaccctacaacccgatacccgttgaaaaacaaatcgttctcatatacgccggaacgcacggatacctcgacgacattcccgtagagtctgtaagaaagtttgaaaaggaactctacgcttacctagacaacgaaagaccggacatactcaaggagataagtgaaaagaagaaactcgacgaagaactagagaagaagataaaagaggcgctcgacgccttcaagcaaaagttcgttccctaa

SEQ ID NO: 23734 - DNA, 1131 bp, Aquifex aeolicus
atggcttcatctactaaaaaggattactacgaaattcttggagtaccgagaaacgcttcgcaggaagaaataaagaaggcttacaggaggcttgtcaggaagtatcacccggatatatgcaagaaacccgagtgtgaggaaaagttcaaggagataaacgaggcttaccaagtactctccgatcccgaaaagagaaaactctacgacatgtacggacacgcagcctttgaaggtgcaggagcacagcagagggtagaaaccactgaaataccgccaatagaggaaatactcagggaattctttgactttgatataggaagtatatttgaaagggctacgggaagaaggagggcaaggagaaggaggagcgtaaaaggggaagacatagttgtccccgttgagattacgttagaagaagcctttaagggaactacagttcccatagaggttgaaagggaagtcccctgttccgcttgcggcgggacgggatacgacgagtcaaagtcaagaacgtgccccacatgcggtggtagaggagaaaccgttcaaggaaactggttcttccaggtaagacaaacctgtcccacatgcggtggagaaggagtgatttacgaaaactgccacgcctgcacgggcaggggatacggactcgttaaggaaacgataaaggtaaagataccgccgggagtgagggatggttcaaaactcgtagtggaaggaaagggacacgcgggaagatacggaggacctcccggggacctctacatcatagtaaaggtaaaaccccacaagatttttgaaagaaagggagacgacctgtacgttgacgtaaacataacctaccccgaggctgttctcggaacagaagtggaagttcccactttagacggtgaaaaggtaaaggtaaagataccacccggaactaaagagggagaactcataaaggttcctggaaaaggtatgcccagactgaaaggttcgggcaggggagacctttacgtcagggttcacatagacgttcccaagattggtgttcttagtaagcttcttggggacggtaaaaaggtggaagagctcttaaaacaacttcaggaagttcttccaaagcctgaaagaattgtagagaggtga

SEQ ID NO: 23735 - DNA, 2079 bp, Aquifex aeolicus
atggaagaagaaaaagtaaaagagggattgtgggagttagcttacaacctgtggtggacgtggaatccgccggctaaggaattattcagaagcattgacccgcttttgtggaaggaaactaaggaaaaccccattgagttattgaggaaaaccaaactccttgaaaacaagctcaaagacgaagattttatatctcacttcaagtacgtttattccctttacaaaacctacatgaacaggcattcgaaatacgaggatacgtataagaagcctatagttttcctgtctcccgagtacggacttcaccacacactacttatatacgcggggggactgggctttttagcaggagatatactcaaggagagcagtgacttgggatttccgcttataggtgtcgggtttatgtaccctcagggctacgtaaagcagaggataagggttgacggatggcaggaagaccttgacgcacaaaatcaaaaggaattaatgcccgttaaaaaagttctggacaaagaaggaaaatggctcaagtgctacgtttacgtaagggatgaaaaggtttactttggagtctgggaagttaacgtgggaaagacaaagctctaccttcttgacacgaacgtagaggaaaatactccctggaacagggaaatatcctcaagactctacgttccggacaaagacctgaggttaagacaacagatagttcttggttttggcaccgtaatactccttgaaaagctgggcattgatgcaggaggttttcacataaacgaagattatccctcgttcgtgttccttgcagaaatatttaaacttctaaaaaaaggtctgacctgggataaggcgatagaagaagtaagaaagatttctctctttaccacgcacacaccactacgggttgccgtaaatacttatcccttccacatgatagaggaacagtttctattcgttaaggatgtttacggaatagacgtaaagaaagttctggaactcggaacgaatcctgaagacccttcggagggttttaacagtacgattatgtccctcagactcgcaaagtacgtaaacgcagtgagtaaaagacatcaagaagtttcaagcaagatgtggagttttttatttaaagaaaaggagaatccaatagattacgtaacgaacggtgttcactttcccacatggatttgttcagatttgagaagactgtacgaggagtatttgggagagaactttgtggaacttcacgaccacaagtctctgtgggaattaataagagacatacccgacgaagaactgtgggaatatcacataagaaataaagaaagacttattgagcacataaaagacagggcaagggaaaggtgggtcaaggaaaaagcggatccttcaatccttatggccgaaggtctgttccttgattctgacgttcttacggtcggttttgcgaggaggatgaccggttacaaaagaccggatcttatattcacggatgtagaacgcttaaaaaagatagtgaatgattcggaaagacctgttcagataatattcgcgggaaaggctcatccggctgatatcgaagggaaaaagataatccagagaatatttaactttgcgaaagatccggaatttgggggaagaatagctttcgttgaagattacgacgaactccttgcccattacatggtgaggggtgtggacgtatggttgaacaaccctcttcctccccttgaagcctgcgggacaagcggtatgaaagcttctatgaacggagtgcttcacctttcaatacttgacggttggtggattgagggttataacggaaagaacggttgggctttcggagattacgaagttgaaggagacaggaacagagcggatgcggaggccatttacaacatccttgagaatgaagtaatccccctttattacgaaagggacgagaggggagtgccagttaagtggataagtatgatgaaggaagctataaaaagcattacccctaacttttgctccagaaggatgttaaaagattacataaataagttctattcaaaaattttaaaggaggagggatga

SEQ ID NO: 23736 - DNA, 1392 bp, Aquifex aeolicus
gtgagggttttattctgctcaagtgagatttacccttacgcaaaaacggggggactggctgatttttccttttgcttgataaagtatctgaaaaagtacggcgttaaagtcaagggagttatgccctactacaaaactttaaaggcggaaaacctgagaaaaacggataaaggagttactctaaatctcaacggaaaagattacacctttgaggtttacgagagtgaggactgttacttcctgagaaatgacgagctctttgggagggattacatttacggtcctccgggatgggggtatgaggacaacgatatcaggttcgggggatttagcagggctgtttcggagctgataagtactggacagctggaggcggatgtagttcacgcaaacgactggcaaaccgcgcttattcccctttttctgaaggaggtttttaaaactcccgtaaagactgtgtttaccatacacaacttagcttatcagggactatttccaaaggaaacagtagaaagggttggcatccccccttacctgtttcacatggaagcggtagagttttggggactcgtcaacttcatgaaagggggtatagtgttttcagacctgataactaccgtcagcccgacttacgccaaggaaatacaaactcaagaatacggttacggacttgagggagttcttaaaaaatactcttacaaattaaggggaattttaaacggaattgattacgaagtctggaatcctgagaaagataaatacatttaccagaattactccctgaggaattactccaaaaagttcaagaataaggaatttctgtcaaaggaactcggaattgaggctgaaaaaccattaatttccttcataaacaggtttacccatcagaagggtgttgaacttatacttaactgcgcggaagagatgtctaaactcaacgcgaactttgtattcttgggaacgggtgagtacgaaaacgcctttcttgatgtgagtaaaatctacaaaaactttaaagtgtttgccgaatttaacgaaggttttgcgaggaaactttacgcctcttcggacttcatactcatgccctcgtactttgagccctgcggactcactcagatgataggcatgaggtacggatgcgttcccatagtgagaaaaacgggaggccttagggacacggtaaaggacatttcagaaggcgggtacgggatcacctttgaagaaccatcaaaagagactttcctttgttcacttaaaagggccattgaactttacgaaaatgcgaagaagttcagaaattccgttaagatagtgatgagccttgacttttcctgcgataggatgacaaaagaatacatagagtgctatgaagaagttcagtctcatcagtga

SEQ ID NO: 23737 - DNA, 1893 bp, Aquifex aeolicus
atgaagaagttcagtctcatcagtgattacgacgtttacctctttaaggagggaacgcacacgagactttacgataaacttggctcccacgttatagaactaaacgggaaaaggtataccttctttgcggtttgggcaccccacgcggattacgtatcacttataggcgattttaacgaatgggataaaggttctactcccatggtaaagagggaggacggctccggaatatgggaggttttacttgaaggagacctgactggttcaaagtacaagtactttataaagaacgggaattacgaagttgataagtccgatcccttcgcatttttctgtgagcaaccccccggaaacgcttccgtagtgtggaagctcaattacaggtggaacgactccgaatacatgaaaaagaggaaaagagtaaactcacacgactcgcctatatccatatacgaagttcacgtgggttcttggaggagagttccagaagagggaaacagatttttgagctatagggaacttgccgaatacctcccatactacgtaaaagagatgggatttactcacgttgagttcttacccgttatggaacatcccttttacggctcttggggctaccagataacgggctacttcgctccgacttccagatacggaactcctcaggactttatgtacttaatagacaaacttcatcaagaagggataggtgtgatactagactgggttccctctcactttcccaccgatgcccacgggctcgcatactttgacgggactcacctttacgagtacgaggactggagaaagaggtggcatcccgactggaacagctttgtttttgattacggaaaaccggaagttcgctcctttctcctgagttctgcccacttctggctcgacaagtaccacgcagacggtctcagagtggatgcagttgcttcaatgctttacctagattactctaggaaagaatgggttccaaacatatacggagggaaagaaaacctcgaggctatagaattcctcaggaagtttaacgaaagcgtttacagaaattttccagacgtccagacaatagcggaggaatcaacagcctggcctatggtgtccagacctacatacgtggggggactgggatttggaatgaagtggaatatgggttggatgaacgacacactcttttacttttcaaaggatcccatctacaggaagtaccaccatgaagtcctcactttcagtatatggtacgctttttccgagaacttcgtccttccactatcccacgatgaagttgttcacggaaagggttctctgatagggaagatgccaggagattactggcagaagtttgcaaaccttagagcccttttcggatacatgtgggcacacccagggaaaaaactcctctttatggggggagagttcggacagtttaaggaatgggatcacgaaacgagtctcgactggcacctcttggaatacccttctcacagaggtattcagagattagttaaggacttaaacgaagtttacaggagggaaaaggctttgcacgaaacggatttttcacctgagggctttgagtgggtagacttccacgactgggaaaagagcgttatatccttcttgagaaaggacaaaagcggtaaggaaattatactcgtagtttgcaacttcacacccgttccgagatacgattacagggtaggtgtaccgaaaggcggatactggagggagataatgaataccgatgcaaaggagtactggggctccggaatgggaaatctgggtggaaaagaggctgataaaatcccgtggcacggaagaaaattctcactttcacttaccctgcctcccctttccgtgatctatttaaagcacgaaggatga

SEQ ID NO: 23738 - DNA, 2508 bp, Aquifex aeolicus
atgctgaaagcacattctctttcccctgaagagatattaaggattttaaagacggacaggagggggctctctgaagaggaggctaaaaagaggctaaaaatatacggaaagaacgagatagaggaagaagaggaaagtttaattaaggtcttctttaggcaatttaacaatccctttgtttacatcctgtttgttgcaagcggtatttccgcttacataggaaaaaaagaagattccctgataattcttgctattatattcgtgaactcccttctcggtttctttcaggagttcagggccataacatctttaaaggctttaaagaaattaacggaagtaaaaacaaaagtttacagagacggcaaattaaaagtaatacccgcttccgaactcgttcccggtgacgttgtctacattcaggagggagacgtagttcctgcggatataagacttattgaaagtgtaggccttatggttgatgaatcggttttaactggtgaatccgtgccggttgagaaaaacgcggacgttgttttgcctgaagatactcccgtttacaataggtcgaacgtagtatttaaaggcacgcacgttgtaaagggatgggcagtcggagtagtttacgcaacgggaagacaaacggagtttggaaagataagtgaaaaggcaaaggaaaagtccccggaaacaccattaatgagggctttgaaaaagttttcccttgcatggatggtaatcatctttttcttactctcaatccttttccttataggtatttatcagggaagagacatttacgaggttttactcctcatagtttccgagttggtatctgcagttccagagggcttgcctctcgtaataacgttcactttagtaattggtgcgattgccctttcacggagaaaggttctcataaggtaccttcccgctacggagacgcttgggagtacaacttttatatgttctgacaagacgggaaccataacagaagggaaactaaaagtccaggaattcttcgccctgaacgagaagtttttaaacctcatttctgcactctgcaactcgtcggacggcgagagtggggatccggttgatcttgctcttctcagatggcttgaagaaaacgacatagactggaagaaactgagggaagaatacagaacggttaaagttttcccctttgatacaaaaaagaggtatatggctgtaattgttgaaaaggagggcaagtattacctgctcgtgaagggtgcctttgaaactttatcaaatttttccgaaggtatttccgaagaattaataaaagttcacgacgttcttgcggaaaacggcctgagagtcctcttcttcgcttacgccgaaattccagagcctgttgaagatatagaaagcttaaaactgaaacccgctggttttgtcggatttcttgatcctccaaaagagggtgtaaaggaagcagttgtgaacgcaagaagggcgggaataagggttatcatgataacgggcgataacttaaaaaccgcagtagcagtagcgaagcaaaccgaaatatacagggaaggtgacttagccgttgagggaaaagatctttctaaatattcagatgcggaactttacaatttgttgaagagggtttctgtcattgcaagggcacttcccgaagataagtacagggttgtaaaagtccttcaggaaaaaggggaaatagtcgcggttacgggagacggtgtgaacgacgttccagcccttaaggttgccgacataggcgtagctatgggttctggaactgaagcggcaaagagtgtagctaagatggtaataactgataacaacctaaaagttatagtggaggccgttaggtgggggaggataatagtcaggaatataaagagggcgattacttacctcctcaccacaagctttggtgaaataaccttactttcttccgcaatactgatgaaattacctctgccgctttatcccactcagatactctggataaacatagttaccgacggagttcaggataaaactttccccttcaacaaagaggaaatagacgttatgaaggaaaaacctcagaagcctgagaaggtattcctggacaaaaggctttttttaagatttttaaccggaggtttattcataggatttataaacttaattctcttcaaacacctcctaagcgtttattcatatgaggttgcagtaactataacctttacctcaatggttgtcaatcaatgggctgtaggaattcagactgtaagggattaccccttcttttacaagccttggaggaatttccagatgaacccatacatatttataggcatatttataggattgatccttcagcttttggcaatatacgttttccctaactactttcacgcagttcccctctcattagaacactggttttacgtaatcttaacaacattatcagttttcatcttcatagaaataaggaaattagtttttacaattttcagtgagaggtaa

SEQ ID NO: 23739 - DNA, 1173 bp, Aquifex aeolicus
atgactaaggttgtaaattacggggaagttcagtacggttttgctaagaggtactttgaagaattcttatccgagaggaaaggaaggatagaaaagctcttgaaaccagaaaaaactccggttctccttatggacatccagggtgtgaagaaaaagtacctcgaagttaagtatcactttcccgagtttaacgtttactacgcggttaaggcaaatgacgacgaaagcgttataagggctctcgttgaagtgggagcaggatttgaggttgcctcttctcaggaacttgaaaaggttctgaggcttggaggaaaaattgaaaaagtaatttcaagtaatccagtaaaacctccagaatttatagagtttgcgtatcagaagggtgttagaaccttcgcggtggatagcataacggaagttaaaaaaattaaagatattgccccgcgttcaaaagtttacgtgaggattgccgttccgaatgaaggaagcgactggcccctttcccggaagtttggagtgagtgtggaagaagccgttgaaattctagagtacgcaaatgaccttggactcgtcccttacgggattacctttcacgtgggttctcagtgtaataacttaagaaactggttcatagcggtaaagctttctgcacaactctgggaaaaggcaagggcaaagggactaaagcttcagatgctcaacatgggcgggggaattcccgttcgttacaactacgaagctctgagcgttgaggacatagcctattacgtcaaaggactcatgaggaagtactttcctgttcaaccttatgaactgcagatagaacccggaaggggaatagtcggagatcagggaattatggtaacaaaggtaatagggaaagctaagagaggaagtgaaaactggctttacatagacactggagtttttaacggacttgcggaagcactcgggggcataaggtatcccttcttccttgaaagggaaggggaactgaaggagtggacaataggcggtgtttcctgcgacagtatggacgtagtggctaagaacgtttaccttccagaacctgaagtaggtgattacctttacatactttccgctggagcttacaccaccgtttacgcttcaaacttcaacggctttcctaaacctgaggttgttcctttttag

SEQ ID NO: 23740 - DNA, 1398 bp, Aquifex aeolicus
atggagtttgacttaataatcgtgggtgcgggtagtggaggttacgaggcggggctttacgccttcagaaggggaatgaaggtagccttcgtggaactctctccggagaccgtgggaggaaattgcctcaacagaggttgcatcccttcaaagtacatgaggcacggggcttacctccttgacaagtttcagaaaatggagcaatacggaataatttcaaagggttacgacatagagtacaaaaaactcaaagagggaagggataacgtcgtagtgaccataagggaaaactttaagaagttcgcccagcaactcagaattcccatatactacggcaaaggagttttaaaggatccaaacactgtgttcgtggaaggaccagaggaaactctgaaggctaagtacatcctcgtggctactggatcctctcctacctctgtcgggaacctcgttccggacggaaagtacgttatagacacagatcagatatgggaaatagattacgtaccaaagaaggttctaatagtcgggggcggagcagtaggggttgagttcgcatacatattcaggaagtacggaagtgaggttgttctggtagagataaaagacagactccttcccactcccgatatccccgaggacagcgggaggtacctcgccagaaagttaagggaactgggagttgatataaggacgagaacttctgtggagagctgggaaaagactcagaacggagtaaaggcaaagctcacggacgggagcgaggttgtagcggacttcatcctcctcggtgtaggaagaaaaccaaacaccaaaggaataggccttgaggaactcggtatagagatggacgagaggggattcgtaaagacgaacgagtacgcccaaacgaacattccaaacatatacgcctgtggggatataacctctcccttaatgctggctcacaagtctatgtacgagggtaaaatcgccgtttcccacatacttggcgagagggactggaagaagaacgagaggataattcccaagattatttactccgcactggaagtggcatcggtcggcctcactgaagagcaggcggaagacgaagacatagaagtaagggtgggagtagcttctttcgtttcaaaccccaaagccatggacgacggagagaatgagggatttgtaaggatagtggcggacgacgagactggtgaaatactcggatgtcacatagtcggtccacatgcgggagaactcatacatcaggtagttcacatgataaaggacggaaaaaccgtggagtttgcttcaaagactatgtactcccacccatcactttcggaaaacataggaatagcttcctcggaggtttattacggacctatatcgtgggtaaaaaggcggtaa

SEQ ID NO: 23741 - DNA, 1275 bp, Aquifex aeolicus
gtgaaggtacttgtagtaggaaacggaggaagagaacacgcaatagcgtggaaggtggcacagagcccgctagtaaaggaactatacgtagcaaagggaaacgcaggcatctgggaaattgcgaaaagggttgatatatcccctacagatgtagaaaagcttgcggagtttgcaaaaaacgaaggtgtagacttcaccatagtgggtccagaagcccccttagtcgagggtatagttgacgagtttgagaaaagaggtctaaagattttcggtcctaacaaagaagctgcaaagctggaaggcagtaaagcctttgcaaaaacttttatgaaaaagtacggtattcctacggcaaggtacgaggtattcaccgattttgaaaaggcaaaggaatacgtagaaaaggtaggtgctcctatcgtagtaaaggcggacggtcttgccgcgggaaagggtgcggttgtttgtgaaacggtcgaaaaagcaatagaaacccttgacaggttcctgaataaaaagattttcggaaaatcttcggagagagttgtaatagaggaattccttgagggagaagaggcctcctacattgttatgataaacggggataggtacgtaccccttcccacatctcaggaccacaagagactccttgacgaagacaaaggaccaaatacgggcgggatgggtgcgtattctcccacacccgttataaacgaggaagtagagaaaagaataagggaagaaatagtagagagggtaataaaaggtttaaaagaagagggaatatactacagaggtttcctttacgccggacttatgataacaaaagaaggtccgaaagttcttgagttcaacgtaaggctgggagatcccgaagctcagcccatacttatgagggtaaagaacgatttcctcgaaacgctccttaatttttacgaaggaaaagatgtgcatataaaagaggatgagaggtacgctctggacgtagtcttggcttccagaggataccccgaaaagccggaaactggaaagataatccacggtctcgattacctaaagagtatggaagacgttgtagttttccacgcagggacgaaaaaggaaggcaactttactgtaacttccggcgggagagtcctgaacgtatgtgcgtacgggaaaaccctgaaagaagcaaaagaaagggcttacgaagctataaggtatgtttgctttgaaggaatgcactacaggaaggacataggagacaaagcctttaaatacctgagtgaataa

SEQ ID NO: 23742 - DNA, 789 bp, Aquifex aeolicus
atggaaaggatagaaacctggaaagaaaaaatagaaaaaagacttaatgaaatcctgaaacccgaaggtccagaagaattaatagaagctatgaagtactatcccttacaaaagggaaagaggataagacccctctttacggttgcggtcgcaagtgctctcggagggaatgaagatgatgctataaccgttggctctggtatagaactcattcacaactactcccttatacacgacgatcttccctgtatggacaacgatgtctggagaagaggcctccctacgtgccacataaagttcggagaagcgatggcactccttgcgggagatgcactcctgacttacacctttgaggtcctatcacaaagggaaaattacaaaaccctttcctgtgaagagatacttgagataaacaaaattatcgctcaaaaggcaggttctaacggaatggtagggggacaggttcttgacataaaggggtatgaggacctctacgaggtcagtgtaaaaaaaacaggggcactctttgaagcttgctttatgtgcggagctgtggtagcgaagagaagggaaaaactcaaggagatggaaagtattggcagaaaagtaggcttactctttcaaatggttgacgactaccttgacaaagatggattttacgagaaactcggagaatgtttaaaagaagaaataaaaaaactatacgaagaactaaaagaaaaagaaattttcaaggaaagccaagaactcagataccttctagaccttatatacaagaggattacctga

SEQ ID NO: 23743 - DNA, 1533 bp, Aquifex aeolicus
atgaactactttctaaggtttgatacttctcttttacctgaagaagaagcgaaagttctaatatgcgggagcggtatcggaggtcttgctaccgcaatttctctaaaagaactcgggattgaacctctaatcttaacgcgaggtatcgggaacacttactattcccagggtgggatagccgctgcagtgctccccgatgacagcccttaccttcactactgtgataccctgagggccggaaggtacttaaaccacgaactccatacaaaactcctaacctacgaaggcatcttcaggatacttgatttagaaagatggggtgtagattttgataagaaaaacggattttacgagactactctggagggagggcactcaaaacccagagtgttgaaagtaaaagactacacgggaagggagatatatacgaaactcttgaaaaagacggaagaactaggaataaaaatccttcacggagaacttcaggaaataataattgaggagaatggggttcagggggtaatttactccgaagaaggtagtctaaagttcatacgcacacccctcctaattctggcaacgggcggtgccgcgtctatgtactactacacttctaaccctaagaaagtcaggggagatgcgataggaatcgctttcagaatgggggctaccgttaagaaccccgaatttgtccagttccaccccacggtcctgaagggaacgaacttactgatatccgaggcggttaggggagagggtgcaattctcgtgaacgacaggggagagaggtttgtaaacgagctcctcccgagagatgaagttgcaagagctatatataaccagataaaacggggaagggaggtttacttagacctgagacccgttgcacaaaagggtattaagatagaggagcgtttcccgactatatacagctttttaagggaaagagggtacgacccctacagagagcccgtgcctattatcccagcagcccactactatataggcggtatagaggtagacgacagaggaagaacctcaatacaaggtttgtacgcggtgggtgagtgcagttgtacgggaattcatggggcaaacagactcgcttccaactctctcctggaaggtgtggttttcggtcacaggacagcctatcaggtttacttagatttaaaaattttaaaaccctcaaaagtgaactttcgctctgagagagcaggaagtgataagccgaacttgggtatagaagagctaaaaaaactcatgtggaattacgtaggtcttgaaagggacgaagaggggttaacttacgtaaaaaaacgaattcttagtgtgctttcacaggcaaaacactgggaacctacaccgcaaaacaggcaactttacgacatactcctcgtggctctttgcaccgttgaaggagcactcatgagaaaggaaagcaggggagtacactacaggaaggactaccctacagaaagggaagtttacagaagggacacaataataacgagggacctttttgagctttag

SEQ ID NO: 23744 - DNA, 1281 bp, Aquifex aeolicus
atgaggattgaggacctgagaaaggaagactggaaactcaacgagaggcttgagtacctcgcaaagaggggagagatactggaagaggagtacgaaaagagcgtaaaggaaattctgaaaagggtaagggaagagggggacagggctgttatagagttcacgaaaaagtttgacggagtagaattgacacccgagaacatggaagttccctttgaggaacttgaaaaagcttacgaagaaatagaacctgaagtgagggaagcccttgagtttgcagaaaacaggatcagggtattccacgaaaaacaattggaaaactccttcttcaaagaagaggaggggataatactcggtcagaaggtagttcctttagaaaaagtgggcgtttacgttcccggcgggaaagcagcttacccctcaacagttttaatgaacgtggtgcccgcatccgtggcgggagtggaagaaataataatggtgtcaccaaaaccgaacaagtacaccttagcagcagcatacatagcgggagtgagcagggtttttcaggtcggcggagctcaggcgataggtgcactagcttacggaacggagaaaatacctaaggttgacaagatagtgggtccgggaaatatatacgtggcgcttgcgaaaaaactcgtctttgggaccgttgacatagacatgattgcaggaccttccgaagtcctcgttatagccgacgaaagggcaaaccccacttgggtagccgcggacatgctctctcaggcggagcacgacgaactcgcggcgtccatacttctcactccctccgaagagcttgcaaataaggtaaaggaagaagtggaaagacttctttctcaattagaaagaaaggaaatagctcaaaaatccctagagaaattcggaacaatctttctggtgaaggacctttaccacgcctgcgaggttgccaattacatagctccagaacaccttgaagtcatggtaagggaacccatggcgctccttccggagctaaaacacgcgggagcaatttttctcggagactacaccactgaacccttgggtgattacgtcctcggtccaaaccacacacttccaacaggtggtagtacaaggtttttctcccctctcggagtttacgactttataaagaggtcctccgttctctacgtctccagagaaggcttcaaaagggtggcaaatcaggcggaggcaatagcgaaagcggaaggactcactgcccatgcccttgcggtgaaagtgaggaaaaatgattag

SEQ ID NO: 23745 - DNA, 2010 bp, Aquifex aeolicus
atgaaactcaacactcaacaggaagaggctgttaggcatttcggctctcccctgctcgtcgtggcgggagcgggatcgggaaagactaaaacccttacccacaaagttgagtatttgataaaggaaaaaggtttgaagccctacgaaatcctttgtataactttcacgaacaaagcggcaaaggagataaaagaaaggataaaaaacaccttcgggcttgagcttgagtggagcggaacatttcactcggtagccctgaaaatcctgaaaaaggacggagaaaagataggaattcccaaggacttttcaatagcggacgagaaggacacgactctgatagtaaaggaaatccttaaaaagtacggtctgaaaaaggaaccggaagaagtgaaggaaaaaatctcaaaggttaaggaaaactttgaagagccagaagcatggctcggtgtgcttttagaggagtaccagagggtacttagagagaataaactccttgatttttccgatttgatgagggaactgtacaacctgcttctcgtggacgaggtaagggaaaagtacaggaacactttcaagtacataatggtggacgagtatcaggatacgaacaacattcagtatgagatattaaaactccttgcgaataaaaacatatgcgctataggggaccctaaccagtgtatatacgagtggagggacgcaagaccggacaacattctcaggttcatagaagacttcaacccgaaaataataaaacttgaactcaattaccgctcaagagagcctattctcagagtagcaaacgcggttctggaggcttctaccctagagtggaaggatttaatcccgaaactgaggggagtaaggggagaaggacaaaagccctacgttagacgctttcaggacgaggaagaagaagctctctggatttcccggaagataaaggaactggcaggagagtatgagctgaaagacatcgcggttctcgtgagagtcggatacataacggacgtttttgagagaaccttcttcaaggcgggaattccctacaaagtcgtgggaactataaagttttacgaaagaattgagataaaaaacttaattgcactcctgaggcttatttacaacccttcggacgaggtggcttttaaaaggctaacggagttctttgttaagggttttggggataagagttttgaagtagtgaagaaaaactttaaagggaactggtttaaagccctcaaggagtctcttaaaaagcttcccaaaaacgccgcaatttccgcgtatgagttcctgaaggctgtggttcccctttacaaaaaccccgaaaagtaccacgaaggacttgaagctttcgttgagaagatagattactacgaactattaaaggaaaagttcaagaaggattacgaggagaggattgaaaacgttaaggagtttttaagctccctgaaagacttttacgcaaaggcttacacccttgaggaccttctcgcggaaataaccttgacctcggaagaagaggaagaggaaaacgccgtaaaaattttgactatacactccgctaaaggtctggaatttcccgtggtatttcttccgaggcttgaagagggtatactcccacaccacaggtctcaggagagtgaaagggaactggaagaggaaaggagacttttttacgttgcgattacgcgggcaaaggacctcctctttatgagttacaccaagaaagaaaacagaaaaccgagcaggtttttgtccgacattccgaagcacctcttagacctttccgccttcaaaaagaagaaaaaggtcgcttacgaagaaaatttaaggcccaatagattgataaagaagggagataaagtaatccacagggttttcggaaagggtgtggttttaaggattgaagaagagagggcaaaggttagatttgaaaacggagaagaaaaggtaattcacacttcttttcttgaaccgcttaaaactccttcaggagtgccttga

SEQ ID NO: 23746 - DNA, 1275 bp, Aquifex aeolicus
atgaagaacgaaaagttatacagagaagcccttcaggtaatgcccggaggcgtaaacagtcccgtcagagcctttaaagcggtagggggaaagcccattttccttgttaagggaagaggaccaagagtctgggacgccgaagggaacgagtacatagatttcctcgcttcctggggggctataatcctcggacacgctcccaagaaagtggtgaaagcggttcaggaggaagctgaaaagggactttctttcggtttgacaaaccctcacgaagtaacactggcaaagctcgtggttgagatggttcctagtgttgaaaaagtaaggttcgtaaactctggaactgaagccacgatgtctgcggtgagactcgcaaggggagtcacaggaagaaagtacatagtgaagtttgaaggttgctaccacggtcactatgatagcctcctcgtgagtgcgggttcgggcgtggctactttcgggatccctggaactcccggcattcctgaagaaatagcgaagctcaccatagtcttgccttacaacgatgttcaagctctggaggaagcctttaaagagtacggcagtgaaatagcgggagttatagtggagcccatagcgggaaatatgggcgtagttcccccaaagaaggaattccttataagactcagggaactcacgaaagagtacggaagcctccttatgtttgacgaagtaattacgggttttagactttcaaagggcggagctcaggaactctttggtatagagcccgacataacatgcctcgggaaaatactcggaggaggactgcccgtaggtgcttacggaggaagaagggaaattatggaaagggtagctcccgagggtgaagtgtatcaggccggaacgcttgcgggaaatccccttgctatggtttcgggttctgaaaccttaaaagatttaagggacaaagaaccttacaaggaactggaagagaagatggagaaacttgccagaggcgttaaggatatcctcaccgaaaagggaatacagcacacgataaacaaggtaggttctatgatgacggtgttcttcacggataagaaagttgtggacttccaaaccgctaagacttcggacacagagctgttcgcaaagttcttcagagcacttttaaacaaaggtgtgttaattccgccctctcaattcgaggcgtggttcttaaccaccgcacacgaggaagaagtaatagacgaagcccttgaaagaatccgggacgcggtaaaggaactgtga

SEQ ID NO: 23747 - DNA, 669 bp, Aquifex aeolicus
atggaagtagtttctctgccgagactcggtgagccggcaccggcttttgaagcacaaacgaccttcggtcccgtgaaattccccgatgactttaagggacagtgggtagttctattttcacaccccgcggacttcacacctgtgtgtactaccgagttcgtagctttcgctaaaaattacgaagagttcaagaagagaaacgtccagctcataggactctcagttgacagcaacttctcacacatagcgtgggttatgaacataaaggaaaagtttggaattgaaatccccttccccataatagcggaccacaacatggaagttgcaaagaagtacggaatgatacacccagcacagagcacaaccttcactgtgagggcactctttgtgatagacgacaagggaatactcagggctatgatttactacccgctcacaaccggtaggaacataagggaagttataagactcgttgatgcgctccaaaccgcagacagggaaggagtggcaactcccgcggactgggtacccgaaccccaaacctgggaatttaccgaagaaaatacaaaagtcatcgtaccgccaccgactacttacgaagacgcggtcaagagactacaagaaggatacgagtgtgcagactggtacatctgtaagaagaaggtttaa

SEQ ID NO: 23748 - DNA, 1887 bp, Aquifex aeolicus
atgcttgagaagtacgagatcttgaaggactataaagggccttttgatataaagaattacgattatgaaacgctccagaagctcgctcaagaggtaagggattacatcataaatgtaacttcaaagaacggaggacatgtaggtccgagccttggtgttgttgaattaacgatagcactcctgagggttttcaacccgcctgaggacgtaatagtctgggacataggacaccagggatacccatggaagatactcacagacagaaaagagcaattccctactttgagacagtataagggcatttcgggatttttgagaagagaggagagcatatacgacgccttcggagcaggacacagctctacctctatttctgcagccctgggcttcaggataggaaaggacctgaaaggagaaaaagaggattacgttatagcggtaataggggacggtgcactcacggcgggtatggcttacgaggctctaaacaacgcgggacacataagaccggacaggtttatcgtgatactgaacgacaacgagatgtctatatctccgaatgtaggagcgatatccacatacctgaacaggataataagcgggcatttcgttcaagaaacgagacaaaagattaagaatttcttacagcacttcggggagactcctctcaggataatgaagctcacggaggagttcctcaagggtctaatatcacccggagttattttcgaggaactcggttttaattacataggtcccatagacggacacgacataaaggcccttgaggatacattaaacaacgtgaaagatataaagggacccgtccttctccacgtttacacgaagaagggaaagggctacaagcctgcggaggaaaatcccgtaaagtggcacggagttgcgccctacaaggttgagtccggagaaatcattaaaaaaagctctcctcccacctggacctcggtctttggaaaggcactcgtggaactggctgaaagggacgagaaaatcgtggcaattactcccgccatgagggaaggttcgggactcgttgagttcgcaaagaggttccctgacaggttctttgacgtaggaattgctgaacagcacgcttgcacctttgctgcaggactcgccgcagaaggactaagaccagtcgcagcatactactccactttcctccagagggcttacgaccaggtaatccacgacgtagcactccagaacctgcccgttaccttcgcaatagacagggcgggacttgtcggagacgacggtcccacccaccacggagtttttgacctctcttacctgagatgcgttcccaatatggtagtttgcgctccaaaagatgaacaggagctcagggacctcctttacactggtatatacagcggaaagcctttcgccctgaggtatccgaggggtgcggcttacggagttcctaccgaaggttttaaaaagatagaaataggaacttgggaggagcttctggaaggtgaggactgcgttatacttgcggtgggataccccgtataccaagcccttagagccgcggaaaaactctacaaggaagggataagggtaggtgtagtcaacgcgaggttcgtaaagccgatggacgagaaaatgctcagagacctcgcaaataggtacgacacattcataaccgttgaagacaatacggtagttggaggctttggaagcggagttctggagtttttcgcaagggaaggaataatgaagagggtaataaacttaggtgtgccggacaggttcatagaacacggaaagcaggacatactcagaaacctcgtcggtatagacgctgaaggtatagaaaaggcggtgagggacgccctgaagggcgggcgtctcatttaa

SEQ ID NO: 23749 - DNA, 981 bp, Aquifex aeolicus
atggacgccaccctcataattggtttattatctaaagacatgggcaagctcgcttacgtttttcccggacaaggttcccaatacgtgggtatgggatacgagttttacaagcagttccacgagaccgctgacgtggttcacgcggttgaacactccctcagaatgtctttagacgatatcgttgacgttatgttcaagggtccagaagagaaactgaacaaaaccgtatacacccaacctgcactctttgcgatttctctcggtatatacaaagcccttgagagtatgggatttccaaagccagactttgtagcggggcactccctcggagagtatacagcccttgctgttgcgggcgggatagacgttcagctcggggcaagactcacctattacaggggaaagtacatgcaggaggctgttcccgaaggaaagggagctatggtggcgattctgaaactccctcctgaaaaggtagaagaagcgtgtgaaagggcgaaggacgtcggggtggttgaaccggcaaactacaactcatctacccaaaccgtgatatcgggggaaaagcctgcggttgaaaaggccgcccagatagcaaaggaaatgggtggaagggcaatcccgttgaaggtttcagttccctcccactgctcactgatgaaacccgcggcggacgcctttaggcttaaactcgctcaagctccgattcaaaatattaaaatccctctggttcagaactacaccgcaaaggctcacaccatggcacacgagataaggaacaacctttaccatcagatattttccccggtaaagtggtatcagagtgttatatggatgcacgaacagggagttgataccttcgtagaaataggtccaaagaacgttctctcaaaactcatacagcaaacgctcccgaacgtgagggtgtttaacgttgaaaaaccagaagatgcggaaagcgttttaaaggcgataacatga

SEQ ID NO: 23750 - DNA, 915 bp, Aquifex aeolicus
atggaaatcctgaaggctatagaagacagactcgtagaagagctaaaccccaaagtgagactcgtccttgaaacgggcaggtatatcgtagagagcggaggaaagagactccgtcccctctttaccttactcgtgagcggtatgtgcggaggggacccttcaaaagcccttcccctcggagttgcccttgagtacatacacgtggcttcacttctgcacgacgacgtggttgacagggcaaagacgagaaggggaagagagtccgcaaacctcgtgttcgggaacggcgtggcggtattgacgggtgattacatgtacgcaaagtccctgcacctcttttctacatacggaaatatggaaatgatcaggctcgtcagcggagttgtcatggacatggcggaagggcaagtgcttgaaatatccaaagtaggagacatcatatccgaagaggagtacttccagattattgacggaaagacgggagttcttttcggtgcgtgctttggtgtgggagcgatgagcggggagtgcggagactggagggagctgtatgaagctggtttgaggctcggaagggcgtttcagttaatagacgacgcccttgattacgaaggggatccgaaggttttagggaagcccgtaggaaacgacctaagagaaggaaagtgcacgtatccacttatatccgttctggacaatctggacagggaagaggtaaagagagttttaagaggacttgaagactcagaaaaactcaggaagaaagtggtggaactgggcggagtggaaaagacgaaagaaagggctaaggaagagctaaaggtggttaaagagataatatcaaagtatcccgagaacgagtacaaaagggagatactgaagttaatagacttcgtggttgagaggaaagcttaa

SEQ ID NO: 23751 - DNA, 810 bp, Aquifex aeolicus
atgattaacgcccaaacgcagctatacggagtaataggctttcccgtaaagcattccctatcccccgttttccagaatgcccttataagatacgctggtcttaatgcggtatacctcgcctttgagattaaccccgaagaactaaaaaaagcctttgaaggatttaaggctcttaaggttaaagggattaacgtaaccgtccccttcaaggaagaaatcattcccctccttgactacgttgaggacacagctaaggaaataggtgccgtaaacacggtaaagtttgaaaacggaaaagcttacggctacaacaccgactggataggttttttaaaatccctaaagagcttaattccagaggtaaaagaaaaaagtattctcgtccttggagctggaggagcttccagagcggttatttacgctcttgtaaaagaaggggcaaaggtatttctgtggaacaggacaaaggaaaaggcaataaagctagctcaaaagtttcccttagaggttgtaaactctcccgaagaagtaattgacaaggttcaagtaattgtaaacacgacgagcgtaggactaaaagacaaggatcccgaaattttcaattacgacttaataaagaaagaccacgtagtcgtggacataatctacaaagagacaaagcttttaaagaaggcaaaagaaaagggagctaaactctttgacgggcttcccatgcttctgtggcagggaatagaagctttcaagatatggaacggatgtgaagttccctactctgtggcagaaagatctgtaagagatctccgtgggtaa

SEQ ID NO: 23752 - DNA, 807 bp, Aquifex aeolicus
atgataaaggttctatcacccgcgaagataaacttggggctgtgggttctggggaggctaccgagtggttaccacgagatacttaccctctaccaggaaatccccttttacgatgagatttacataagggagggagtgctcagggtagagacgaatataggcattcctcaggaggagaacttagtttacaaaggattgagggaatttgaaaggataacagggattgaaattaattactctatctttattcagaagaatataccacccggtgcgggactcggaggaggaagctcaaatctggcggtagttctaaaaaaggtaaacgaactcttaggatctcccttatctgaggaagaactgagggaacttgtaggcagtatttccgcagacgctccctttttccttctcggaaagagcgctatcggaaggggaaaaggggaagttcttgaacccgtggaaactgaaatttcgggtaaaatcacactagtaatccctcaagtctcttcaagcacgggaagggtttactcttccttgagggaagaacacttcgttacaccagagtacgcggaagaaaaaattcaaagaatcatctcgggagaggttgaggaaatagaaaacgtcctcggagatatagcgagggaactttacccggaaataaacgaggtttacaggtttgttgagtatttgggattcaagccttttgtgagcgggagcggttcaacggtttacttcttcggaggggcatcggaagagttaaaaaaagctgcaaagatgaggggctggaaagttgtagagctagaactctaa

SEQ ID NO: 23753 - DNA, 798 bp, Aquifex aeolicus
atgagcgtcagggtggtagtttgtggtgccctcggtaggatgggaaggaggataatagaacttgcacttcaggataaagatgtggaagtagtcggaggagttgaacatccggactgcgtaccttcaatagatctgggagaagcccttggaaaggaagaactgaaaggaaaacctctaacgagcagactcgaagaactccttccctacacggatgtggttatagagttttcgggaaatcccaccgcggctgtagggcacgcggagttaaccacccttgaaaagaaggcgatagttataggaactactggatttacgaaacaggaaattgaacagataaaggagttttcaaaaaacgctcccgttttactctcacccaatatgagtttgggagtaaacctcctcttcaaactcgcagaaatcgctgcaaaggttttgaaagacaaaaactttgacgcggaaataatggaaatacaccacaggtttaagaaggacgctccgagcggaacggctatgaaactcgccgaaatactctccgaaactcttgagaagaagaacttggttttcggtagaaagggagaagctcccagaaaagaggacgagataggcgttatggctctaaggggtggagacgtggtaggagatcacaccgtttacttcttaggatttggtgagaggatagagctcacccacagggcgacgtccagagatacctttgcaaaaggtgccgttgaagcggcaaagtggattaaggggaaagaacccggattttacacgatgtttgacgtgctcgggctctga

SEQ ID NO: 23754 - DNA, 1905 bp, Aquifex aeolicus
atgaacgcgttgaaaaacttctttatatgggcaatcattatcggagctgcgatagtagcctttaacctatttgaaggaaaaagagaatttaccacgaaggtttccttaaacgaagtagttaagctcgttgaggaaggtaaggtaagttacgcggaggtaaggggaaacacggcgataattcaaactaaagacggacaaaaactggaggtgactctcccacctaacacgaacttagttgacaaaatggttgagaaaggtgtaagggttgaagttgcaaacccagaaccgcccggagggtggctcgtaaacgtattcctctcatggcttccaatactcttctttatcggtatatggatattcctcctcaggcagatgtcggggggtggaaacgtaaacagggcctttaacttcggaaagagcagggcgaaggtttacatagaggaaaaaccgaaggtaactttcaaggacgttgcaggaatagaagaagtaaaggaagaagtaaaggaaattattgaatacctgaaagaccccgttaagttccagaagctcggcggaagacctcccaagggagttctcctttacggtgagccaggtgtgggtaaaacgctccttgcgaaagctatcgcgggcgaggctcacgttcccttcatctcggtctctggttctgacttcgttgagatgttcgtcggtgtaggagccgcacgggtaagggacctttttgaaaccgcaaagaagcacgctccctgcataatctttatagacgagattgacgcggtaggaagggcaaggggagctattcccgtaggcggtggacacgatgagagagaacaaaccttaaaccagcttctcgttgaaatggacggctttgacacctcagacggtattatcgtaatcgccgcaaccaacagaccagacatcttagacccggctcttttaaggcccggacgttttgacaggcagatatttatacccaaacctgacgtaagaggtaggtacgaaatactcaaagttcatgcgaggaacaagaaactcgctaaggacgttgaccttgagtttgtggcgagggcaaccccgggctttacgggagcggaccttgaaaacctcctaaacgaagcggcattactcgcggcaaggaaaggtaaagaagagataactatggaagaaatagaagaagccctagacaggattactatgggactagaaagaaagggaatgaccatatcgccaaaagaaaaggagaagatagctatacacgaagccggacacgccctcatgggactcgtctccgatgacgatgacaaggttcacaagatatccataatcccgaggggtatggctctgggagtaacgcaacaacttcccatagaagacaagcatatatacgacaaaaaggatctctacaacaagatactggtgcttctgggcggaagggctgcggaagaggtattcttcggaaaagatggaatcactacgggagcagaaaatgaccttcagagagcaacggacctcgcttacagaatggtttccatgtggggtatgagcgataaggtcggtccgatagctataaggagggtggcaaatcccttcctcggaggaatgaccacagcggtagacacaagccctgaccttttaagggaaatagacgaagaggtaaagaggattattacggaacagtatgaaaaggctaaagctatagtggaggaatacaaagaacccttgaaagccgtggtcaagaagctacttgagaaggaaacgataacctgcgaggagttcgtagaagtgttcaagctctacggtatagagcttaaagacaagtgtaagaaagaggaactctttgacaaagacaggaaatctgaggaaaataaagaacttaaatctgaagaagttaaggaggaggtagtctga

SEQ ID NO: 23755 - DNA, 1299 bp, Aquifex aeolicus
atgggaatgactataaccgagaagattctggcggaacacgctggtaagaaggaagtccaccccggagaactcataactgcaaagatagacctcgcaatggcaaacgatgtgaccgcaccccttgccataaagatacttgagaagtacggaatagataaggtctttgaccctgagaggatagcccttgttctctcacacttcgttcccgcaaaggacataaagtccgctgagcaggcaaagatagtaagagaattcgtaaaaaagcacggtataaagtggttctttgaagagggagaaggtatagaacacgccatactccccgagcaaggactcgtcgttcccggggacctcgttgtaggtgcggactcccacacctgcacttacggagctctcggagcctttgcaacgggggtcggttccaccgatatagcctacgctatggctaccggagaagtttggctcagagttcccgaaagtatgaagttcatcttctacggaaaactaaaaccatgggtgatgggaaaggacctaatcctctacacgatagggcaaataggggttgacggagcactctacagggctatggaatttgacggagagaccataagaaacctttctatggaacagaggtttactatagcaaacatggcgatagaagcgggtggaaagagcggaataatctctcctgatgaaaaaacgatagaatacgtaaaacaaagggcaaagagaccatggaaagtttaccagagcgaccctgacgctgagtaccactccgtttacgagtgggacgcttctcagatagaacccttagtagcgtggccctacctaccttcaaacgtgcatcccgtttctgaatccacccatataacgatagaccaggcatttataggctcctgcacaaacggaagaatagaggacctgagagttgcagcaaaggtgtttgaagctgcgctaaagcaaggaaagaaagttcacccttacgtgaggtgcatagtaattcccgcgtccaaggctatatacaagcaagctttgaaagaaggactcatagatatctttatggaagccggttgcgtggtttctacttctacgtgcggtccctgccttggtggacacatgggagtgcttgcggaaggtgaaaggtgtatatccacatctaacagaaacttccccggaaggatgggtcatcctaagagcgaaagctacctcgcaaaccctgccgtggtcgctgcgagtgcaataatgggaagaattgcccaccccgacgaggtggtgaaagccgaaacccttgcgggtgtttaa

SEQ ID NO: 23756 - DNA, 930 bp, Aquifex aeolicus
atgaaaaaaggagtaatacttataaacctcggcggacctgattctctggaagcggtagagccgttcctttataaccttttctcagatccagatattttctccttaccctttcaaaaagttctcgcaaaaataatcgcaaagttaagggctaaaaaaacgagacattactacgagcttatgggaggaaagtctccccaatacgaacaaacccttgaacaggctaaagcacttcaggaaagactaggagaagattacaaggtagttgtgggaatgagatactggaaaccttacataaaagacgcactttctgaactcctgaaggaaggaataaacgaagtaatactccttcccctgtacccccagtacagcaaaacgacaactggttccgcttttaacgagtttgaaaggagcaaaaaagccctcaaagcggaccacattaaagttaagaaaatagaacacttttacgaccaccccctctatataaaggcgtgggccgagcagataaaacagagcgttgaaaagcccgaagaataccattttctcttttccgcccacagccttcccaagaaattgatagaagaaggagacccttatcaggaacaaaccgaaaaaacggtaaaactcattatggaaaatttccctgaagtagaatacacgcttgcttaccagagtaaagtgggtttcggaaagtggctcgaaccctcaacagacgaagtaatcagaaacctgattaagaaagaagttaaaaagttattagttattcccatatcctttgtttccgaacacagcgaaaccctttacgaactcgacaaacaatacagagaacttgcccaagaactgggatacgaagaattcgtaagagtccctactctaagaacaaacccctacttcatatctgcacttgaagatttagtaaaaaatgaagtatag

SEQ ID NO: 23757 - DNA, 588 bp, Aquifex aeolicus
atgttaatcgcttttgagggaatagacggttcgggaaagactacacaggcgaaaaaactgtatgagtaccttaaacaaaagggctactttgtgtccctttacagggagcccggcggaacaaaagttggagaagtattaagagaaattttacttacggaagagctagacgaaaggactgaactcctgctctttgaagcatcccgctcaaaactcattgaagaaaagataatccccgacttaaaaagggataaagtagttatactcgacaggtttgtcctttcaacgatagcgtatcagggatacggaaaaggtctggacgtagagtttataaagaacttaaacgaatttgcgacaaggggtgtaaaacccgatataaccttactccttgacatccccgtggatatagcgctgaggagactgaaagaaaagaacaggtttgaaaataaggaatttcttgaaaaagtgagaaagggatttttagaacttgcaaaggaagaggaaaacgtggttgtaatagatgcgagtggggaagaagaggaagtgtttaaggaaatattgagggctttaagtggtgtactccgcgtttag

SEQ ID NO: 23758 - DNA, 1140 bp, Aquifex aeolicus
atggctgaaattttaatgggcgtaggaaatgcgggtttaaaggaatctggaaatccggatatactcgtcgtttaccttccgtacccatgcaccgcttccttcgtctttacggacaactacttcaaggctggttctgttatttactcggaaaggatagcaagggataaagaaaggattagggcttttgtagtaaacagcggaaacgccaactgcggaacgggagaggaagggataaaacacgcagagatgatggctgaaaaagtagcccagatactggatattccaaaggacgaagtcttcgttttttccacaggaataataggaaagtacctgcctatagaaaacgtattaaaaggtatagaacaagcttgctcaaatcttgaacttctggatttgaagagggcttccgaagttatttccacaacggacaggtttccaaagtacgattttgccaaagccggggaggtagaaaccttcggttttgcaaagggagcgggtatgatacacccttccatggcgaccatgctcgctttcgtttttacgaacgcaaatctcgagtacctgaccttgaagaggatccacgaaagcgtaacggaaaaaacctttaactccataactgttgacgggtgtgagagcacgaacgacgccttcggcattatatctctaggggaggtggaagcggatccagaaacggtagaatttgaactcctaaaggtttccgaaagcctcgcaaagcaaattgtggcggacggtgaaggagctacgaagataataagggtgaacgtgaggagtgcgattacagagataaaagccagagaaatagcggaggctatagcgaactccttactggtaaagacagctgtattcggaagggatccgaactggggaaggatagcagctgcggcggggagtacagagttccccatagacccattcaagctagaaatttacgtagggggatacttactctacgacggaaagccccacgacgagaacctggaaaaggcaaaaaaacacttgattgaagacagggaagttgatataactgtggaactaaacgaaggagagtacgagtgggtgtgctactcctccgacatagggtacgactacatcaaactaaacgcggagtacaccacttaa

SEQ ID NO: 23759 - DNA, 1899 bp, Aquifex aeolicus
atggctgaaaagaaggaaaaaataattgggatagaccttggaactacgaactccgttgtttctgtaatgatgggggatgaagcggtagtaatccaaaaccaagaaggttcaaggttaaccccctcagtagtttcctggaccaaggaaaaggaaattctggtaggagaacccgcaaagagaagggcgatactggatcctgaaaacaccgtatacgaaagtaaaaggttcataggtaggaagtttgaagaagtaaaggaagaggcaaagagagtatcttacaaggtagttcccgatgaaaagggagacgccgcctttgacataccgaacgccggaaagctcgtgaggcctgaggaagtaggagcacacgttctcaggaagttaaaggaagctgcagaagcgttcctcggagaacccgtcaagaaagcggtgataaccgttcccgcatacttcaacgaaagacagaggcaggcgacaaaggacgcgggtaagatagcgggacttgaagttgtaaggatactgaacgaacccaccgccgcggcaatggcttacggactccacaagaaggacaacgtaaggatactcgtttacgacttcggaggaggaacctttgatgtttccatactggaaggcggtgagggcgtaatagaggtaaaggtaacggcgggagacacgcaccttggcggtgcaaacatagacgagaggataatggactggttaattgaagagttcaagaaggaaacgggaatagacctgagaaaggacagaaccgcactccagagactcaaggaagcttccgaacaggccaaaaaagaactctccttcaagatggaaacggaaattaacctgccgttcataaccatagaccccaacactaaccagcccctccacctccagaagaagctcaccagagcaagacttgaagaaatgattaaagacatcgttgacagaaccatagacatagttaaacaggcactagaagacgccaaactaaagccctccgacatagacgaagtggttcttgtaggcggttcaacgaggatacctttagttcagcaaaggattaaggagttcttcggaaaagagccccacaagggactgaaccccgacgaagttgtagcgatgggtgcggcaattcaggcaggtgttctcgcaggagaagtcaaggaaatcgttctcgttgacgtaacacccctgtctctcggagttgaaacctacggaggggtaatgactgttctcattcccagaaacaccccgatacccgtcagaaagtgtgaaatcttcacaaccgcccacgactatcaaacggaagttgaaatacacgtccttcagggtgaaagacctctcgctaaggacaacaagtccctcgctaaattctacctgacgggaatacctccggcacctagaggagtgcccaagatagaagtttgctttgacatagacgcggacggtatactccacgttaccgcaaaggacctcggaacgggtaaagagcagtccgtaagggtagaaatatcctccggactaacgcccgaagaaattgaaaggattatcaaggaagctgaagagcacgccgaagaagacaggaagaagaaagaactcattgaagctaagaaccagcttgaccacctcgtttaccagcttgaaaaggcactaaaagaagcgggagacaaagtacccgcagacgtaaagagcgaagcggaaaaggttatagaagaagctaagaaaaccatagaaaccgcaacggaaattgaacaggtaaaacaagttacggaaaaggttctccaggtttcctcaaagatgggaaccacactctacggtgaagccggaaaacaagcgggcggaggagaaaagaaggacgaaggtggagagggagaagtagaagccaaacccgttgattaa

SEQ ID NO: 23760 - DNA, 2472 bp, Aquifex aeolicus
atggaatttttgagggatttcgggaaaactgctttaattcatcaaggaaacgaaatctcctacgctgaactcctcgaaaatatagcctctttcgcaaacttaatggacataacgcctaacgaaagagtaggcatagtaatggaaaatagacccgaatgggtttacgccttttacggaacgtggaaaaagggtggaatagtcgttcccatagactttatgtcaactcctcaagagataaggtacattcttgaagacgcagaaccttcaataattttctgttcagatgaaacttatccgagggtcagggaagcctctgaagatttgaaagtagaaatcgtaaacgtggacaaccttgtactacccactccgtgggaaggtatagtgaggagagatgaagacgatgtagccgttcttccttacacctctggaactacgggaaatccaaaaggtgttatgcttaccttcaaaaacctcatgtcaaatataagaggtgtatcggaggtaggaatagcgggaaaggaagacaaaaccctcgccattctccccttccaccatatgtacccgcttatgactactatgttattgcctctttaccttggtgcaacggtagtttttctggataagttaacaccggaagacataatcgagaaacttcagaagtaccagataaccgttttaataggtgttccgaggctttaccagctcttccacagaaggattatggaggagataaacaaaaacgttctcgcgaaaaatttatttaaattaatgaaaaaagttaaaaaccagaaaataagaaaaacggtttttaaaaaagttcacgatgcctttggtggaaggataaagtacatggtaagcggaggggcaaaactacctctggatatcgcccaggacttaacaacactcgggtttaccgtaatagaaggctacggactcacggaaacctctccgatagtttcttttaatcctccgaacagaataaaactgggctcggtgggtgtaccgataaaaggcgttgaagtgatgaccacgagtgaaggggaaatcattgttcgcggagacaacgtaatgaaggggtactggaaaaaacccgaagaaactcaaaaggtaataataaacggttggttctacacgggagatctcggagagatagacgaagaaggatatatatacataacgggaaggaagaaagaaataatagtcctcggaagcggtaagaacgtattcccggaggaaatagagagtaaaatccttgcaaaagctccatacataaaggaagtcggggtttttgaaaaagatggcaagctcctcgctttaatttaccccgattttgaaaaagttaaagaattaggaataactaatctggaagaaacgataaagtgggaagtaatagacaaagtaaacagggaactcccggagtggaagagggtagtcgggttcaaaatcgtgaaaacggaacttcccaaaactagactggggaaactgaggagatttttgcttccgcaaatttacgaaaaggctgaagaaataaaagaagaaaaaacggaggattacagcgtatttgaaacggaggaaggaagaataataaaggaatttcttgaaaaaatttctcagaaggaagtaaaacccggagatcacctcgaaattgacttggggcttgattcccttgctaaggtagaacttcttggatttatagagacaaacttcggagtcagtctttcggaagaggaattgtcaaaaaatttagtggtaaaggacctcatagaactcgttcgcagtaagaaaaaaagtgtggatactaaagaagtttcctggaaagatatactcacaaaggcaaagccttacgagctttaccactaccccctcatctttgaactcggaagaaagcttttaaaactttacttcaagctataccacaggatagacgtgagaggtcttgaaaacctgcccaagcctccctttataattgcaccaaatcaccagagctatttagacgccttcgccatagccgctgttcttccaaaggaaatagcccacgaaacttactttttaggagacgaaacctacttcagaaatccaataacttcaaccttcggtaaactcgctcacgtcatcacagtaaacgtaaacaaaggtttaaaagaatccctccagaaaaccgcttacgccttgatgtcgggaaaagtagtggtgatctttcccgagggtgcgcggacgaggacagaagaattaatggaattcaaaaaaggagtcgccatactcgccagagaacttggtgttccaatagttcccgttgcaatagaaggggcttacgaagcttggtccgtttacgacaagttcccgaaacctaaaaagataaaaataatgttcggaaagcctgtagatccggacgagaagtcttacgaagaaattacaaaggaactctacgagtggattaagagtatgcttgagtttttaaagaaagaaagttaa

SEQ ID NO: 23761 - DNA, 765 bp, Aquifex aeolicus
atggaagatattatagtttctttcatgaacgttgccttaatcacaggtgtaaggaggataggaaaggaagttgctaaagctttgatagataaaggttattccctgagcgtcgtatacaggtcaagcagagaagcggtggaggaactgaccgagtatgcaaagggaaaaggagttaaggtaaagggatttcgggcagatctgtgcgcgtacggggactatgaaaaacttgtaaaaggaacttacgaggagttcggcaggatagacgccttcgttcacctcgcctcaccctatgagagaaaagagctcacagaaacaacgcgggaggatctttactatcacttcatacccatagcggaagctttcttctttatctctgtggagtgttataaagttatgctcaaaaatgaaggaaacgtaaagggaaggatagttgccttcggcgattgggctacaaacatatccccttataagggtttcagtgcttactttatcgccaaaggagcccttcacacagcggtaaaggttctggcaaaggagtttgcacctcacgttctcgtgaattgcgttgctcccggtcccgtgatgaaggcggaaaactactcggaggaggagtggaaaaagatactcgcgagaacgcccctgagaagggaagtttccgttaaagacgtggtaagcacaacgctccttcttttggaaacggaaagtatcaccggagaaataatctgcgtggacggtgggaggcacatagcggggtcgggagtttaa

SEQ ID NO: 23762 - DNA, 1128 bp, Aquifex aeolicus
atgaagaaggttaaacttatcggaactttagactacggaaagtacagatatcccaaaaaccatcctcttaaaataccaagagtttccctactccttaggtttttagatgccatgaaccttatagatgagaaggaattaatcaagagcagacccgcaactaaagaagaactccttttattccacacggaagactacataaacactttaatggaagcggaaaggtgtcagtgcgttccgaagggagctagggaaaagtacaacataggcggatacgaaaaccccgtatcttacgcgatgtttacaggctcttctctcgcaacgggttcaacagtgcaggcgatagaggaatttttaaagggaaatgtagctttcaatcccgcgggaggtatgcaccacgcttttaaaagcagggcaaacggcttttgctacataaacgaccccgctgtgggaattgagtacttgagaaaaaaaggctttaagagaatactctacatagaccttgatgcccaccactgcgacggtgttcaggaagccttttacgatacagaccaggtgttcgtcctgtcccttcaccagtcgcccgagtacgcctttccctttgagaagggcttcctggaggagataggagaaggaaaaggaaagggctacaacctgaacattcccctgccaaagggcttgaacgacaacgagttcctctttgccctagaaaaatctctggaaatagtcaaagaagtatttgagcccgaggtttaccttcttcaactcggaactgacccactccttgaagattacctttccaagttcaacctctcaaacgttgcctttttaaaagctttcaacatcgttcgtgaggttttcggggagggagtatacctcggaggaggcggataccatccttacgccctcgcaagggcatggaccctaatctggtgcgagctttcgggaagggaagtgccggaaaagctaaacaataaagcaaaagagcttttaaagagtatagactttgaagagtttgacgacgaggtggaccgctcgtacatgctcgaaaccctaaaggacccctggagaggaggagaggtaaggaaagaagtaaaggatacgcttgaaaaggcgaaagcctcatcttaa

SEQ ID NO: 23763 - DNA, 3048 bp, Aquifex aeolicus
gtgaattacatggatatttcaaggaggggttttttaaaactatcagtaggtagtgttggagctgggatattaggtggtctcggttttgatcttacacctgcttatgcacgtgtaagagatttaaaaataacaaaggcaaaagtaacaaaaagtatatgtccttactgctccgtatcctgtggaatactagcctactccctttccgacggagcgatgaatgttaaagaaagaataatacacgtagagggtaacccggatgacccgataaatagaggaactttatgtcctaaaggggcaaccttaagagatttcgtaaacgctcctgataggcttaccaagcccttgtacagacctgcaggatctacagaatggaaagaaataagctgggacgaggctatagagaagttcgcaagatgggtaaaggatacgagggataggacctttatacacaaggacaaggctggaagggtggtgaacagatgtgactccatagtttgggctgtgggctcaccccttgggaacgaagaggggtggctcatggtaaagatcggtatagccttaggtctctcggcacgagaaacgcaggcgactatatgacacgcacctacggtggccagtttggccccaacctttggaagaggagcaatgactaacaactgggtggacatctccaactctgacctcgtattcgtaatgggaggaaacccggcggagaaccacccctgtggttttaagtgggccataaaagctcgtgagaagaggggtgcaaagataatatgcatagacccaaggtttaacagaaccgccgctgtggcagatatcttcgttcagataagaccgggaacagatatagctttcctcggaggtctgattaactatgtccttcagaacgagaagtatcagaaggagtatgtgagactgcacacaacaggacccttcatagtgagggaggacttcggcttcaaggacggactctttacgggatacgatcctaagacgaggagctacgacacgaccacctgggactacgagttcgatcctgctacgggatatcccaagatggatcccgagatgaagcatcccagatgtgttctcaacatcctgaaggagcactactcgaggtataccccggaggtcgtctcccagatatgtggatgttccaaggaggacttcctcagagttgcagaggaggtggctaagtgtggagctcccaataagttcatgacaatcctctatgccttgggatggacccatcactcctacggaacccagctcataagaactgcctgtatgcttcagcttctgcttggaaacataggttgtccgggaggaggaataaatgccctcagaggtcactctaacgttcagggtatgactgatctcgccgggcagaacaagaacctccccacctacataaagcctcccaagccggaggaacaaaccctcgcccagcaccttaagaacaggacaccgagaaagctccatcccaccagcctgaactactgggcaaactatcctaagttctttatcagctttctcaagtgtatgtggggcgacgccgcaacgcctgaaaatgacttcgcctacgactatctatacaaacccgaaggaggctacaactcctgggataagttcatagacgacatgtacaaaggaaagatagagggagtggtaaccgcagcccttaacttcttgaataacacacctaacgccaagaagacggtaagggctctcaaaaacctcaagtggatggttgtaatggatcctttcatgatagagacagcccagttctggaaggcggaggggttagacccgaaagaagtcaagacggagattctcgtccttccaacggctgtatttctcgagaaggaaggttccttcaccaacagcgcgaggtgggtaaagtggaaatacaaggctaccgatcccccaggagatgcgaaagacgaattctggatatttggaagattctttatgaaattgaaagaattttatgaaaaagaaggaggagctttccccgaaccgattctcaacctcgtctggccctacaagaatccatactatccgactgcagaagaaatacttaccgaaataaacggatactacacaagggacgtggacggtcacaagaagggagagagggtaagactcttcactgatctgagagacgacggatcaactgcctgcgggggatggctctactgtggcgtattcccgcctgagggcaaccttgcaaagagaactgacctcagcgatcccctcggtctgggaacctatccgaactacgcctggaactggcccgccaacaggagggtcctctacaacagagcctcctgcgatgaaaagggaagaccgtgggacccagaaagacccctcctgagatgggatcctgaaagagacatgtgggtaggtgatatacctgattatcctgctaccgcacctcccgaaaagggtataggtgctttcataatgctcccagaaggaaaaggaagattgtttgcagcaaaaagctatgttacattcaaagatgggccacttcccgaacactatgaaccttatgaatctcccgtgacgaatattctccatcctaatgttcctcacaaccccgttgcaaaagtatacaaatctgatctggatctgttaggaactcccgataaattccctcatgttgctaccacttataggctaactgaacattatcacttctggacaaagcatctgtacggtccttcactgcttgcaccagtaatgttcattgaaatacctgaagaactggcaaaggagaaaggtatccaaaacggagacttagttagagtttctactgcaagagcatcaatagaagctatagctttagtaacaaaaagaataaaacctctaaaagttgcaggaaagaccgtatacacaataggtataccaatacactggggatttgaaggtctagtgaaaggtgccataacaaatttcataacgcccaacgtctgggatcccaactctagaactcctgagtttaagggctttcttgcaaacattgaaaaggtgaaaacttaa

SEQ ID NO: 23764 - DNA, 1029 bp, Aquifex aeolicus
atggctataaaagtagggataaacggattcggtaggatagggaggagctttttcagagcttcctggggaagagaagaaatagaaatcgttgcgattaacgacctcacagacgcaaagcaccttgcacatctcctgaagtacgactcggttcacgggatatttaagggaagcgttgaagcgaaagacgactctatcgtggttgacggaaaagagataaaggttttcgctcaaaaggacccctcccaaattccttggggggacctcggggttgacgttgtaatagaagctacgggagtgtttagagacagggaaaacgcttccaaacacctacagggaggggcgaaaaaggtaatcatcaccgctcccgctaagaatcccgacattactgtagtactcggagtgaatgaagagaagtacaatccaaaggagcacaacataatctcaaacgcttcctgtacaaccaattgtttagctccctgtgtaaaggttctgaacgaagccttcggagttgaaaagggatacatggtaacggttcacgcttacaccaacgaccagagactcttggaccttcctcacaaggatttcagaagggcaagggctgcggctataaacatagttcccaccaccacgggagctgctaaagcaataggtgaagtaattcctgagcttaaaggaaaacttgacggaactgcgaggagagttcccgtaccggacggctcactcatagaccttacggtcgttgtaaataaagctccttcttcggttgaagaggtaaacgaaaagttcagggaagccgctcaaaagtacagggaaagcggaaaggtttacctgaaggaaatactccagtactgcgaagaccccatagtttccacggacatagtcggaaatccgcactccgctatatttgacgctcctttaactcaggtgatagacaaccttgtccacattgccgcgtggtatgacaacgagtggggttactcctgcagactcagggacctcgttatatacctcgccgaaagggggctttaa

SEQ ID NO: 23765 - DNA, 1332 bp, Aquifex aeolicus
atgactgcggtaagccaagaaataatgaactacatagaggagaaagtaaacagggcaagaagcgttctgagagaactcacttccctcaaaacttccgtaaagaacgaaaccctcttaaaagtagcagaactaatagataaaaacagggattacataaaggaagaaaacaggaaggacgtagaaaaggcaaaggaaatgggattgagacctgcagttgtagacaggttggttctcaacgacaagagaatagacggaatggtaaaagtactcaaagacgttgcctccttacctgatcctgtaggtgagattataaaaatgtggaatctccctaacggtctgaaagtgggaaggatgagagttcccttgggagtgatattcatcgtttacgagtcaaggccgaacgtcactatagaagcctcatccctttgtatgaagtcctcaaacgcagttatcctgagaggaggcaaagaagccataaactctaacaaagcactcgttaacctaataaaggaagcgtgcagggaaacgggatttcccgaagatgctgttcagttcatagacagatccgagagggaaatagtgtgggaaatcctgaagatggagggcaaaatagacgttgccattccgaggggaggggaaagcttgataagggctgttgttgaacacgcaaaagttcccgtcattaaacactacaagggtgtttgcaacatttacgttgacgacgaggctgaccttgaaaaggcttaccacatagtttacaacgcaaaggttcaaaggccttccgtctgcaacgctgttgagaacctagtaataaacagaaaaatactgaaagagttcttcccgaagatggcttactacctcggaaaggcgggtgtggaactcaggtgtgatgaagaaagcctgcaggttataaaggaaaacccgaaactctcctttgttaacgcaaaacctgcaactgaagaggattactacgaggagttcttagacttaatactcgccgtgaaggtggtagacgatgttgacgaagcgatagctttcatagaaaagtacggctcaaaacactcggatgcgataatcacggaaaactacacaaaggctatgaagttcttaagggaagtggactccgccgccgtttacgttaacgcgtccacgagatttaccgacggaaacgagttcggactcggagcggaaatggggatctcaacggacaagatccatgcaagggggcccatggcactcgaagagctgaccataccgaagttcgtaatactcggagaagggcaggtgagggacaacttcggtgttcccgaagagtggatgaaggagttttaa

SEQ ID NO: 23766 - DNA, 915 bp, Aquifex aeolicus
atgcttttactgcttcttctcgtctccatagcgttttcagttcccaaacttgtaagtccggaatggttgaaagaaaacttaagtaaaaagaatttggtaattatagaattcggagatacccagtcttaccttgttgaagggcacattccgggagcggttttgacggaaaaggagcagtggaggaagatggatcccgaaacgggagctctcgtgagaagaagtgtggagtactacgagaagttattcaggagctggggaataaacaacgactcggaggtggttatctattacaagggaaacacaaggaacgaaatactcggtgcagtttacgcctactgggtatttcacctcctcggacataaaagggttgggatacttgacggaggttggaaggagtggataaaaaagggataccccgtgagttacgaagaaccggaaataaacaggggaaactttaaggcaaagtacaataaagaacttgaaactaactggaagtacgtttacgaaaatataggaaaaatacccataattgacggcagattgcctgatttttacttcggtataggaaagtttccggcagctaaaaagtacggacatatcccctgttctgttcctttctcatgggagtggtgggtaaagagggatagagagacagaaaaactttacatcgaatttccctattatgcaaaagagtttttaaggaaccaaggcttaaaacccgaggacgaggtaatactcttttgcttcggaggaactggagccgctttcctttactgggtgtttgacgtatccggacacaaaaatatgaaggtatacgacgcttcaaaaagggaatgggaagccctcaacttacctttaaacaggtacgtatgggaaacctttagggattgtagaaagttcttttacactaattaa

SEQ ID NO: 23767 - DNA, 1641 bp, Aquifex aeolicus
ttggaaaaaattaaatacttaaaatcgattcagatttctcaacgctctgttcttgatttaaagcttctggcagtgggagctttcacccctttagacaggtttatgggagaggaagactacagaaacgtagttgagagtatgcgtctaaagagtggtacactttttcccatacccataactctccctatggaaaaagaaattgcaaaagatctaaaagagggagaatggattgttctcagggatcccaaaaacgttcccttagcgataatgagagtggaagaggtttataagtggaatttagagtatgaagctaaaaatgttctcggaacaacggatcccagacaccctctcgttgcagaaatgcatacgtggggtgagtactacatttcgggagaacttaaagttattcagcttccaaagtactacgattttcccgagtacaggaaaaccccaaagcaagtaagagaagaaataaagagcttgggactggataagattgtagctttccaaacgaggaaccccatgcacagggttcacgaggagttaaccaagagggctatggaaaaagttggaggcgggcttttactacacccagttgtaggcttgacaaagcccggcgacgttgatgtatacacgcgtatgcgtatctacaaagttctttacgaaaagtattacgacaagaaaaaaaccattcttgcctttttgcctctagccatgagaatggcaggtccaagagaagcactctggcacgggataataaggaggaattatggagctactcattttatagtgggaagggatcacgcaagtcccggaaaagactctaaaggaaaacccttttacgatccgtatgaagcacaagaactctttaaaaagtatgaagatgaaataggaataaagatggtaccttttgaagagttggtttatgttcctgaactcgaccaatatgtggaaataaacgaagctaaaaaaagaaacttaaagtatataaacatctctggaacggaaattcgagaaaacttcctgaaacagggaagaaaattacctgaatggttcacaaggccggaagttgcagaaattctggcggaaacttacgttccgaaacataaacagggtttttgtgtgtggcttaccggtctaccatgtgcgggtaagtccacgatagcagaaatcttagctaccatgctccaagcgaggggaaggaaagtaactctgctggacggagacgttgtaaggactcacttgtcaagagggcttggcttttcaaaggaagacaggattaccaatatactccgtgtagggtttgtggcttcggagatagtaaagcacaacggagttgttatatgtgcactcgtgagcccttacagaagcgctagaaatcaggtaagaaatatgatggaagaaggcaagtttatagaagttttcgtggacgctccagttgaagtgtgcgaagagagagatgtaaagggtttgtataaaaaggctaaagaaggactaataaaagggtttacgggtgttgacgatccctacgaacctccggtagctccagaagttcgcgtggataccacaaaactaacgcctgaagagagcgcactcaaaattttagaatttttaaaaaaggaaggcttcatcaaagattag

SEQ ID NO: 23768 - DNA, 1038 bp, Aquifex aeolicus
atgtctggaaagcgtgctttaattacaggaatcagggggcaggatggagcttacttggctaagctcttattagaaaagggatacgaggtttacggagctgataggagaagcggagaatttgcgagctggagactgaaagaactcgggatagaaaacgacgtaaagatcattcacatggatctgcttgagttttcaaacattatcagaaccatagaaaaggttcaacccgatgaagtttacaacttagcagctcagagctttgtgggagtttcctttgaacagcccatacttaccgcggaagtagatgccataggagttctgagaattcttgaagctctgagaacagtaaaacctgacaccaagttttatcaggcttccacgagcgagatgttcggtaaggtgcaggaaattccccaaacggaaaaaacgcctttttaccccagaagtccttatgcggttgccaaactcttcggacactggataacggtaaattacagggaagcttataacatgttcgcctgcagtgggatactctttaaccacgaatcacccctaaggggtattgaatttgtgacgagaaagataacatacagcttggcgaggataaagtacggacttcaggataagttagttctcggaaacttaaatgccaagagggactggggatacgcacccgaatacgtggaagctatgtggcttatgatgcagcagccggaaccagatgactacgttatagcgactggggaaacccataccgttcgggaattcgtagaaaaagcggcgaaaatagcggggttcgacatagagtgggtcggtgaagggataaacgagaaaggaatagacagaaacacaggtaaggtgatagtggaagtctcggaagaattcttcagacccgcggaagtggacatacttgtaggaaatcccgaaaaggctatgaagaagctcggatggaaaccgagaaccacttttgacgaactcgttgaaataatgatggaagcggaccttaaaagagtaagagacagagaagttagcgtttaa

SEQ ID NO: 23769 - DNA, 930 bp, Aquifex aeolicus
atggggactaaaataatcggaaccggcgtttacctgcccaaaaacgtccttacaaactttgaccttgagaaaatagtggacacatcagacgagtggataacaacgagaacaggtataaaggaaagaaggatagcgaaagaggaaacaattacctacatggcaacgcaagccgcaaaagaggcactccgagaagctaacttgtctccagaggagctcgaccttatcatcctcgcaaccctaacaccacaaaagaggtttccgtcaaccgcctgtttggttcaggcacagttaaaggcgaagggagtttacgcctttgacatatcggcagcctgtagcggatttatatacgctctggacatagcagacagctttataaagtcgggaaaggctaaaaacgttctcgtaataggtgcggaaaagctctccgaggcggttgactgggaggaccgctccacctgcgttctcttcggagacggagcgggggcggtagtggtaacaaggtcagaggacaagagcgacattctcgcaacgaggatgtacgccgaaggctctctggaggaactcctccacgcggataactgcggatacataaggatgaagggaagggagcttttcaaggtcgccgtaaggagcatggaagaggtctgcagggaagttttagaaaaggctggcgtaaaacctgaggaagtttccctagtcattccccatcaggcaaacgtgaggataataaacgcccttgccgaaaaattaaacataccgaaggaaaaggtcttcgtaaacatacaaaagtacgggaacacttccgctgcatccattcctatagcccttcatgaagctataaaagaaggaaaagtaaagaggggagatctaatcctcatgaccgccatggggggcggtcttacgtggggagccgtgcttttgaggtattaa

SEQ ID NO: 23770 - DNA, 516 bp, Aquifex aeolicus
atggaagacttctacgttgaagattaccttgtaaagggagatcgctactacacaaaagagcacgagtgggtcagggttaaaaacggctttgcggaagttggtataacagattacgcccagaaacaactgggagacatagtttacgtggaccttcccgagaagggaaaggaggtggatgcgggagacaccttggctaacatagagtccgttaaaaacgtagctcccgtttacgcacccgttacgggcacagttgtggaggtaaacgaggacctcaaagacgagccggggataataaacgacgacccgtatgaggcgggctggatagctgttatagagatgaaggatcccacggaagtggaagatttgatgacagcacaggattacgcagagtacctcaaagaaattgtagaagaggaaaaggaagaagaagttgaagtaaaagaagaggaattaatagaaaccgagtccatagaagagttgtccgaagaagaactcggatacgaggagaataaatga

SEQ ID NO: 23771 - DNA, 1206 bp, Aquifex aeolicus
atgaagaaaaagagggtaattctcgcatactcgggcggactcgacacatccataatagtgagatggctcacggaaaaagggtacgaggtaataacatacaccgcggacgtgggacagggagaagaactctctgaaattcccgaaaaggcaaggagagcgggagcgattgaagccatagtagaggatttaaaagaaacctttgcggaaaattactgccttccaactttgagggcattagccctttacgaagggaagtaccccctcaccgcagccctctcaagacctctcatagcagagaggctcgtttactatgccgaaaagttcaacgcggactacgtagcacacggctcaactgggaagggaaacgatcaggtgaggtttgaactctcagtctgggccctaaaccccgatatagaggttctcgctcccgtgagagaatgggagttcaaatcaagggaagaacaagttgagtacgctcagaggttcaacatccccgttaaagctacgaaagaaaagccatactccatagacaggaacctctggggcgtttccatagagtgcggacccttagaagacccgtggcaagaaccaccgcaagacgcttaccagatcacccaatcccctgaagaggctccggatgaaccagaatacgttaccgtgggttttgaaaaaggaaaacccgtttacctgaacggtgagcgctacgaagagcagtggaaattgatagccaacctaaatgaaatagcgggaagacacggtgtgggaaggatagacatggttgaaaacagactcgtagggataaagagcagggagatatacgaagctcccggagccatggttctctacgaagcatacagggatttactctctttagttcttgacaggtttaccttccactacttcctcacccatattccccacgagtacgcaaagctcgtttacgaaggtctctggttcacccccttgagggaagcgcttgacgcctttacgaataaaatcgccgagttcgcaacgggagaagtaagattaaaactctacaaaggaagtgtaagcgttgttgggagacgttcacccaactccctttacgttgaagagctcgcaacttactcggaaaaggaccaatttgaccaaatagcaggtaagcacttcacaaaggtatggggacttccactgaaggttctgggaagggtgagaaaaggtaaatag

SEQ ID NO: 23772 - DNA, 885 bp, Aquifex aeolicus
atgtttcaaggctcaatagttgctctgattactcccttcaaggaaggagaagtggactacgaagccctcggaaacctaattgagtttcacgtggacaatggtacagacgcaattttggtttgcggaactacgggagaatccccgacccttacctttgaagagcacgaaaaggttatagagtttgccgtaaaaagggcggcgggaaggattaaggtaatcgcaggaacgggcgggaacgcaacccacgaagcggttcacctgacagcccatgcgaaagaagtaggagcggacggagccttagtggtcgttccatactacaacaagcccacacaaagaggtctctacgagcactttaaaacggttgctcaggaagtggacattcccataatcatttacaacataccctcaagaacctgcgtggaaatttccgtggacaccatgttcaagctcgcgagcgagtgcgaaaacatagtcgcttcaaaggaatccactcccaacatggatcgcatttcggaaatagtaaagaggctgggagaaagtttcagcgtcctttcgggagatgacagcctgactcttcccatgatggccctcggtgctaagggagttatatcggttgcgaacaacgtaatgccaagagaagtaaaagaactcatacgggccgctttggaaggagactttagaagggcgagggaaatccattactaccttcacgacctatttaaggttctctttatagaaacgaatcccattcccgtcaaaaccgcctgctggatgctgggtatgtgtgaaaaggaattcagacttcccttaacggaaatgtctccagagaatgaaaacaagctgagagaagtcctaaagaagtacaacctacctctgaaaaactaa

SEQ ID NO: 23773 - DNA, 1164 bp, Aquifex aeolicus
atgactgttgtaaatgagtacagacccgttgaagttttcttcggcgaaggagcggtaaaaaaagcgggagaagtagggagacgctttggcttcaaagccctgatagttactggaagaaaaagcacaaaggaaagcggtgcactggataaattgataaactccttaaaacaaaatcaaatagagtacgtggtatttgacgagataactcccaacccgacggacaaacaggtaaacaaaggtgcagagatagccgtaaacgaaaaagtggactttatcgtaggtatcggaggaggaagtgtcttggacgccgcgaaagcaatttccatagtatcttccaacgaaggttacgcctgggattacgtaaggtatccggaagggagcaggctgattccctttctgaacagacccgtgataacgataccgacaacggcgggaacgggaagcgaggtaaacaggtattccgtactcacaaacccgatgacaaaagaaaaaatggtaatttcccacagcctgaactacccgaaggttgcactcgtggacccggagctaacttatagtatgcctcctagactcaccgccctcacaggctttgatgccctgatgcacgcccttgagagtttgacgaataaaagagaaaacttcatagctgaagagtactcggtaaaggcgatagagcttataaggaagtggcttcccgtagcctttgaagagccagaaaataaagaagcaaggcggtacatgagttacgcagctatgcttgcggggatagctatagaccacctcggagttgccctcatacacgcaatggaacaccccgtttcgggacactaccccgaggtggcacatgcggaaggactttcggcgctcgctccttacataaccgcctttaattacagaggaaaccctgagaagtacgccctctttgcaagactgatgggagaagaagaaaaacctcacaaagcggtggacgctctcgttaagttcatagaaaggttttctctcccaaaaaccctgaaggagcttggagtagaaaaggaaaaactcccgagacttgccgaagacgtttacatgtgcgcaaggcactcctttgccgttaaccctgtagaagtaggtatggaagaagtagaggaactctacgaaagggcttacgaaggaagattatga

SEQ ID NO: 23774 - DNA, 1248 bp, Aquifex aeolicus
atgaaaatactcgttcagaagttcggcggaacctccgtgggaaccctagagaggatagaactttgtgcaaagagagtaataaaagcccttgaaaagggctacaaacccgttgttgtttcttccgcaatggctggagagactgactctttaatagaactcgccaaaaaagtacacccaagacccccggaaagggagatggacacactccttgcagtgggagaacaaaaggctatagccctctttgctatgactttaaataaactcggataccccgcggttagcctgtgcggctggcaggttcccataataacggacaacgttcacacaaaggcaagaatcagaaagataggtataagcagacttctcagcttaatagaggaaggatacattcccgtcgttgccggatttcagggagtgacggaagactgggaaataacgaccttagggagaggtggttccgacacgacagcggtagccctcgccgcagcccttaaagcggactgtgagataaacacggacgttcctggcgtatttaccgcagacccgaggatagtcccgaacgcaaagaagataaagaaaatttcttatgaagaaatgctggagctcgcatcccttggtgctaaggttatgcagataaggagcgttgagtttgctgcgaagtacaacgtcaggatacacgtgaggagtaccttctcggaggaggaggggacttggatagttccggaggatgaagtcatggaaaaggtagctgtaaggggaattaccgttgacacaaaagaaacgaggtttaccgttgtaagggttcccgacaagccgggaatagccgccgaaattttcaaagctctcggagatgcccacatagtggttgacatgattgtccagaacgtgtcccacgaaggttacacggatatgtccttcacggttaacaaaacggacgcggacaaggcagaagagatagtcaagaagatagcccagaagataggggcaaaggaagttgtaagggacgacaaagtagcgaaaatctctatagttggcatagggatgaagagcgcttacggcgtggcgggaaggatgttcgacatactcgccagaaacggtataaacataaaggctatatccacatccgaaataaagatatcctgtctcatagacgaaaagtacgcggagctcgccgtgagggcactccatgaggagttcatagaggaaatggaggaatttgaaactataaacgggaaaaataaagagtag

SEQ ID NO: 23775 - DNA, 1131 bp, Aquifex aeolicus
atgtacaacctcagaatggctgaatccgtaacggaaggccacccggacaaaatagcggatcaactcgctgatgcactccttgacgagttcataaagaaggatccttacagcaaagtctccttagagattatggtaaccacaggactcgttatggtaggaggggagctcaccacggaaagctacgtggacatcccaagagttgtgagaagcgttattaaggatatcggatacacgagacccgaactcggttttgatgcggacacctgcgctgtagttcagtccatagacgagcagagtcccgaaattgctttaggtatttcctcggagggtgcgggagacaccgcgatagttgtgggctacgccacgaaggaagctcctaacctcatgccctggcccataacaatagcccacaagatcacaaagaggatatccgagtacaggaagataggaaagtttcccttcctgaggccagacggaaaggttctcgtggctatgatttacgaggacgggaagccctcttacgttcagagcatagttgcctacgtccaccacgaccccgacgtttccataaatcacctgagggaactaataattgaagaaattattaaaaaggaaattcctgaggagttcttgacggaaaaaacgagcataaaggtaaaccccacaggcaggttcgtaattggtggacccgttgcggacacgggactcacaggaaggaagatagtttccgacgcatacggagatataggactctccggcggtagtgccttttcaggcaaggacccgacgaagacagatcgttcaggttcttaccttgcgaggatgatagcgaaacacgttgttgccggtggatgggcagagaggtgtttggttcagatagggtacgccttcggacttaccgaacccgttgcttttgacatagaaaccttcggaacggagaagataagcaaagaaatactggaagacgctgtaaagaaggtatttccattaagaccagcggaaataatagagttccttgacctcaggaaacccatatacaggcaaacatccgtttacggacacttcggaaaggaaaacctcccatgggaaaagttaacgaagcttgaggagctgaaggagttactcgattaa

SEQ ID NO: 23776 - DNA, 1614 bp, Aquifex aeolicus
atgtctaaaaaggttgtaatactcggaagcggacccaacagaataggacaaggtatagagttcgattacgcctgtgttcacgccgttttttctcttcaagaagaaggttattacgccgtaatggttaactgcaatcccgaaaccgtttctaccgactacgacacagccgataaactctactttgagcctattgtctttgaacacgtaatggacataatagagcgagaaaaacccgaaggcgttatactccagtttggcggacaaacccctctgaagctagcactcccgcttcaaaaaaacggagtaaaaatcttaggaactaaacccgaaagcatagacaaagctgaggacagggaacttttcagggaattaataatagagctggggctcaagcaaccaccaagcggtactgcaagaacaaaagaagaagccctaaaaatagcaaaggaaataggcttccccgttcttgtgagaccctcttacgtactcggcggaagggctatgcggatagtctacgacgaggaagaattgaaggaatacctcgaagaggctgtaagcgtaagtcatgagagacccgtattaatagacaaattccttgacaacagtatagaactggacgttgacgcggtatctgacggaaaagacgttttaatcggagcggttatggagcacatagaagaggcgggagttcactccggagacagcgctacttcaatacccccctactccctttccaaggaaattgtagaagaagtaaaggaacagacgagaaaactcgccgtagcccttgaggtaaagggactcataaacgttcagtacgcggttcaaaacaacgaggtttacgtccttgaggtaaacccgcgggcttctagaacggttcccttcgtcagcaaaagtataggttatccccttgcaaaaatagcaactaaagttgcaattgggaaaagcttgagggaaatactaccggaagtctttgaaagacttgagaaaggagaggcacactttgcctcggatttcctccctaaagaaaaaaagatattctctgtaaaggaagtcgtatttccctggaaacgttttccggaagttgacccgattttagggccggaaatgaagagtacgggggaggttatggggatagataaagagttcggactcgcctactacaaggctcagctttcagctggctacagacttccagaaaagggaaacttatttataagcgttgcggacagggacaaacccaaaatccttgaacttgcaaaagaatttgagaaactcggttttggtatatatgcaacttccggtacttacaaatttctaaaggagcacggtgtaaacgccaaaagggttttgaaggtttcagaaggcagacctaacgttgttgacatgataataaacggagaaattcatctggtaataaatactccctccggaaagcgtgaaaagagcgacgcttattacataaggagggcatgcgttcagtttaacgttccttactacactacgatgcgtgcgggatacgcagttcttgaagcaataaaaagcataaagaaattaaaagaagaaggaaaaggcttaagtgttcattcccttcaagagatttataatatttag

SEQ ID NO: 23777 - DNA, 1257 bp, Aquifex aeolicus
atggaatttgacgtgaaggatttgtccttagcggaagagggattgaagaggattgagtgggctgaaatggacatgcccgtcctcaggcagataagggaaagattttcaaaggaaaaacccctgaaaggtaagaagatttccgcatgccttcacgtaactacggagaccgctaaccttatgagaactttgaaggaaggaggagcggaagtttacctaacggcttcaaatccactatccacgcaggacgacgttgcggcggcactcgtaaagtactttgaaattcccgtttttgcaatcagaggagaggacagggaaacttattacaagcatctgagggctgtgatagaaaaggaaccggacgttgttattgacgacggtgcggatttaatttcaacgcttcacaaagaataccccgggcttgcggaaaaggttctcggcggtatggaggaaaccacaacgggagttataagactgagggctatggcagaacaaggagttttaaagtttcccataatagcggtaaacgacgcatacacaaaacacatgtttgacaacaggtacggaacgggtcagtctacgatagacggtattttgagggctactaacagacttctggcgggttcatacttcgtagttgcgggttacgggtggtgtggaaaaggagttgctcaaagggcaaggggaatgggagcgatagtgatagttacggaagttgatccgataaaggctctggaagccagaatggacggatttctggtaatgcctatggaagaggcggcaaagctcggtgactttttcgtgaccgtcacgggaaacatacacgtcattagaagagaacactttgaagtaatgaaggatggtgccatagttgcaaacagcggacactttaacgtggaaatagacattccggcacttgaagaaatggcggtagaaaaaagggaaataaggaaagaagttacggagtacaaattaaaggacggaaggaggatatacctccttgcggaagggaggctcgtgaacttagctgccgcggaaggtcacccagcatctgttatggacatgtccttctcaaaccaggctctgagtgctgaatacatagtaaaacaccacaaagaactcgaaaaaaaggtttacagagttccgagggaaatagacgaggctgttgcaaggttaaagttaaacgccttgggaataaagatagacgaactcacggaagagcagaagaaatacctgagttcctgggaaatgggcacctga

SEQ ID NO: 23778 - DNA, 1263 bp, Aquifex aeolicus
atggaactgctcaaagagtacaacccttaccttgagtacagagatggtgagcttttcatagagggtgtttccctgaaagaactggcacagaccttcggaacacccctatacgtttacagttcaaactttataaaggagcgtttcgaggcttacaggaaggctttccccgacgcactcatctgctacgccgtgaaggcgaatttcaacccacaccttgttaagcttctcggagagctcggagcaggagcggacatagtttcgggcggagagttatacctcgccaagaaagcgggaattccccccgagaggatagtttacgcgggcgtgggaaagacggaaaaagaactcacagacgctgtggactccgaaatcttgatgttcaacgttgagagcagacaggaactggacgtgctgaacgaaatagcgggcaaactgggaaagaaggcgaggatagccataagggtaaacccggacgttgaccccaaaactcacccctacatagccacgggaatgcaaaagagtaagttcggagttgatataagagaagcccaaaaggagtacgagtacgcctcaaaactcgaaaatctggaaatagtagggatacactgccatataggctctcaaatactcgacatatccccctacagggaagcggtcgaaaaagttgtaagcctttacgaaagcttaactcaaaaaggctttgatataaagtacctggacataggcggaggtctgggcataaagtacaaacccgaggacaaagaacccgctcctcaggatcttgcagatctcctcaaggacctccttgaaaacgtgaaggcgaaaattatactcgaacccggacgttcaataatggggaatgctggaattttgataactcaggttcagtttctcaaggacaagggaagtaagcactttataatcgtggatgctggaatgaacgaccttataagaccttccatatacaacgcgtaccaccacataattcccgtagaaacgaaggaaaggaaaaaggtagttgcggatatagtagggcctatatgcgaaacgggagacttcctggcacttgacagggagattgaagaggtccagaggggcgagtaccttgcggttctgtctgcaggagcttacgggtttgctatgtcttctcactacaacatgagaccgagagcagctgaagtgcttgttgaaaatggtagcgttaagttaataagaaagagggaaaattacgattacatcgtagaaccttctcttgatatctga

SEQ ID NO: 23779 - DNA, 1422 bp, Aquifex aeolicus
atgagtaaagtgaaaacgaggttcgcacccagtccaaccggatacctacacctcggaaacgcaagaacagccatattcagttatctgtttgcaaggcacaacaacggaggttttgtacttcgtatagaggacaccgatccagagcgttcaaagaaagagtatgaagaaatgctgatagaggatttaaagtggctcggtatagattgggacgaattctacagacagtccgagaggtttgacatatacagggagtacgtgaacaagctccttgagagcggtcacgcttacccgtgtttttgcacgccggaagaacttgaaaaagaaagagaagaggctagaaagaagggaattccttacaggtattctggaaagtgcagacacctgacaccagaagaggtggagaagttcaagaaggagggaaaacccttcgccataaggtttaaagttcccgaaaacagaaccgtggtgtttgaagacctaataaagggtcacatagccattaacacggatgacttcggggactttgtaattgtcaggagcgatggctcacccacttacaacttcgtcgttgttgttgacgacgcccttatgggaattacccacgtgataagaggagaggaccacatacccaacactcccaagcaaatactcatatacgaagctctcgggtttcccgttcccaagttcgcacaccttcccgttatactgggagaggacaggagtaaactctcaaagaggcacggagctgtttcggtaagggcttacagggaagaaggctatatgccggaagccctcttcaattacctctgtctcttagggtggtcccctccagaagagggaagggagatattctcaaaggaagaactgataaagatttttgacctcaaagacgtaaacgactccccggcggtcttcaacaaggaaaaactaaagtggatgaacggagtgtacataagggaggtgcttcccttagacgttctccttgaaagggctattcccttcttggaaaaagcgggctacgacacgagcgacagggagtatataaagaaagttctcgaatacacgcgcgactcctttgatacattgagcgaaatggtagacaggctcagacccttcttcgtggacgagtttgaaataccagaagagctctggagcttcctagacgacgaaaaggcttatcaggttctctcagctttcttggaaaaaatcagggagaaaaaacccgaaactccccaggaagtaaagaagctcgcaaaggaaatacaaaaagccctgaaagtaaaaccaccgcaggtatggaaacccctcaggatagccctcacgggtgaactcgaaggtgtgggcatagacatactcatagccgttcttcctaaggaaaaaatagaaaagaggatactgagggttctggaaaagctctcgtga

SEQ ID NO: 23780 - DNA, 765 bp, Aquifex aeolicus
atgcctcagtacgcgctcgttatagatttgaacacctgtgttggttgtcacgcctgtgcgacgaattgcaaagagtggaacactcaggcggctttcgggcccttatccgattacgacccctacggaagggaagcttcaggagtctggtacaacaggatattcacttacgaaacgggagagttccccgaaacgcaggtctttcaccttccaaaatcatgtctccactgtcaggacgctccctgcgttcccgtttgccctacgggagcaagctacaaaagggaacaggacggaatagttctcgtgaactacgacgactgtataggttgtaagctatgttcctgggcatgtccttacggttgcagggagtttgacgaggcggacaaggtaatgaagaagtgtaccctctgtatagacaggatttacgacgagacacttcctcccgaacacagacagcccgcgtgcgttctcacttgtcccgcgagggcgaggttcttcggagacatagaagacccaaacagcgaggtttacaaactcattaaggaaagaaacggatttgtcctcttccccgatatgggaacgaacccggcaaaccactacctcccgagacaggaaacgaggataaaccttgaagagtttgaaaagcacatactaaagcccgacaacccgctcttcctggaagttatgaggagacaccacacctcttcaaaggctcaagcacaggaaacacctcaagaggaagtaacacattctgaagaattaccataa

SEQ ID NO: 23781 - DNA, 2955 bp, Aquifex aeolicus
ttgcttataagacccataagtttcgcttataatcccttaagaaagtgtgactgtaaatggaaaagtttaagacttattctaaatggaagtacaggagggttaaaaatggaaataggcggtagtttttacgaaaggaagtattacagcacctgttatatgtgtgcgtgcaggtgcggtatagaagtttacgtcagaaacggaaaagttacatacataaaaggaaacgacgaccacccgcttaacaaaggagttctctgtgctaagggttcttccggaataatgaaggaatactcccccgcaagattgagaaaacccctcttaagagtaggaccgagaggttcaggacagtttaaagaaatagagtgggacgaagctttagagattgcagcaaagtggattaaggaagcggctcagaaaaacccctcaaaggtcgctttcttcaccggaagggaccagatgcaggccataaacggctggtttgcaggacagataggaacgctgaactgggcagctcacggaggattttgttctgtaaacgttgcagcagcaggactgatgtcagtaggatactccttctgggagttcggggacccggactttgagcacaccaagtacttcatgatgattggtgttgcggaagaccatgcttctaatccctttaagctcggaattcaggaattaaagagaagaggcggaaagttcgtattcgtaaatcctgtaaggtggagttacggggcgatagcagacgagtgggttcccataaagcccggaacggacggagcctttatcttaggcctcgcacacgttctatttaagtacaacctgatagattgggaattcttgaaagagttcacgaacgccccctggctcgtaattcaagcacctggaacacccaaggacggactcttctacaggaatgaagaaggaaagcccatggtatttgacaaaaagtccaactccttcaaacccgcagacaggatagttcccgaggaccttgatcccgcgtttataggagaatttgaaacgccagaaggatacaaggtaagacccgcctttgatatcttcgcagaaagaattgttaaggactatacgcccgaaaaagttgaaaagattacaggaattcctgcggaaacgatagagagaatagcaaaggaactcggtgttacggctctttacaaccccatagaactcccgatagagtggacagacgtctggggcagaaagcacaagaagatggtgggaagaccagtttccttccacataatgaggggaatagcttcccacacaaacggataccagaccgcaagggctgtatttgtccttatgatgctcctaggttgcatagacagacccggcggacacctcgcaaaaccaccctatcccaaacacatagaagacctacccaaacccaagaagataaaatcccttgatgaacttgaatttggaaaaccttacggacctcacctcggaataccacaaagccctgacgacctcctcgtggacgagaaaggaaatcccttaagaatagacagggcttacagctgggagtttccgatagcggctcacggttgcatacagaacgtaatccccgcggcataccagaaggatccctacgacatagaagttcttatgatttacatggctaacatggcttggaactcctcccagaacattccctacatactggaggcccttaccgcaaaagatgccagcggaaactacataatcccaaagataatcacgatagacgctttctacagtgaaatggttgcatactccgatttagttctacccgacgccacctacttagaacagtggttcgcactctcacttctggacagaccgccttccgtggcatcgggacccgttgacgccataagacaacccatagtggaaccgcaggacctcaaaggtgaaaaactggacgtgctcccgtggggagaggtaatggtaagactgggaacgaagctgggacttccgggattcttaaatgaggacggaacacctaagtacaaagattggaaagacttcctcataaactggcaacctcaacccggagtgggagcacttgcgggatggagaggaaagaatggcgataaacacttcgtaggtgaacccaatcccaaccagcttgagatgtacgcaaagaataaaggattcttctactacccacttcccgaacacatgaggtattacaggcacgttaacaaggattatcttgagtgggcaaagagcgtgaagttcgtaaagagaacggacccgataataatgaacttctacgtggaaacactacaaaagtttagactcgcgggtcaggggctctgggaaggggaaaatcaacctcccaacgacccggcaatcagggagaggctcgtaaggtactttgacccgctacccttctggtacccgccctttgaagaagaagtcagcggaaaagattatcccctctacgcctttacaaagagaccccagtggatgtatcactcctgggactctcaaaacgcatggctcaggcagatatcaacgagaaactatctttacatgaatccaaaaaccgctaaaaagctcggaataaagcaccttgactgggtatgggtagagtcgagaataggaagggttaagtgtcaggtattccttaccgagtgcacggagcccaattccgtatggacctggaacgccataggtaagatgataggagcctggggattaaaacccgaagcggaagaaggacatcagggattccttctaaaccacgtaattccccactccataaagatgaacggaaaagagttctactacggagacccgataaccggacaccttgcctggtttgacacgaaagtcagagtttacaaagcagaagatcaaacacccgaaacttatcccgagtttaaagtagagcctctgccttacataaaggagaggtgggttgacgttctcaggtataaaccttaa

SEQ ID NO: 23782 - DNA, 726 bp, Aquifex aeolicus
atgaagttgttcataacgggaataggctcagggctgggaaaggcactcgtagaggaaggaataaagaggggctacgaggtttacgctttaagcagacacctgcccgaggaattcaaggagaagatacactttgtaaagtgcgaccttttaaaggtagaagaagttcaaggctgtctttttaaactccttagtggtgtaaaagaactggaacttgcaatcctgaacgcgggaatcctcggaaagttttccgatatgaaggacataagcctacacgaaatagacgaagtgatgaaggtaaacctgtggtccaacaaggtaataatagacacgcttatggaactcggaataaaggtaaaaactttaataggtatttcttcgggggctgcgaggaactgcaacaggggttggaacgcctactccctttcaaaggcggggctaaactgcctcttaaaactctactcctgggaactccccgaaactaaagtaatttccttggctccaggacttgtgctcacacctatgctgaaagaggtaatgtcgcagaatgaggaaaagtacccgtccataaagaggataaagaacgctcctaaactcacacctgaaaagactgcggagtttatattttccattcttccgaaactggagagtgtagagtcgggctcctttgtggacgtccgagactttcccgagtacgaggagtacattttaaggtacggagtttactga

SEQ ID NO: 23783 - DNA, 1221 bp, Aquifex aeolicus
atgggcgaaatattcgtggcgggtgtaaacttcaaggtagcacccgtagaggtaagggaaaaactcgcttgctctctggaagaaactaaaaaggtcttaccgattttaaagagggaaactccattagaagaagtcatgctcctctcaacgtgcaacagggttgaggtttacgcctataatttcgtggaaaactccgaagatctaataaataaacttttagagataaaaaggttaaatccaagctttaaaaggtacttttttgtaaaaaggggagaagaagcggtttaccacatcttcaaagtggcctcaagcctagactccatggttatcggagagcctcaaatagtcgcccagtttaaggaagcgtacagagttgcaaaggaagctggaaccgtcggaaagattttaaacagggtttacgagaaagctttaagggcttccaaaagggttaggacggaaacgggaataagcaggagtgcggtatccgtaagttacgcggctgtagaactcgcaaagaaaattttcggagacttgaaggaggcaaaggttcttttaatcggtgcaggcgagatgggggaactcgctgcaaactacctcagacgctttggagcaaaactccacataacaaacagaacctacgaaagggctcttaaactcgtcaaggaactcagcggtaatgttctgagatttgaagaactaaaggagtaccttcccctgatggacatcgttatcgtctcaacgggggcaaaagattacatactcaaaagagaggattttgaacgctccgtaagggaaaggcattacgaacctcagttcgttatagacatagccgtcccgagaaacgttgatcctgaagcgggaaatgtggaaggtgtattcctttacgacatagacgacctcaaacaggtagtggaagaaaacttaaaggagaggataaaggaagcccagaggggtgagataatcctctgggacgaagttaagaagttcatgaactggtacgagtctttaaaggccgaaccctacattctggaactaaaagcaagtgttgaagggaaagaggtaagtccttacattaaaaaattggtgcacagggctattaaggaaatcaaaagaaatcccgaagttgcggatataatcttaaggatattcaaggaggtagagaagaatgaacccagaagaaaggaattatccaatgtctataacggaactcatggagcttga

SEQ ID NO: 23784 - DNA, 1299 bp, Aquifex aeolicus
atggaaaagctcattattttgggtgcccagtggggtgacgaaggaaagggtaagatagtagacctcctttctgaacactttgacataaccgtaaggtatcagggcggtagcaacgcgggacatactgtagtcgtaaactcccagaagtttatcctccacctccttcccacgggcatactccacgaacacgtaaagggcgtaatagcacagggaatggttgtggatcttgaagttctccacaaagaggtaaagaatctcgaagaaaaggggatatacgtaaaggaaaggctgtttataagcgacagagctcacctcgttatgccctaccacaagctcctagattccctttttgaaaagaaaaagggtataggcacgactttaaggggtataggccccgcctacatgttcaaatacggaaggaaggggataaggataagcgatctgaaagacgaaaaacgcttttacaccttgctggaagacaatctagatttcgttaaaaacatttgtgaaaaggtattctgcgaaaagtttgaccttgacataaaccagatttacgaggaacagctcaggtactttgaggagtttaaagaaaacgtcgttgaccttttgaggtttttcaacacccagaaaggttcagtcctatttgaaggtgctcaaggaacgctccttgacgttgacatgggaacttacccttacgtgacttcttcaaacgcctcagctctcgggctttccaacggaactggtatgcctcccaagtacttctccgacgctttcttcctcggcgtggcaaaagcctacaccacgagggtaggagaaggacctttccccacggaactcaaaggcgaagagggagaaaaactcagagaacttggcggggagtacggatccactacgggaagaccgagaaggtgcggttggttagacctcgtagccctaaaatacgcagttcaggtaaacgggctcgacgggtttgtgataacgaagcttgacgttttagatacctttgacgaggtaaaggtttgcgtggcttacgagctggacggtgaggtgatagattacttcccagcctcctactcggaacttataagggttaaacccgtatacaaaaccttaaagggatggaagaaaagcacaaaaggtgctaaagacgtcagtgaattgccaaaggaagctctcgattacgtaaaatttattgaagagtacacgggtgtccccgtagtaatgctatccacaggaccgaagagggacgagtacatatggctcaaggagatactccggacaagaagcggctattcataa

SEQ ID NO: 23785 - DNA, 2433 bp, Aquifex aeolicus
atgtttgagaagttcacagaaagggcaagacaagttatcttgagggcgagggaagaagccctcgagctgggacacagctacttgggaagtgaacatattttgcttgctctgataaaggatgaggacatacccgtcctcgtcctcagcaagctgggtgtctctcctgagaagataagaaaggccataatgggccaaataactaagggaagccactcgggagaggtactcttcgcacccgacgcaaaaagggtaatagagtttgcagttgaagaagcgagaattcttcaccaccagttcgtaggtcccgaacacctacttatcggagtggttagagaaaagacgggactcggtggaagaattttaaggagctttggactggacgagtactccgtaaggagagaggtacttcaactactcggagaacttccccctcaagaaagccagaggtacgtatccactcctaaccttgacaggttctcaagggacctcacccaaatggcaagggaaggaaagctcgacccagtaataggcagggaaaaggaaatagagagagttatccagatactcgtaagaagaaggaagaacaaccctgtcttgctcggagaccccggagttggtaagacggcgatagtagaagggctggctcaaaggatagcaaataaggaagttcccgaaccgctactcaataagagggtagtggctttagaccttgcggcactagttgcgggaaccaagtacagaggacagttcgaagaaaggcttaagaacatcttaaaagaacttgagaaggctaacaacgtaatactcttcatagacgaacttcacacactcgttggagcgggttctgcggaaggctcgatagacgcatccaatatgctaaaacccgccctcgcgagaggtgaaattcaggtaataggagctaccaccgtagacgagtacaggaagtacatagaaaaggacggagcactggagagaaggttccagcccgtttacgtagaacagccatcacccgaggatacgatccagatactttacggactcaaacccaagtttgaagagttccacaaggtagagtacacacccgaggcaatagaaaaggctgtggaactctccgtcaagtacataaccgacagaaacctgccagataaggctatagacgttatggacgaggcgggagcactcgtaaagctgaaggcaactcaactccctcctgaactcaaggagatagaggaaaagattaaggaactcgagaaggaaaaggaaaaggctgtaaaggaacaggactacgagaaggctgcaaagataagggacgaagagttgagactcagggctaagttcgaaacgatgaaggctaagtggaaggaagaaatggaaaagaacagacccaaagttacggacgaggacgttgcagaagtagtcgcaaggtggacgggcgttcccgtgaagagggtacacgaaagtgatgcggagaaactcctccacatagaagaagaattgaagaagagggttgtaggtcaggacgaggctataaaggcagtagcgaaggcgataagacgttcaagagtcggactgaaaggaaaacacagacccataggcgtattcatgttcctaggacctactggtgtgggtaagaccgaaaccgcgaaggcacttgcggaatacctattcggaacggaagacgcactcatcaggtttgatatgtccgagtacatggaaaagcacaccgtttcaagactaatcggtgcacctcccggatacgttggatacgaagaaggtggacagctcacagaggcggtaaggagaagaccttacagcgttctcctatttgacgaaatagagaaggcccacccagacgtattcaacatcttcctccagatattcgacgacggaagactaacggacggactcggaaggaccgttgacttctccaacaccataataatcatgacctcaaacctcggagctagactcatcacaggcggaacgatgggattcgaaaagaaacagggactccttaacttcgaagagatgaggaaaaacgtccttgatcaggtaaagagaaccttcagccctgaattcctaaacagactggacgaaattatagtgttcaggcctctcgagaagaaagacatagaacagatactcgaactacaactaaaagagataaacgaaaaactaaaagactggaacgtgagagtaaaactccacaagtccttcgtaaactggatcatagaaaaagagtacaagcccgaattcggagcaaggagcttgaagagggctctccaaagacacgttgaagatctgctcgctgaagaactcataaagggaacgctcaaaggcgtagaagaagtagaaataagggtaaggaacgacaagccctacctcaaacccgtaaagaagaaggaaaaagtagaagcccttctcgaaaagtaa

SEQ ID NO: 23786 - DNA, 1311 bp, Aquifex aeolicus
atggatctgtacgagtacgaagcgtacgataaaattttcaaaaagtacggtattcccaccccgaagtatatgttcgttgaacacattacagatgatgttgttgaattcgtaaatcaactgggtgagtgcgttgtaaagtcacaggttctagtaggaaagaggggaaaagccggagctgtaagggtatgctccaatcccgatgaagctttagaagagattgaaacactcctcaggatgactgtttacggagaaatgcctgttggcgttctcgtagtggaaaaggcaaacatcctgaaagaactttacgcttcaatagtttactccacggaccacagggcacccgtacttaccctcagcttggaaggcggaatggatatagaagaagttccccctgataaggtaaagtcctggccaataaacccgctaaaaggactctacccccacatggtgaggaattacctccttgaacttggatttccccacgaatatatgcccgttctcaggaagctctcagaagttatagcaagaatgtgggacgccttctggggggctgaagcgagactccttgaaatcaacccccttgctattgtggacaggggcggaaagcctgacgttcttgcccttgacgcggttgttaaaatagacgacgacgcatcaataccgcctgcaaagatatacggagtgagaaccgcactcaggagacctcccacagaaagagaaatcgcagccgcggaaatagacaaggacgaccacagaggaaaggcaggctcttacgtagaactcgacggtgacatagctatgatgaccttcggaggaggaggttctaccgttacgatagaaacgtgttacgaactcggactaaaacccgcaaacctcacggacataggcggtaacccgcccgccgaaaagatgtacaagataacgaggataatactctccaaacccggaataagggctgttctaatcgccggaggtactgcaaacaacacgagaatcgacgttactctcggtgaaggtgttgcaaacgcattaagagacctaaagaaagaaggaaaactcgaccccaactggatattcgtggtaaggagaaacgggccggaagctgaaaaaggactcagaatgctttacgaggcctttaaagagtgtggaataaagggagaaatttacgactccgcattgccgcttaccgaagctcccgtgaggcttaaagaactcctcgataagtgccaagcaaaaaaacttgaagaagaagaacaaattaaggaaggacatacatttacggacgagcaagcttctgacctcggaatgtaa

SEQ ID NO: 23787 - DNA, 1197 bp, Aquifex aeolicus
gtgaaaaaactcctttcccttgagaacctcacgctcctttccctaatccttgccgtcttttttggtatttactttaaagaaatagccctgaatatcaaactcttcggggacgttttcttaagtctcctgaaaatgataatagtccccctcgtttttacctccgttttcaccgccatactaaaccttgagagtctggcaaaattcagggatctgggtttaaaagcctttttatactacttcacgaccacgggaatggcggtttttacgggacttgttctcgtgaacataatacagccgggaaagggtgcaagcggagtaagtgcaaaacctgaagaaatcccgaaggttcaggagttttctcttgagaacttaattctcggacttattccccagaatccctttgaggctttttctgaaggaaaggttctccagattatagttttcgcggtctttataggacttgctgttctgactatagataagttcaaacaggaaataataaagaacttctttgagggttttaacgaagccctaatacgactgacaaagtgggttatagtcttaactcccgtgggagtttttgcccttgtttcttatctgatagcaaaggtggggtatcaggttcttatttccctgtgggaatacgcactaaccgttttgctcggcctgctcatacacgccttcgtaaatcttccattaattgcctacatattcggaaggtacaatccctacaagtactttatacaggtgagggaagccctgcttcttgcattttccactgcatccagcgctgcaacgcttcctgtctcccttgaacttgcaatcgaaaggggaaaggtaaaaaaggaagtggctggctttgtcctgcccttgggagctaccataaacatggacggcacggccctttacgagtcggtggcagctgtttacatcgcaaacctttacggaatagacctctcaatctctcaaatggttacgatattcctgaccgcgacgcttgcctctatcggtgctgcggcaattcccggagcgggtttagttctcctgactttagtcctcagttccgtagggattcctttagaaggtataggactcataatcgcagttgacaggtttctggacatgctgagaactgcggtaaacgtctggggtgacctgaacggagctaagattctgaataggtacgtaaacagctaa

SEQ ID NO: 23788 - DNA, 642 bp, Aquifex aeolicus
atgagagtaattctgtttgacctggacggaacacttatagactctgcaaaggatatagccttggctcttgagaagactttaaaagagctcggtttagaggagtactatcccgataacgtaaccaagtacataggcgggggagtcagggctctgcttgagaaggttctcaaagacaagttcagggaagagtacgttgaagttttcagaaaacactacctcgaaaaccccgtggtttatacgaaaccttatccggaaattccttatacactcgaagccctgaaaagtaaaggttttaaactcgctgtagtatcaaacaagctcgaggaactctcaaagaagatcctcgacatacttaatctttcgggctactttgacctgatcgtgggaggagataccttcggagaaaagaagccctctcctacgccggtattgaagactctcgaaatattgggagaagaacccgaaaaggccttaatagtaggagacacggatgcggacatagaggctggcaaaagggcgggaactaaaacggcccttgccctgtggggttacgttaagttaaactctcaaatacccgactttacactctcgagaccttctgacttggttaagttaatggataaccacatcgtggaattttaa

SEQ ID NO: 23789 - DNA, 1032 bp, Aquifex aeolicus
atgaaagctgttatcctcaccggtttcggagggattgaaaacctaaagtacgtggaagacttcccgaagccagaacccaaagaagacgaagtactgataagagtaaaagcggtagcattaaatcacctcgatatatgggttcgtatgggagcccttcccgtaaagcctgaacttccccacatactcggttcggacgtaagcggtgtagtcgaaaaggtgggctctttggttaaaaacgtaaaagaaggagaggaggtgataattgccccgggactttcatgcggggtttgctgggactgccagagcggacgagataaccattgtaaagattatgacatcttaggtcttaagaacaaggggggctacgctgagtacgtggctgttcccgcaaggaatgttattaaaaaacccaaaaacctctcctttgaagaagcagcctcttatccgctcacttttttaacggtctggaacgcactcgttgataaggctcagataaagccctacagcagggtgtttatatgggcgggctcttccggcgtaggtgttgcgggaattcaactggcaaaagcctttaacgctttcgtgattactacagccggaaacgaggaaaaagccaagaagtgtaaagaactaggagcggatcttgttttcaatcactacaaagacgacgtagtcaaaaaggtaagggaagtgtttaaagagggtgtggacgtcgtggttgatcacataggagaggctacattctggaaaagtgttcagatgctgagaaaagggggaaaactcgtattcttcggaacaactacgggaagtaaaggagagatagacataaggtacgtcttcgtcagggaaatacagcttctaggtgtttacatggggagcagggcaaacctctttaagataacggagttatttgagaggggcgtgtttaaaccggtggtagataaagtatttcccttaaaggaagtaccgcaggcacacaagtaccttgaagagtcaaaacacttcggtaaagtagttctaaaggttgagtaa

SEQ ID NO: 23790 - DNA, 1374 bp, Aquifex aeolicus
atggaaaaaccatggtcgggaaggtttaaagaagaaacggataagtttgtggaagatttcacggaaagtgtatcctttgataaagagctcgcctttgaagacatagagcaggatatagcccacgtaaaaacacttcagaaagccggcatcctcacggaagaggaagcgagagaactcatccaagaactcctgaagattaaagaggagatcaaagaagggaagttccagtggaagaaggagctggaagacgttcatatgaacattgaggctgaattaataaacagactcggtgatgtagggaggaaactccacaccgcacgctccagaaacgaccaggtggcaaccgacgaaaaactgtacctgaagaaagaaataaaagaggtactccaactcctgaaagaattgagaaagacgctcgttgagcttgcggaaacaactgtggacttcgtcatgccctcctacacgcacctccagagggcacagcccatcagagtagcccattactttctggcttaccgggagattcttcttaaagactcggagaggttgatggacacgtacagacgggttgacgagcttcctctgggtagcggagctgttgccggtgtagactttcccctcgacaggttctacaccgccgaacttctcggtttcaacagggtaacgaggaactctatgtatgccactgcggaaagggactttataattgaatttctttcaaattgtgcactcatagcccagcatctttcaaggctggcagaagaccttataatctggaacacggaggagtttaacttcgtggagcttcccgacaaactctgcacgggcagttccattatgccccagaaaaaaaaccctgacgttcttgagttgataagagggaaaacgggaaggatttacggaaacctgatcgcccttttgaccaccatgaaagcccttcccatggcctacaacagggacatgcaggaagataaagaacccctatttgacacacttaaaaaccttaaaaacatgataaagggtatgactttagtcctttcagatctgagggttaaagaacagaacatgagaaaggcttctggaaacttcctgcttatcacggatatagcgaactacctcgtagaaaagggtgtacctttcaggacagctcaccacatagcgggaagcatagttgcctacctacttgaaaaaggcaagaagttagaagagatgactttagaggagttcaagcagttctccgaaaagtttgaagaagacgtgtttgatattttgagccctgaaagggcagcggacagaaagagggtttacggaggaactgcgaaagaagaaatcttgaggattattgaggtggcgaaggcagaggaaggtttataa

SEQ ID NO: 23791 - DNA, 933 bp, Aquifex aeolicus
atgcccttagttagtggaaaagttctttttgaaaaagcaaacgagtataactttgcaataggtgccttcaatttcaacaatatggaatttctcaaggcaattctggacgctgctgaagaagaacaagctccggtatttatccaaaccacagaaagcgctataaagtacgcaggcattgaatatctcgcaggcatggtacatgcggtaaaagacaagtattccattccctttgcacttcacttagaccacgggaaacatgtagaaactatcctactcgccataagacacggctacacgtcggtgatgatagactactcagacaaatcttatgaagaaaacttaaaggtaacgaaatatgtcgtatcaatttgtgcagctctcgggatatccgttgaagcggaacttggaaaactcgtaagtgtagaggacgaagttgtaagcagggaagaagttctggtggatcctgagcaagcaaaggagtttgttgatagaacaggaattgacgctctggctcccgcgataggaacggctcacggggcttttaaatttaaaggagaaccaaagcttgattttgaaaggttaaaaaaggttaaggagctcacaggtattgccctggttctccacggggcgagcggcgtttacgaagaatacgtggaaaaaatcaacaagtacggaggggatataaaaggagcgaaaggtgttccggacgaagaattgaaaaaagccgtagaacttggaattaacaaggtaaatacggatacggacctcaggctcgcttttatctcaaagctgagggaattaatggctttagaaaaaaaggtaatagacccgaggaagttcttaaaacccgccatggaagaggtaaaaaatattgtaaagaaaaggataaggctttacggaagccaagggaaggcggaactcttcagagtgtga

SEQ ID NO: 23792 - DNA, 1758 bp, Aquifex aeolicus
gtgatggaatacagaatactggctgagttttacgagaggatagagaagacaacgagcaggatcgaaatggtgagctccctcgtggagctcttcaaacaaactcctaaagaattaatagacaaagtcgtttacctatcaataggtaagatagctcccgagtacacgggacttgactacaacttcggtgaaaagcttgccataagggctctttccagagtcctcaaaatacccgccctggaaatagaaaagagagttaggcaagagggagatctgggagaggctggaaggaaactttacgaagagcttggctttaaacccgaagggacgctaaccgtagaagaggtttacaacggactcttaaacatagcaaaagccgtaggcataggctcgcaggagagaaagataagcatattcgcatctcttttgaaaaaggcaacccctcttgaagctaagtaccttttgagaacgataacggaaaggctgagactcggaataggggacaacaccatactggaggctctttccatagcctttacgggaagttctgtaaacagggaagtggtggagagggcctacaacttgacttctgatctcggctacgtggcaaaaatcctcgcggagaaaggactggaaggggtaaaacaggtaaagatacaggtgggaagacccgtaagacccatgctcgcagaacgtatgagcagtcccatactcatcctcagaaagctcgggggaaagtgcggagcggagtacaagtacgacggggagagaattcaagcccacagaaagggagatgagttttatctcttttcaaggagacttgagaatataactcaccagtacccggatcttatagagtttttaaaagaagcaataccccacgactttatagttgaactggaagcggttgttatagaccccgcaagtggtgagataagaccctttcaggaacttatgcatagaaaagtaaagtacgtaacgaagtaccacatcacgaaataccccgttgcaggctttctctttgacatcatataccttgacggtgaggacctaaccctgaagccctaccccgagaggagggaaatcttagaaaaagtcgtaaagaggacggaccgtataggcctcgttcctagaaagatagtggacaacgtggaggatcttgaaaacttcttttatcaggcaatagaagagggatgtgaggggctagtttgtaagtcgcttgctcccaactccatataccaggcgggaaagagaggctttctctggattaagtacaagagagactacaagtcggtacttgcggacacgcttgaccttgtggtcgtgggcggtttttacggaaaaggacagaggaagggaacgttcggttctctcttgatggcgtgctacgaccctgaaagtgacatgtttaaaacagtgactaaagtgggaacgggatttaccgaagacgacttcaagaaacttgaagagatactcatgccgaggaaactgaaccacagacacccgagggtaaattcaattctcgaagcggacatgtggtttgaaccctatctggttcttgaaataacgggagctgaacttactttgagtcctgttcacacgtgcgggtggggaaaagtctctccgaacaggggaattgggctgagatttccgaggtttaccggaaggtacaggttcgacaaaagaccggaagacgcaaccaccgaacaggaaattatagaaatgtacagaatgcaaagaaagattagagtaagatcctaa

SEQ ID NO: 23793 - DNA, 396 bp, Aquifex aeolicus
gtgaggaagttaaaataccaaagggacttctttccacttttgcacctaaattatgggagtaattggaggtgtggtatggacaggatagcttacttcaagagtttacttgagaaaaatccggacaaccctatggttcactattccctaggacttgagtacttcaaagtgaaggattacgaaaatgccataaagcaccttgagaggtacttagaacttcaggaagacgaaggtgcggcttacagaactttggcaaagtgctacgaggaacttggagagttccagaaggctatagaagttctggaagaaggaataagacaggcgatgaagtacaatcacccctccatggctcaggagtatcagcagtggattgaggagttaaagggaatggctttctag

SEQ ID NO: 23794 - DNA, 2040 bp, Aquifex aeolicus
atgaggaaagcttttaaggtttacgggatgtcgtgcgttaactgcgcaagggcgatagagataacgctgaagagaacagaaggtgtaaaaaacgtaaacgtttcctttgaactgggaagggtggaggtagaatttgacgaggacttaatatccgaagaagaaatagtaaagaaaatagaagaactcggatattcggtagagagaaagaaggactacgacaagctctttttaggtttaggtgtgctttcttccctcttcttcctcgtcgggatgttctttactttccctttaaagtacgaacttcaattcttactctccagtattgttcagttcacggcggggtggaagttttacagaggagcttactcttcccttaaaaagggaatcggaagtatggacacactcgttgccctcggtactacgggagcttacgtttacagcgttctttcttactttaaccttataaattccactccgttttttgagacgaacgtatttctcataacctttgtgagactcggaaagttcatagaggaaaaggctaaggagagggccgtaaagggactcaaagagctcgtgaacctctcatttagaaaggtaaaagttcttgaaggcgaaaaagaagttgagaagaacgtaagggaagttttcaaaggtgagaaggtagtttaccgctccggcgagcagattcttttagacggtgtcattatcaagggcgagggacttgtgaacgaagctgtaatcacgggagaacctgtgccgattttgaagaaggagggagacgaggtttactccggctcagtcttagaaaagggatacataattacgaaggttactaaaacctttgagagttctttcataaacacgatgaaaaaactcgttgaggaaagcctgaaggaaaagccaaaaatccagaggatttccgataaggtttcccactactttgtcctgttcgtggtgattttatcggtaattaccttccttacctggtttataaaaacgggagagattaacagggcggttcagttctcacttgcggttcttgtggtttcctgtccctgtgctttcggtatagccgttccccttgcggtatcggtaggcatatacaaagctgtaaagaggggaattctgccgaagaagggaacaatttttgaagtagcccccaaagtggacactgtgattttcgacaaaacgggaactttaacggaagggaagttaaaagtaaaggaaataaacgttccggagaagtactttgatgtcctctacagcatggaaaattactcaaaccatcccgttgccaaagctgtgagggagtacttaaagccttatgtaaaaagggaagctaagcttgagggttgcgaagaaatactgggagtcggtgtaaggtgtggagagtttatcgctggaaaggcagaactgtggggcaaaaactcccagaacggagtgataagggtgggtttcgggacgaaggacaagctcataggtgagatcattctggaggacagcgtcaggaaggaagcaaaagaagtggtggagtttttaaagggaaaaggtattaacgtaattctcctcacgggagacacaaaggaaaacgcacaaaggatagcaaaggagctcgggataaaggaagttatagcgaacgtaaagcctgaagagaaattgaaggttgtaaaagaacttcaggaaaaggggagaaaggtgtgcatggtaggggacggggtgaatgacgctcccgcccttgcccagtcagacctcgggattgcggttgcggaggggacagaccttgcaaagctttcaggcgacgtcgtaattcacaaactcagttcccttccgcaggttttcactctctcagaaagggtttacagaaaaataaaggaaaacttcttctgggcttttgcgtacaacgtgacctttataccgattgccgcgggagtactctggagtaaaggcatttacttaaaaccggagtttgcgggtcttttaatggctctatcctccgtgagcgtagttctgaataccttaagacttcttaaggattga

SEQ ID NO: 23795 - DNA, 1434 bp, Aquifex aeolicus
atgtttagaaaagttctcgttgccaacaggggtgaagttgcggtaaggataataagggcctgtaaagagctgggaataaaaacagttgcgatatattcggaagcggatgtgcgttccctccacgttaaaaaagcagatgaagcttacctcattacgggagatccgataagggcttaccttgattacgtgagaatagttgaccttgcaaagcaggtgggggcggatgccattcacccgggttatggctttttggcggaaaacgccgactttgcgcgttactgcaggaggagggggataacttttataggccctactcccgaacaaatagagatgttcggagataaagtaaaggctaaaaaggttatgaaggaggtggggctccctacaatacctggaacggaagagccagtaagaactcttgaagatgcaaaacacgccgttaaggagataggtttccccgtgatgctgaaagccgcttacggcggtggcggtagggggatgagagttattagaaacgaggaagaacttgaaaagaacttcgagagcgcgttcagggaagcggaaaccttcttcggaaaaggagacctatttatagaaaagtacgtggaaaacccaaaacacatagaagttcaaatcctcggagataagtacggaaacataatacacctaggagaaagagattgttcaattcagaggagacaccagaagttaatcgagatagccccgtcccctaaactccctcaggatctcaggatgaaaatcctcggaaacgccgtaagggcgatgacaagagtaggatacgaaaacgcaggaacacttgagtttttggtggacctcaaaacgggagagtattacttcattgagatgaatacaagacttcaggtggaacacacaattacggaagcaattacgggagtggacatagttgaagcgatgataaggatagcggcgggagaacctttgccttacctccaaagcgatataactttcaggggatacgcaatagagttcaggataaatgctgaagatcctaagaaaaactttgcacctgcacccggtaaaattacctcttattactcccccggagggcctggtgtaagaatagacgcctccgtttacaaggactacattatcccgccctactacgattccatgattgcaaagatgacagtatgggcactaacatgggaaaaggctgtggcaagggcaaggagagcacttgatgagttcgtagtgaggggagttcccacgaatatacccctctacagggaaatagtaagagaccccgacttcttaaagggagacttcggaacaaggttcttggaagagaaaatagcgaagggagagtacgactttgaaatagaaggcgaaaagcccatggaagacgtagttcttgcaatatcggcggctatagcagcccactacggactttaa

SEQ ID NO: 23796 - DNA, 2091 bp, Aquifex aeolicus
atggaaaagacagaaaaaaatgagcttgtcagaaaactcattttcaaccctcaaggagacagggaggcgagcaaaaggaagataataaagggaaacccgacaaacatatttgaacttaacgagataaagtattcctgggcttttgacctttacaagttaatgggctttacaaacttctggatacccgaagagatacagatgcttgaagacaggaaacagtacgagaccgttctatcagactacgaaaagagggcatacgaactcgtcctttccttcctcatagcccttgactcctttcaagtggacatgcttaaagagttcggaaggatgataaccgcccccgaagtagaaatggccataacagctcaggaatttcaggaatccgtccacgcgtactcttaccagttcatactcgagtctgtagttgatccggttaaagcggacgagatttacaactactggcgggaggatgaaagacttctggaaaggaataaagtaatagcagagctgtacaacgaattcattagaaaacccaacgaagaaaactttataaaggcaacaatagggaactacatactcgagagcctgtacttttactctggatttgccttcttctacacactgggaagacagggcaaaatgagaaacactgtacagcaaatcaaatatatcaacagggatgagctctgcttcattgagggaacggaggttttgacgaagagggggttcgttgatttcagggagctgagggaagacgatcttgtagctcagtacgatatagaaacaggggaaatttcctggacaaaaccttacgcctacgttgaaagggattacgagggttctatgtacagattaaaacatcctaaaagcaactgggaagtagtagctactgaagggcacgagttcatagtaaggaacctgaaaacaggaaaggagagaaaggaaccgatagaaaaggtaaaactacatccctactctgcaattcccgttgcgggaaggtacacgggagaagtggaagagtacgacctctgggaactcgtaagcggaaaaggtataactcttaaaacgaggagtgctgtgaagaataagttaacaccgatagaaaaactcctgatagttcttcaggcggacgggacaatagacagtaagagaaatggaaagttcacaggcttccaacaattaaagttcttcttctcaaagtatagaaagattaacgagtttgaaaaaatactcaatgaatgtgcaccttacggaattaaatggaaaaagtacgagcgccaagacggaattgcttacacagtttactatccgaatgaccttccgataaagcctactaagttctttgacgaatgggtgagacttgatgagataacggaagaatggataagggaatttgtggaagaactcgtcaagtgggacggacacattccgaaagacaggaataaaaagaaggtttattattactccacaaaagaaaaaagaaacaaggactttgtgcaggcactttgtgctctgggaggtatgagaactgttgtcagtagagagagaaatccgaaggcgaaaaaccccgtttacaggatatggatttacctagaggacgactacataaatacccaaacaatggtgaaggaagagttctactacaaaggtaaggtgtactgcgtgagcgttcccaaagggaacatagttgtgagatacaaagacagcgtttgtattgcgggcaactgccacgttacgctcttcaggaacataataaacacactcaggaaagaaaatcccgaattatttacgcctgagatagaaaagtggatagtggagtacttcaagtacgcggtgaacgaagaaatcaaatgggggcagtatgttacccagaaccagatactcggtattaacgacgtcttgatagagaggtatataaagtatctcggaaacctgaggattactcagatcggctttgatccgatatatccagaggttacagaaaaccccttaaagtggatagacgagtttagaaagataaacaacactaaaacggacttcttccaggcaaagcctcagacctactcaaaagccaacgaactcaagtggtaa

SEQ ID NO: 23797 - DNA, 1281 bp, Aquifex aeolicus
atgaataaaacaacgtttgaaaatgtttactactgggaaggaaaggcacaaatcccccaggaagggcagtttataaagctcaaagaagataaaaccttagaagttccagacaacccgataattcccttcatagagggagatgggataggtcctgaaataacgcaggctatgctccttattatcaacacagcggttgaaaaaacttacaacggaagcaagaagatttactgggtagaactcctcgcgggggataaggcggaagaaaagactggagagaggcttcctcaggaaaccctggacgttttaaaagaatcaatagtaggtataaaaggacccctcggaacgcccgtaggaaaaggtgtccgctccataaactccgccctcaggagggcatttgattactactctgcggtaagacccgtttactggatgggccaggcaactccgattccaaatcctgagagggttgacctcgtagttttcagagaaaacaccgacgacgtctacgcgggagtggagttctttgcgggaacgcccgaagccaaaaaggtaagagaattcctcataaaggagatgggggcaaaagaggaaggcttccccgaagatgtgggaataacggtaaagcccatgagcgagttcaagacaaagagacacgtgaggaaagcactcagatacgcccttgaaaacaacaagaagaacgtcgcggtaataggaaaaggaaacataatgaaggcaacggaaggggccttcataaactgggcttttgaggtagcagaagagcccgaattcaaaggaaaggtagtaacggacccggaagcagagcccggcgaaggacaggtaaaactcacaaaagtgataaccgaccagatgcttatgcaacttgtcctcaagcccgaagcttgggacgtgataatcgctcagaacttgaacggtgactacgtttccgaccttgcagcttctctgataggaggtccaggatttgttccgagcggaaacataggggacggatatgccctctttgaaagcacccacggaacagcttgggacatagcaggcaagggaatagcaaatcccctttcccttacactatctggcgcgatgatgcttgaatacataggctggaaagaagcagctcaaaaggtctacgacgcagtaagaagaacccttgcggaacatataggaacgcccgatatcgcaagcggattccagaaacagggaatagaagctaaagcagtaggcacgatggagttcgccgaagaaatttccaagaggattgagtaa

SEQ ID NO: 23798 - DNA, 1419 bp, Aquifex aeolicus
gtgttcaataaagttctcgtggcaaacagaggagaaatagcggtaaggataataagggcttgtaaggaactcggtattccgacggtggcaatatacaacgaggttgaatccaccgcaaggcacgtaaagctcgcggatgaagcctacatgatagggacggacccgttagacacttacctcaacaaacagaggattataaaccttgcccttgaagttggagcggacgcaattcacccgggatacggatttttggcagaaaatgcagaattcgccaaaatgtgcgaggaagccgggataaccttcataggtccccactggaaagtaatagaacttatgggagacaaagcccgctcaaaggaagttatgaaaaaagcgggtgtcccggtagtccccggctcagacggagttttaaagagcctagaagaggcaaaagctttagcgagggaaatcggatatcccgttctcctcaaggcaaccgcgggcggtggtggtagaggaataaggatatgtagaaacgaggaagaactcgtcaaaaactacgagcaggcgtcaagggaggcggaaaaagccttcggaaggggagaccttttactcgaaaagttcatagaaaacccaaagcacatagagtatcaggttcttggagacaagcacgggaacgtaatacacctcggtgaaagagattgttcaatacagaggagaaatcaaaagctcgtagaaatagcaccctctcttatccttactccagaaaagagggagtactacggaaacatagtcacgaaagccgcaaaggaaataggctactacaacgcaggaactatggagttcatagcggatcaggaaggaaacctttacttcatagagatgaacacgagaatacaggttgagcaccccgtaagcgaaatggttacgggcatagacatagtaaagtggcagataaagatagcagccggagaacctcttaccattaaacaagaagacgttaagttcaacggatacgccatagagtgcagaataaacgccgaggaccccaaaaagaactttgccccctccacgggagtaattgaaaggtactacgttcccggaggtttcggaataagagttgaacatgctgctgcaagaggttttgaagttaccccctactacgactccatgattgcaaaacttataacctgggcacccacttgggatgaagcggtagagagaatgagagcagttcttgagacttatgaaataaccggcgtaaaaacgactatacctctactcataaacataatgaaagaaaaggacttcaaagccggaaagtttacgacaaagtatttagaagaacaccctgaagtatttgagtacgaagaacacaaggacaaggaggattttgcggcactaatttctgcggctatagccgcttaccacggtttataa

SEQ ID NO: 23799 - DNA, 1968 bp, Aquifex aeolicus
atggtagtaaacccggaggttatagaagaagtcaaggagaaaattaaggaagttaagaataagggctttaagaagaagatattaattaccgacctcacgccaagagacggacagcagtgcaaactcgctacccgtgtgagaaccgaggacctcctccccttatgcgaagccttagacaagtgcggattttacgcggtagaagtctggggaggagctacgtacgacgtttgcctgagatacctcaaagaggacccatgggaaaggctaaggagaataaaggaagtaatgcccaacaccaaactccagatgctcttcaggggacagaacatagtcggttacaaacccagaagcgactatgtagttaagaagttcgttgaaaaggctatagaaaatggaataaccgttttcagagtgtttgactctctcaacgacaacaggaatatagaaaccgctgttaaagctataaaggaattcggcggagaagttcacgctgaaatctcctacaccagaagtcccatacacacttacgagctctggatgaggtatgctcaggaactggcggaaatggaacccgactggatatcctttaaggatgcaacggggataatgcaaccctttgaatgttaccagataatcaagggaataaaggaagtaacgggaggaaagataccagttctccttcacaaccacgacatgagcggaatggcgaccatgaaccacataatggctgttctcgcaggcgtcgatatgctggacacagtactttcacccttagcgttcggttcatctcaccctgcaaccgagaccataatcgcagcgcttgaaggaacaccttacgacacgggacttgaccttcaaaaggtttcggaagctgcggaaatagctaagaagattaagaagaagtacaagaagtatgaaacggaatacgcgggagttaacgcaaaagttctcatacacaagatacccggtggaatgatatccaacatggttgcacaactgatggaggcaaacgcactcgacaagatagaagaagcactagaagaagttccgagagtagaaaaagaccttggatacccaccgttgctaacaccttcttcacaaatagtcggtgttcaggcggttctgaacgtaatcacgggagaaaggtacaaagtaatcacaaaagaagtgagagattacgtagaaggaaagtatggaagaccgcccggaccaatatccaaggaactcgttgaaaagatactcggtcccggaaaagaaccggacttctccaagagggctgccgactacgccgatccccacgaatgggacaaggctaagaaggaactcgaagagctcttcaaaagagaacccacagacgaagaagtactcctctacatactcttccccatgcaggcaaaagagttctttgaactcagggaaaagggagaactccatccagaacccgtggaagcggaactcccggaagttgcagaaacgaagcccggagaagttcccggcgctgcacccgtagagtttgaactcacataccacggtgagaagttcaaggtaaggatagaaggcgtttccgtggacgcagaaagcggaaaacccaggaagtactacgtaaggataaacaacagacttgaagaaatacagttaaagccttttaaggaagcgataccccagggtggcggtgcccaaacagttcagagtgcggaagaagaagagggaattcccaaggctacggaacccggagacgttacaccgcccatgcccggtaaggttgtgaagatactcgtaaaagaaggagaacctgttcagcagggacaaaccgttgcaaccgttgaagcaatgaagatggaaaacgaagtccatgcacccatagacggaatagttaagaagatattcgcaaaacccggagaccaagttaacccagatcaagcgataatgagaatagtcccccacaaagaagataagagctatcaataa

SEQ ID NO: 23800 - DNA, 1296 bp, Aquifex aeolicus
atgaaaaaaatcgagaaaataaagagagttaaaggagaactcagagttccctccgacaagtccataacccacagggcttttatactgggggcactcgcaagcggtgaaactctagtaaggaaacctctaatctctggagacacactggccactttagaaatcctgaaagccatcagaacaaaagtaagggaaggaaaagaagaagtcttaattgagggaaggaattacacctttttagaacctcatgacgtactcgacgctaaaaactctgggactacggcgaggattatgagcggtgtactttctacacagcccttcttcagcgtccttacgggggacgaaagcctgaaaaacagaccgatgctgagagtggtggagcccttgagagagatgggggctaagatagatggaagggaggaggggaataaattaccgatagccataaggggaggaaacttaaagggaatttcctacttcaataaaaagtcctcagctcaagtaaagagtgccctcctgcttgcggggctgagagccgaaggtatgaccgaagttgtagaaccttacctttctcgtgatcacacagagagaatgttaaagctcttcggagcagaagtgataactattcctgaagaaaggggacacatagtaaaaataaaaggaggacaggaacttcagggaacggaagtttactgtcctgcggatccctcctctgcggcgtactttgcggcactcgctacgctcgctcctgaaggggagataagactaaaagaagttctcctgaatcctacccgtgacggattttacagaaaactcatagaaatgggaggggatatttcctttgaaaactacagggaactttccaacgaacctatggctgatcttgtagtaagacccgttgataacttaaaacccgtaaaggtttctcctgaagaagtacctactttaatagacgagattcccatccttgcggttcttatggcttttgcagacggagtatcggaggtaaagggagcgaaggaactcaggtacaaggaaagtgacaggataaaggctatagtcacaaacctaaggaagctcggagtacaggttgaggaatttgaggacggctttgcaattcacgggactaaagagataaagggaggagtgatagaaaccttcaaagatcacaggatagcgatggcttttgcagtgctcggattggtcgttgaagaggaagttataatagaccaccccgaatgcgttaccgtgtcttaccccgagttctgggaggatatcttaaaagtagtggagttctaa

SEQ ID NO: 23801 - DNA, 858 bp, Aquifex aeolicus
gtgttgaggaagctttcgaaattctcaaataaaggggaggtgtttatgggactgcttgaaggaaaaagggctttaataaccggggttgcgaacgaaagaagcatagcctacggtatagcgaaatcctttcacagggaaggagcacagctcgcctttacttacgctaccccaaagctcgaaaagagggtaagggaaatagctaaaggattcggaagcgatttagtagtaaagtgtgacgtttcactcgacgaagacattaaaaatctgaaaaagttcttggaggaaaactggggaagtttagacataatagtgcactctatagcttacgcccctaaagaagaattcaaaggaggagtgatagacacctcaagggaaggtttcaagatagcgatggacatctcggtttactctctgattgccctcacgagggaactccttccccttatggaaggtaggaacggagctatagttacactctcttactacggggctgaaaaggtagttccccactacaacgttatgggaatagcaaaagccgcccttgaaagcaccgtgaggtacctcgcctatgacatagcaaagcacggtcacaggataaacgcaatatccgcgggacctgtgaaaacacttgccgcttacagtattacgggttttcacctcctaatggaacacaccactaaggtaaatcccttcggaaaacctataactattgaagacgtgggagatacggcggttttcctgtgtagtgattgggcaagggctataacgggagaagtcgttcacgtggacaacggataccacataatgggcgtttttggaagagaagaggagatcaaaaaggaagtttacggagattga

SEQ ID NO: 23802 - DNA, 1665 bp, Aquifex aeolicus
atgaataattacagatggctctataacctatctaaaccttacattctcttattcttactctcgctcctcggatcccttattcagtcctctggagccacggctttagccctgctggtcaagcaggttgtggataacgtattaatcctcaaaaatcaggaagagcttttaaagtacgttctcctcttgttctcaagtgccctaataatacaggtgggcttctttatctcctcctttacgctatcttacatatccgaaaaggtaatatactccctcagaaacgagatttacgaaaagctcctgtacgcacccataaactacgttctctacacgccttcgggggagctcataagcaggatagtgagtgacttagaacagttaaggcaggtttttgcagattacataccgaagctactgagagaacctttagtagttctcgcgctcttcggtgtcctcctctacagggacctattcctcacccttttaatcctcctcttatttcccgtaatggctctatttactaagtacttttctgagaaaaagaagaaacacctctcaagacagagggaaaaggttgcactcctgacaagtatactctcggaaaccttgagaggatttgagaacataaaactcttccttgcggaaaatagatttataaaggacttcaaagaactgtctttcaggattttcagatcctctgtgaagataaacctttatgtggtgggaaatacggtcattaattacacctttggttacgccgtagtttccttgatcctctttgctggcggttacagaatagtaaagggagacataaccactggagactttatttccttcctgacagcactctttatgattcaaaaacccttaatggaaactcagaaggcgataatgaacctgaggggctcagcacctatttttgaaaggataaggaatctcttgaacgttccagaagaaaaggacggaagtgaagagtttgaaggtttgaaggaaaggattgagttcagagacgtgagcgtaaagattaacagaaaggaaattctcaaaaacgtaaatctttcagtttacagaggttcaaaagtcgggattaaagggcacacggggagcggaaaaagtactttcgttaaattaattccaagactccttgagtacgaaggggagatttttgtggaccacacggagctgagggagtttaaactcaagagtttgagggaaaaaataggatttttgagtcaggaagttatggtatttcgcggaagcgtcagggagaacctgctcatagcgaaaccagacgctacggaagaagaaatgttaaaggctctagagcttgcaaagtgtgactttgttctcaattcacctgaagggcttgacaagttcttagaagagggtgggaagaacctttctggcggggaaaaacagaggcttgcccttgcgaggatattcctcaaaaacccggagatagttatcttggacgaggctacatccgcattggacccgaaaacggaagaagaagttatatacaacctttataaatttttaaaagagaaaacaattttcgcggttgcacacaggccctttatttttaacttctgcgacgtgatacttgagtttgaaggggggagacttaaagagttttccacttctaaagaaaattctattaaattataa

SEQ ID NO: 23803 - DNA, 1278 bp, Aquifex aeolicus
atgtttgtaaagttacttcctcctgaagtaagaaaggtaatagcggccggagaagttatagaatctcctgttgacgtcgtaaaggaactcgttgagaattctctggacgcaaaggcgacaaaagtagaggtagaaatcgtaaaaggcgggaagaggctaataagggtcaaagacaacggtacaggaatacaccccgaagatgttgaaaaggtggtcctgcagggagcgacgagtaagatagagaccgaaaaggatttgatgaacataagcacttacggatttcgcggtgaggccctttactccatatcaagcgtaagcaagtttaaactccgttcccgttttttccaagaaaaggaaggaaaggaaatagaagtagaagcgggaaacatactcgggacgagaagagtgggaatgcccgtgggaacggaagttgaggtgagggatctctttttcaatctccccgtcaggagaaagttcttaaaaaaggaggataccgaaaggagaaaggtactggaacttatcaaggagtacgccctcacaaatccagaagttgagttcacactcttttccgaaggcagggaaaccctgaaactgaaaaagtcaagtttaaaggaaagagttgaggaagttttccagacaaaaacagaggaactttacgcagagagagaaggaataacgctcagggcttttgtttcaagaaaccaaagacagggaaagtattatgtctttataaacaaaagacctattcagaataagaacttaaaggagttcctgaggaaggttttcggttacaaaactctagtagttctttacgcagagctccctccctttatggttgacttcaacgtccaccccaagaaaaaggaagtgaacatactgaaggagagaaagttccttgaacttgtaagagaactcgcgggaaaagagaaacctatcgtagatattcccctctctcaacctgtgaaaacttacaagcccacatacgagatactcgggcagatggacgagacctttatcctcgtgaaggattccgaatacctgtacttcgtggaccagcacctccttgaagagaggataaactacgaaaaactgaaggacgaaaacttagcctgcaggatttccgtaaaggcgggacaaaagctctcggaagagaaaatcagagaactcattaaaacctggagaaacttggaaaatccccacgtttgcccccacggaagacccatatactacaaaatacccctgagggaaatatacgaaaaagtaggcaggaattactga

SEQ ID NO: 23804 - DNA, 429 bp, Aquifex aeolicus
atggccgtagagaggacactcataatagtgaaacccgacgctatggaaaagggagctctcggcaagatcctggaccgcttcattcaggagggattccagataaaagctttaaagatgttcaggtttacccccgaaaaggcgggagaattttactacgtccacagggaaagacccttcttccaggaactcgttgagttcatgtcttctggtcccgtggttgcagctgtactggaaggtgaagacgcaataaagagagtaagggaaataataggtcctacggacagcgaagaggcgagaaaggtagctcccaactccataagggctcagttcggcacggacaagggtaaaaacgccatacacgcctcagactcacccgagagtgcacagtacgagatctgtttcatattctccggtcttgagatagtatga

SEQ ID NO: 23805 - DNA, 1332 bp, Aquifex aeolicus
ttgaaagggatccgaaggaatttgcaaaaatcgtatttgaaaaggtgttcggagatgtatttaagagggcttaaagtttctggagaaatcgtttccgcgaaaggaatatacctggaagccatactcccctttgcgaacataggaaacgaagtggaaatacagagcaacagcaggaggataaggggggaagtaataggctttagcggtgataaagtcctcgtaatgccctacgaaccagtctttggactcagaaaaggggataaagtcctgcttaagaacgagctcgtttccaccaagacgggaaacggcgtagtaggaaaagtggttgatcccttcggaaatcctctggacggtggttttataggatttgttgaggaaaagggcttagaactgccccagataaacccgttatatagggaaaggattagagaagtttttgatacgggcgttaggagcgtaaacgccctgtttaccttaggaaaagggcagaagatagggatttttgcaggagcaggagtgggaaagagtacgctcctcggaatgataacgaggcactcaaaagcggacgttgtggtcctcgcccttatcggagaaagaggaagggaggtaaaggagtttttagaggaggttctgggagaagagggcttaaaaaagagcgtcgtggtggtttctaccgcggatcaatcccctattttgaaggtaaaaggggctatcagtgctgttgttcacgcccaccactttgcatctcaagggaaggacgttctgcttttgatggactctattacaaggctcgccttagcccagagggaaataggacttgccgcgggagaacctcctaccctgaagggctttactccttctgtttttcagctcctcacgaggatagcggaaagttgcggagctttcaagaagggaagtataacgggaatattcacagttctggtagagggagacgatatatctttagatccaatagccgactcgcttatgggagtcctcgacggtcacataatactttccagaaagagagccgtaaggggacttttcccggcggttgatccagtaaggagtctttcccgtctaatgccaaagcttgtaagtgaagagcacttcatgaaggcaaacttctttaaggaagttctgagtaagtttgaagatgtggaggagcttgtgaggataggactttacaagggcggttcaaatcctctggtagacaaagttataaataacttagaaaaagtggaaagcttttttaaacaaaaaccagaagagaaggtgaattttgaagaaagcttaaaggctcttgacgaaatttactcactccttaagtaa

SEQ ID NO: 23806 - DNA, 1863 bp, Aquifex aeolicus
atgagggaaatcaaagttacggatgtctcgctcagagacggcattcagagtctactcgctacaagggtaagaacagaagacatgcttgatgtaatagaaatactagacaagtgcggattctggtctctggaagtgtggggtggagctacttttgacgtgtgtctgaggtacctcaaagaggatccctgggaaagactcaggaagttcaaggagagggcgaagaacacaaagcttgagatgctcctgaggggacagaacgttgttggatacaggcactatcccgacgatgtggttgaggaatttgtaaagaaggcttacgacaacggaatagaagttttcaggattttcgacgccctgaacgacacgagaaatatgagaaagtctattgaaactgccaaaaagctcggagccatagtaaagggcgttctctcctacaccataagtcccgttcacaccatagagtactacgtaaaagtagcaagagaactcgttgatatgggaatagacataatatccataaaggatcaggcgggaatactctcacccaaagtttgttacgagctcgtttccgctttgaagtccgaatttcccaattatcccgtgcaccttcacacccagactaccgcggaccttgcggagatggcacaactcaaagggattgaagcgggagcggatatgatagataccgcgtgttattcactttcgggacaaacctcccaccctccgggagaaacgatgatatacgtcctcagggagttcggctacgaggtaaaagtaaacacggagctctataaaaaagcgggagacataatgagagaagtaaggaagaagtataaaaaatacgacgtccttcctccttaccccgacgtttcagtcctaatacaccagatacccggcggtatgatatcaaacttcatatcccaattaagggagcaaaatctggaggataaactagaagaagttcttgaagaagtaaaaagagtcagggaagacctcggatacccgcccttagtgacgccaaccagccagatagtgggaactcaagcctttttaaacgtcctccacggagagcgttacaaagtagttaccaaggaaacgaaggactacgttaagggactctacggaagacctcccgcccccataaaggaggaaattatcagaaagatactcggagacgaaaagcccatatacgacataagacccgcggacctgcttgagccggaacttgacaagataagagatgaggcaatagaagcgggtgcaaggagcgaagaagatatactctcttacgcactcttcccggtagtcgccaaagagttctttgagtggagggaaaaagtagaaaaaggagaacttccgcccgttcccatggaagaaacggtggaagaaactacggagtgcaaggctcccgtagagttctacgttaccgttcacggagaacagtatcacgtccagatagcgggtaaaggcgaagaggacccgacgaggagaaccttcttcataagactggacggacaactccaggaagttcagctccagcccataagagaagtaagtgtaaaggaagcctttgcgaccgaagcaacggaaggcggtacggtaataagcaagagaccaaagcccaaaggtatcggagacgttacctcacccataaccggtaaagtggtaaacataaaagtaaacgtgggagacgaagtaaaagagggagacgtccttttagtcgtagaagccatgaagatggaaaatgaaatccatagtcccgttgacggaatagtagaggagatattcgtaagagtaggagaaacagtaaaccccgacgaagtgctcataaggattaaacccaaacgcggtaaaaggaaatga

SEQ ID NO: 23807 - DNA, 1158 bp, Aquifex aeolicus
atgaagctccacgaacatcaggcaaaggagatatttgcaaaatacggaattcccgttccggaaggcaaggtggcattttccctgaaggaagcaaaagaagtcgcagaagaactcggagaatttcctctcgttgtaaaggctcagattcactgcggtggtaggggtaaagcaggcggagtgaagatagtcaaggacatggacgagctggaaaaggcagttgaatcactcctcggtaaggttctaaaaacctttcagtgtcccgacggaaaacccgtaaacagggtactcatagaaaaggctacgaacatagacaaggagtactatcttgctataactttggaccgttcaaagtccaagcccgttataatggcttccgcagcgggcggtatggaaattgaagaaatagtcaaagaaaatccagaggcgataataatcgaaacaatagacccagaactgggacttatgccctatcaggcgagggagcttgcctttaagttgaacctgcccgtaaaggaattcgcaagcatagccctgaaactttaccagatatattccgaccttgacgcttcactcgttgagataaatcccctcgttctcacaaaggaaggaaaccttatagcccttgacgcaaaactcgacatagacgacaacgccctcttcaggcacaaggaccttgaagagatggaagacgaaacacaacttccacaacttgaggtggaagccaagaagtacggccttaactacataaaactcaatggaaatataggttgtatggttaacggtgcggggctcgctatggcgactatggacataatcaagctcgcgggaggagaacccgcgaacttccttgacgtgggtggtggcgcgaacgtagagcaaatcgcgaacgccttcagaatactcatggcggacccggacgtgaaggcggtcttcataaatatattcggtggaatactgagggtggacaggctggctcagggactcatagaagcctccaaaatggtagaactcagagttcccattgttgcgagacttgaaggaacgaacgttgaagaaggaaagaggatgctccaagagagtggactcaacttcataatagcggaagacatgtgggacggagcgaaaaaggctgtggaaatagcgaataaacaaagctaa

SEQ ID NO: 23808 - DNA, 918 bp, Aquifex aeolicus
atggctattttggtaaacaaagataccaaggtggtagttcaaggtataacgggtaaagaaggttctttccacgcaaagcaatgcaaagaatacggaactcaggttgtcgcaggagtaacccccggcaagggaggaatggaggtagagggaattcccgtattcaacactgtgaaggaagcggtaaaagagacaggtgcaaactgttcactcatattcgttccagccccctttgcggcggacgctatagtggaagctctggacgcggggatagaactcgtggtgtgtataacggaaggaattcccgtaaaagacatgatgatggtaaaggactacatgctcaagaactatccgaacgctaaactcgtaggtcccaactgccccggagtgattacccccggagaggcgaaggtgggcataatgcccggacacatattcaaaagaggtaaaataggcatagtttcgaggagcggaaccctcacgtacgaggcggcttatcagctcacgaagtacggactcgggcagtccactgctgttggtataggcggtgaccccgtccacggactcacacacagggatgttatagagatgttcaacaaggaccccgaaacggaagccattttaatgatcggagaaatcggtggaacggaagaagaggaagctgcggagtacatagagaaggaagttgacaagcccgtatttgcctacatagccggaatcaccgcgcctcccggaaagaggatgggacacgcgggagctatcatcatgggcggaaagggaacggctaaggccaagatggaagcccttgaaaaggcgggagcttacgtcatagagaatcccgcaaagataggtgagacagtggcgaaaatactgaaggttatagaactggaagaagaagaaaggacttccgatgctgagtaa

SEQ ID NO: 23809 - DNA, 942 bp, Aquifex aeolicus
gtggggaacaccctcgccacgcaccttgacaggaaaggacacgaagttctgctctacgacataaacgaagaagtggtaaagaagattaacgaaggaatacatccctacgttgaaggaattaggtttaaaaatgtaaaagccactacggatttaaatcaaataaatgagtttaaaaatctaatttgtgcacttccagttcaggtaattccaaaagtaatcacgaaagtaaacctgaagggaaagaactttatttctgcttcaaaaggaataatccatgaaaatttaaagagaatttcacagctcgttaaagaaatcgaacctaaacttaaattttttgttctttctggaccttcctttgcggaagaggtttcaaagggacttcccacggccatagtgctggcttacgaggacaaagaagaggcaatgaaactccaggacgcacttgattctgaaaacttcaacgtttacttgaacgacgatataacaggagttgaactgggaggtgctttaaaaaacgtcatagcgattgcggtgggactttcggacggaatgggctacggctacaacgcaaggagtgcaatcataaccagaggtttgcacgaaatggcaaatgtaggtgagaagttcggggcaaggagggaaacgtttttcggactttcaggagcgggagaccttatactgacttcaacctctgacctttcaagaaacaggacctttggaaaactccttggacagggatacagcgttgaggaagccctaaagaagataaaccaaaccgtggagggtgtaaaaaccgcagaagcactatacgaaattatcaaaagggaaaacattttcgcaccaatatgcgaaggagtttacaggataatcaagggtgaggatcctaagaaggtttatcctcactttctttcgaatcatctaagggaggaatttcagagataa

SEQ ID NO: 23810 - DNA, 936 bp, Aquifex aeolicus
atgaacggtgtgaaaataattgcgggaacttccaataaaaccctttccgaagagatagcgggatacttaggtctgagacttaccgacgcgttaataaccaccttctccgacggagagataagggttcaaataaacgaaagtatcaggggctatcacgtatacgtaataacttccctctcaaaccccgtcaaccataacttaatggaactcctgcttaccctcgacgctgtaaagcgttcctctcccaaggaaattaccgcggtagttccgtattacgcctacgggaggcaggacaggcaggacaagcccagaactccgataagcgcgaagctcgttgcagaccttatccagaaggcaggggcgaacagggtaatagttgttgaccttcactccccgcaaatacagggcttttttgacatacccgttgagcatttaaccgcaatccccgtgctctacgactacatcaggaagaacgtagttttagaaaatccaatagtcgtttccccggacgccggaggtgtaaagcgggcgagggatcttgccaacaaactagggtgtggcataggagtaatactcaaaaggagacccgaaccgaacaaagcggaagttatggacgttgtaggagacatagaaggtaaagaggctataatcgttgacgacataatagacaccgccggaacgctcgttgctgcggcaaaccttcttgtgaataaaggtgttaaaagggttatagcctgcgctacgcacggtatattctccggtcctgcggtagaaaggcttacaaactcccctattgaaaaggttatcgtgacgaacacgcttcccgtttacgaaaagaagttcggtaaactggaagttgtttccatcgcacccctgataggagaagccataagaaggatacaggagggaacttctgtaagttccctctttacctga

SEQ ID NO: 23811 - DNA, 1335 bp, Aquifex aeolicus
atgttcaaaagggttttaatagccaacaggggagaaatcgcagtaagggctataagggcgtgtagggaactgggattgaaaactgtggcgatttactcggaggctgacaaaaacagcctccatgtagaactcgcagacgaagctatatgcataggtcctcccgacccttcaaagagttatctcgatattccgaggataatgtccgcactggaagtgagtaaagctgatgcggtgtatcccggctacggatttttatccgagaacccaaaattcgcggaaatcgtagaaaagagcggggcgaagtttataggaccacgctccgaggttctggcgaagattggggataaagttctggcaaagaaggttgcaaaggaagtaggactccctttagttcccggaagcgatgagccccttgagttttctgaagctgtgaaactcgcttcaaagataggttatcccgttgttataaaggctgcggccggaggcggaggaaggggaataagaataataagggatgaaaaagaactgagggaaaagtttcccttagcgaagaaagaggcggaaagtgctttcggagatggtaggctttacatagaaaagtacgtgataaatcccaaacacatagagtttcaggtaattgcggacgaacacggaaacgtgtacgttctcggagaaagggaatgctctattcagagaagacaccagaagttaatagaagaagctccgagtgtttccgtgagtgaagagaaaagaaaggaaatctccgaaaaggtagcggaattttgtaaaagactcggttacacttccgcggggacggttgagttcctgatggacgaagaggggaacttttactttatggaaatgaacggaaggatacaggttgaacacccggtaacggagatggtaacgggtgtggacatagtaaagctccagttaatagcagccatgggagaggagataaaacttgaaaaagtggaaactaatggttttgctatagagttcaggataaacgctgaagatccagtaacttttattccctctcccgggcaggtggaaaaattaatccttcccggaggtccgggagtcagagtagacactcacctgtaccaaggctacacagttccgccctattacgactccctgcttgcaaagataattgtatggggaaatacgcgtcaggaagcgatagcgagaggaaaaagggctctcggagaactaaagattgaaggaaagggattaaaggtcaacacggaatttcaccttagggtacttgatcagaaagagtttatagaaggaaagcacgacataacctttgtggaaaggataatggtttaa

SEQ ID NO: 23812 - DNA, 1005 bp, Aquifex aeolicus
gtgaaagggaaattgataaactcatttcttatgaaaaagccaaaaattagtgtaataggtgcgggaaaggtaggggaaaatgtagcctacctcctcacgatcctcggcctcggagacgtttacctatttgcgaggtataaaaaaggtttagaacctgcgaaagctaaggctcttgatctaaaacaaatggctgttttaatggacatagatataaacgttaaagggatttcctacgacaaagagggttttgaagaactaaagggttcagacatcgtggtaattaccgcgggaatacctcgaagggaggggatgagcagggaggatttactctacgaaaacttaaaaatcttgaaaaagttcacggatgcgataaaggaatacgcgaaggattcaataattatagtggtttcaaatcctgtggatacgctcacttacgccaccataaagttgacgggatttgaaccgagaagggttatcggaatggccggagttctcgattccgcaaggtttaaaaacttcgtaaaggaaaagataggtatatcaaacgctgatataaggactctggttctgggaactcacggggatttaatggtgccagtaacctcgcacagctttataggagacaaaccgatagaggaagttttcagtgcaagcgagatagatgaactcatagaaaagaccagaaaaggtggagcgcagatagtatcccttatgggcacttctgcctactatgcacccgccgcctcggttgtgataatggttgagtctataatcaacgacaggaaaagggtaatgccttgctccgtttacgttgaaggggaagctgcaaagcactacgaaatagaaggagtgtgcataggactgcccgtagttctcggaaagaagggagttgaagactttgagcttgtaaacctgagcggttacgaaaagagagaacttctgcgttctgcaaaaactttaaaagaaatggtaagcttagcggataaactcctgaatgagctttaa

SEQ ID NO: 23813 - DNA, 3021 bp, Aquifex aeolicus
atgataagcgaaaacctgttttccgccaaatcccttgagtatctggaaaaggcgaaagaaatagcaagggaaaacaaggacactaaggtggacacggatcaccttctaatagccctgctcctcgacgaaaaatctcctctttctaaatatatagagaaaaggggaatagacaggaaggagtttttaaagagggtgagcgaataccttgaaaacctcaacaagcaacttgaaaaggctatagaagcggaagcccagaacctaataaacctgagaacccagataatggaagtaaaatccaacataggaaacgtccagacggaactctccaaaataaggaaggcaaaggagaggatactcagggaacttgagtacgcaaggagatacggagattggtggaccgctgaaactctggaacttgaactcagacaactcgaagcaacggaacaaagtataaggagacaactggagcaggtggaaaagagcttatccaccgtatttgcacccgaggatgtaaaggcattccttgaaaataaactctccatagatggtctaataagaaaagcccttgaaaagtctcccttaattgaacaagtaaaggaacttggaatttctccggacaggataatagacaaggtagcggaaaaggttttcggaaagaaacccacctttgattacagtcagtacctgactcaggttcttgaaaaggctcaggacaaggctgtatccgagggagaggctcaggttcaaccttctcacatttccgcggctttaattgaggcaaaagataccataggtggtaagttaataaatcaagttttaggaggtgaaaaagagatgaagaaggacgtcactcaagaactcaaagaagaagaaaagtctccccttgagcgcttcggcgttaacttaaacgaactcgcaaggcagggtaaactggaccctgtaataggaagggaaagggaaataaaccaagttatagaaatactcctaaggagaactaaaaacaaccccgtactcgtgggagaccccggagtcggtaagaccgcaatagtggaaggactcgcccaaaggatagtgaacaaggaagtccccccagaattacaggacaaggaaatatggtccatagatatggcatcactcctcgcaggttctaagtacaggggtgagtttgaagagagactaaaagctctccttgacgaggtaaaggaaaaaggaaacgtaatactcttcatagacgaaatacacaccgtagtgggagcgggagctgcggaaggtgcagttgacgcggcaaacataatgaagcccgcactcgctagaggagaaatcagggtaatcggagctacaaccgttgacgagtacagaaagtacatagaaaaggacccggcacttgaaagaaggttccagcccgtattcgtggacgagccaaccgaagagcagacgatagaaatcctaaaaggtctgagaccaagacttgagcagttccacaaggtaaagatttccgacgaagcaatagaagcggctgtaaagctcacgaagaggtacgtaaccttcaggagacttcccgacaaggcgatagacgccctcgaccaggctgccgcaaggaaaaagctaaaagttataggaactccccccgaaatacaggaaatagagaggaagataaaagctctggaagagcagataatagaggctaacctaaaaggcgactacgaaaaagaagcacagctcaagatagagaaagctaaacttgagaaggaaaagcaggaactcctcggcaaggtaggaggagtagaagctaagatcgccgagctcaagaagaagattgaggaacttgacgagaagataaaggaagccgcggaaaagggcgattatgagaaggaagctgagctcaagatagaaaaggctaagctagaaaaggaactcaagaagttagaacaggaaaagtccaaggaactcgtggtcacgtgggacgacgttgcggaagtagtttcggagtggaccggaatacccgtatccagactaaaagaagaggaaatgcaaaaacttctcaaacttgaagacgaacttcacaagagagtcgttgaccaagaacacgctgtaaaagctgtagcggaagcaatcagaagggcaagagcaggactaaaggatcccaagagacccatagcgagctttctgttcctcggaccaacgggtgtaggtaaaacggaactctcaaaggcacttgcggaactcctcttcggagatgaagacgctctaatcaggcttgatatgtccgagttcaaggaagagcactccgtggcaaagctaatcggtgcacctccgggatacgtaggatacgaggagggcggaaaactcaccgaagcggtaaggagaaaaccatactcagtaatactccttgacgaaatagaaaaggcacaccccagagttcttgacctcttcttgcaagtgcttgacgatggaagactcacggactcccacggaaggacggtagactttagaaacaccgtgataataatgacctcaaacataggttctcagtatctcctgaacattcccgtggatgcggatgaggaaactctcaatagggaattcgaaaaggctaaggaaaaggttcttgaagagctcaagctctacatgagacctgaattcatcaacagaatagacgagataatcgtgttcaaaccgctcaccatgagagaactctccaagataatagacctccttatcgcaaacgtgaacaagagactcgctgaaaggaacataaagatagaactcacggaagaggcaaagaaagaactcgtaaggagaggatacgacccggcattcggagcgagacctctaaagagaacaattcagaagtacgtggaaacacccctcgcggacaagataataagaggagaaatcaaggacggaatgacggtagttgtggactacaaagacggggagttcgtctttattcctaaggaagagtacgaaaaacagaaagctgaggtttccgcatcctccgaagagaagaaggaatcctaa

SEQ ID NO: 23814 - DNA, 894 bp, Aquifex aeolicus
atgagagaaattagaaaggttgttcttcccgttgcggggtggggaacgaggtttttgcctgctacaaaggcaatgcctaaggaaatgctccccataattgacaaaccaataatccagttcatagtcgaatcctttatcaacataggtattgaaaacatcattttcgtcacaggtagacacaagaaagcgatagaggatcactttgaccacaaccacgagctggaagagcacttaaaaaaagctggaaaagagaaattactgagagaagttgtaaaaatttcgagccttattaacccgatttacgtaaggcaaaaagagcaattaggactcggacatgccgttctcatggctgaaccagccgtatcacaggaacccttctttgttgccttaggagacataatcgtggagaacgaagaggaagaacttaaaaagatgatacatttgttcaggaagttcggaaactcaatcgtagcattgatggaagttccaaaggaagaagtctcaaagtacggtatagcaaaagtaaaaaaattggacgaagaaacttatataattgtagatctggtcgaaaaaccctctcccgaagaggctccttccaaccttgcgatagttggaaggtacatattcacacctaccatttttgaaaaactaaaggttacaaagccaggtaaaggaggagagatacagttaaccgacgccatgagactcttacttgaggaggaggcgatatacgcctgcaaggttaataacacggtatacgacacgggaaatcctaaagattatctgaaaacggttatatcctttgctttaagaagggaagatataaacggtgaacttatcgagtttattagaggattgattaaagaagaaccaaaaaaagaaaaggctaaatga

SEQ ID NO: 23815 - DNA, 966 bp, Aquifex aeolicus
atgaggataggaattcttaccgccgggggtgacgcccccggtatgaatgccgtaatcagggctgttgtgaggagcgccgaaagggaaggacacgaagtaatcggcataaagagaggctataaaggattaatagaaggagattttattaaactcacctccagagacgtggggggaattctggacaggggaggaacaatactcctgtcctcaagggaccccagatacaaaaaactcgagtacagggagaaggcttataaaaacctaaatgaacagggtatagaggctttaataattctcgggggtgagggaacacttgcgggtgcaaaactcaccgcggaagaaacgggaattccagtaataggcgttccctgtaccatagacaacgacgttggtggaactgagtactgcataggctacgacacagccctcaggaacgccgttgacgcgatagacaagataagggacaccgcaagctctcacgagaggattttcatagtagaggttatgggaagaaacagagggtttatagcagttgaggctggactcgccacgggtgctgaactcatactcattcccgaagagagattcccgagggaacaaatccccgaggagatagaaaaggctaagaaactggggaaactccacttcataatagtcctcgcagaaggatattgccgtgcaaaggaactggaagacttccttctggaaaagatcggtgataagtacggggagatacgctcaaccgttctgggacatatccagagaggaggaataccaacccactttgacaggataatgggaacaaagttcggagttgtggcttatgagagtctcatcgcaggagaacgctcaggatttgttgcctacgaaaagggcaagttttacatagaggacttcgaaaaagctcaggaatacaaaccaatagacagggaagcttacaaactaaacacgagactggctatataa

SEQ ID NO: 23816 - DNA, 2286 bp, Aquifex aeolicus
atggtaaaaacctacgcttttggttttcctaagctcggtgaaaaaagggagtttaaaagacttcttgaaaactactggaagggcaaaatctcccaagaagaactaataaagggaatggaagagctaaacctgtggagggcaaacctatacagggaaaacgttgaaataattccctcaaacgagctctcttactacgacttcatgcttgacaccaccgtaatggtcggagctattccctcccgctttggcgaatacagaggacttgacacatactttgagatggcaaggggcaaaaacgcccttgagctcacaaagtggttcaacaccaactaccactacctcgttccggaacttgaaggagaaaattttaagcttctaataaacaggccccttgaggattacaaattcttcaaggaaaagggtataaacacggttccccacgtgataggactctttacattcctaaaactctcaaaagctcccaaaagagttgaagaagaaggactccccgtaataatactcgaaaaactggacacaaaagaaagactggagaagttcacaaaagcccttctaccggtttacaaagaactccttgaaagcctaaaaaatgaaggagtaaacagggttcactttgaagaacctgctctcgttacggatttagaggactacgactgggaaattcttaacgagatatactccgaactctcaaaggtgggagtggacctcggaatactcacctactacgacagcgtttctgattacgataaattcgtaaacctccccgtgaaagcccttcactttgacctcgtttctaacgaagaaaacttaaagaacataaaggaaaagggctttccagaagataaggaactgatagctgggataatcaacgggagacagccctggagggctaacttaagagagaaggttaaactccttgaggagctcctcaaagtttcagcgaacttagtcgtttcaaattcatgtcccctttaccaccttccggtgaccgttgaaccggaagacgaactacccgaaggtctaaaggaaagactctccttcgcaaaggagaaactcagagagataagactgataaaagaagcccttgaaggaaaagaagaggcattaagggaagtagaaagctccgaaaaagtaatgaccgctgtctttgcacaaaatccggaagtcaggaggagactcgcaagcctcagcgaaaaggacttccagagggaactaccttacaaggaaagggacaagatacagagggatatactcaagctcccgctttttcccacgaccacgataggttctttcccacagacggaagacgtaaggaagatgagaaccgcttacagaacagggaaaatatcggaagaggagtacaagaacttcattaagcaaaagataaagtacgctattgaggttcaggaagacatagggcttgacgtcctcgttcacggagagtttgaacgttcagacatggttgagtacttcgccataaagctcgacggcatagctaccacaaaacacgggtgggttctctcctacggctccagagtttacagacctcctataatatacggagacgtttcaagacccgcccctatgacccttgaggagataacctacgcccaatcgctcacaaacaaacccgtaaagggaatgctgaccggtcccgtcacaatcctaaactggagctactaccgtgaagacgttccaaagagagaaatagcctaccagatagcccttgcgcttctggatgaagtcaaggaccttgaaaatgcaggaattaaagtcatacagatagacgaacctgccttcagggaaggagcacccttaaagaagagagattggcccgagtactttgattgggcagtgaaagccttcagactcgcatccagggcaaaacccgagacccagatacacacccacatgtgctactcggagtttaacgagataattgagtacatataccaaatggactttgacgtcatatccatagaggcgtcaaggagcaagggtgaaataatagaagtctttgaaaagttcaagggatgggacagacagataggtataggtgtttacgacattcactcacccgctattcctacgaaggaagagatgaaggctataatgctaagagctatgaaggtacttcctaaagaactcctgtgggttaatccggactgcgggctcaaaacgagaaggtgggaagaagtgatacccgcactcaggaacatggttgacatggcaaaggaactcagggaagaggtaggtgtaaaagtatga

SEQ ID NO: 23817 - DNA, 921 bp, Aquifex aeolicus
atgaaaagggactttgtagacctgtgggatttaagtcccaaagaggcatgggagatagtaaaaaaaaccctgaaagttaaaaagggagaagaagaacttggaaaaccgctttccgggaaaacgatagcccttctcttcacaaagccctcaacgaggacaagggtttcctttgaagtgggaatttatcagctcggcgggaattccttattttttcaagagaaagagctacaagtttccaggggggaggacgtaagagataccgcaagaacactgtcaaaatacgttgacggggtgatagtgagaaatcactcccacacgtggttgaaggagtttgcaaatttcgcgagcgttccggttataaacgctttgaccaacatgtcccatccctgtcagatactgagtgatgtgttcacactttacgaacactacggtgaggaacttaaaaacctaaaggtagcctacgtgggggacgggaacaacgtgtgcaataccttaatggtcggggcggggatgttcggactgaaactcttcgtggcaacccctgaaggttacgagccaaattcctattactacaaaaaagcacttgagttttcaaaggaaaacggcgggagcgtggaactaactaacaacccggtggaatcggtaaaagatgcggatgtcgtttacacggacgtttgggtaagcatgggagaagaaaacaaaaacatagaagcgtttttaccttatcaggtaaacgaaaaactcctctctttcgcaaagagttccgtcaaagtaatgcactgcctccctgcaaagaaagggcaggagattaccgaagaggtttttgagaagaacgctgactttatattcacgcaggcggaaaacagactgcacacacagaagacactcatggagttcctattcagagaacctcaagcttag

SEQ ID NO: 23818 - DNA, 747 bp, Aquifex aeolicus
atggaaataaaactccagggcaaggtttccctcgtaacgggttccacaagaggaataggaagggcgatagcggaaaaactcgcatccgcggggagcaccgtcataataacgggtacttctggagaaagggcaaaggctgttgcggaggaaatcgcaaacaaatacggagtgaaggctcacggtgttgagatgaaccttttatcagaagaaagcattaacaaggcctttgaagaaatttacaaccttgtagacggtatagatatactcgtcaacaacgcgggaataacgagggacaagctctttttaaggatgagtcttctggactgggaagaagttctgaaggtaaacttaacgggaacttttttagtcacacagaactcgctgagaaagatgataaagcagagatggggaaggatagttaatatttcttccgttgtaggttttacgggtaacgttggacaggtaaattactccaccacaaaagctgggctgataggttttaccaaatcccttgcaaaggaactcgctccgaggaacgttcttgtgaacgcggtagctccgggatttatagaaacggacatgactgcggttttatccgaggaaattaagcagaagtataaggaacaaatccccctcgggcggttcggaagtcccgaggaggttgcaaacgtggttttattcctttgttctgagcttgcaagttatataacgggtgaagtaattcacgtaaacggaggaatgttttaa

SEQ ID NO: 23819 - DNA, 237 bp, Aquifex aeolicus
atgagtttagaagagagggtcaaggaaattattgcggaacaacttggagttgagaaggaaaagataactcccgaggcaaaattcgttgaggacctcggggcggattctcttgacgtcgttgaactcataatggcctttgaagaggagttcggtattgagatccctgacgaggacgcggaaaagatacagactgtcggggatgtaataaattaccttaaagaaaaggtaggaggatga

SEQ ID NO: 23820 - DNA, 1248 bp, Aquifex aeolicus
atgaagagaagagttgttatcaccggcatcggggcggttacgccccttggaacaggcgtaaagaagttctgggaaaaccttgtaaagggtgtaagcggtgttgattacataaagagctttaaccccgacgaatacggaatacccgtaaagatagcggcggaagtaaaggactttaatccagaagactttatggataaaaaagaggcgagaaaagcctcccgctttgtccagtttgcaatagctgcggtaaaggaagcccttgaagacagcggactccttgaaagtgagtacgacccttacagagtaggggtaattatagggacaggaattggcggtctcaaggatatagaagatcagactttaatccttaaagaaaagggagcgagaagggtatctccctttttcataccctacggcatatccaacatggcttcggggcttgtggccataaagtggggctttaaaggtccaaattactgcgtgacttccgcctgtgctacgggaaaccacgctataggagacgccttcagactcattcaaaagggtgatatagacattgctatagcgggaggaacggaagctgcgataacccccctcggtgttgcgggatttgcatccatgaaggcactctctacgaggaacgacgagccccagaaagcttcaagaccctttgacagggacagggacggcttcgtaatgggagaaggagcaggaatactgattttggaagaatacgagagggcaaaggcaaggggtgcgaagatatacgctgaactcgtgggctacggtgcaaccgacgacgcttaccacataacttccccccacgagtgcggtgagggagcttacgagtgcatgaggttagcactggaagacgctggaattaaacccgaagaggtggattacataaacgcccacggaacatcaacaccgctcaacgacaaaacagagacgatggcgataaagcagctcttcggagaacacgcatacaaacttaaaatttcttcaaacaagtccatgatagggcacctgctcggagccgcagcggctgtggaagctgtagcaacgataaaaaccatagaaactggagtgatacctcctaccattaacctggaaaaccccgatccagagtgtgatctggactacgttccaaacaaagccgtggaataccccgtaagggttgcactttctaacgcctttggttttggaggaactaacgcaacgctagtgttcagaaaaatagaagaatga

SEQ ID NO: 23821 - DNA, 1095 bp, Aquifex aeolicus
atgtcacaggcggtcaaagactactacgagatactcggcgtaaacagggacgctacgaaggaagaaataaaaaaagcatacagaaaacttgttaggatataccaccccgacataaaccctgacccgagcgctcaggagaaatttaaagagattaacgaagcttaccacgtccttatagacgacgagagaaggagcgagtacgacgcaatcctgagcaggaatgacgtaggtaagttcagggactttctggagtacattcaggagtttgtggaaagcataattcagggagaaaagggaaagaagagaagaccaagaaagggacaggacataaagatgaagcttcccctcacgcttgaagaggcgggactcgggtgcgaaaaggaaatcatttacagcagatggatggactgtcccgtgtgtgaaggtatgggagtaaagggagaggcggaaacggttgtttgccacgcatgcaacggagagggtaggagggtaagtgggatatttaacttcccaagaccctgctcagtttgcaaaggtaaaggcttcatcgttaaaaacccatgtcctacctgctatggaagaggtagagtttccgcacagcacaagataaaagttcacatacctcccggaacggaagaaggagaagtcttaaaggttccagaaaagggacatctcggttactttggtggaaagccgggagacctttaccttaaggtagttctaaaagaacatccgatttttaagaaggtaggcaaggatctccacatggaaaaagtagtgagctttccgctcgcggttctgggaggaaccgtaaaagttcctacattggagggcgaagaaatagacgtattcatacagccgggaactgagtgcggtgcaacgaaagtggtaaaggaaaaagggtatccatacgaaaatggaaggggagaccttataattcacataaggataggagttcccaaaaacctttcaaagtctgaaaggaaacttttagaaaagctcgcagaatctattaaggaagagggggaagaggtttacagggaaggtggaagtcttgtagaaaagttaagttccctctttaaaaagaacgcctga

SEQ ID NO: 23822 - DNA, 2070 bp, Aquifex aeolicus
atggtagtccagcttgatcaaatacactttttcatttttcatgaagtccttaaaatatttaaaactatgcctcagctttttaaaacctctaaaaaaatcgacgagctggttataaacactattcgctttttgagcgttgatatggtcgaaagggcaaaatcaggacaccccggaatgcccctcggagcttcccacatagtttatctgctttacgacaggataatgaagtacaaccctaaaaatcccaattggtttaacagggataggtttatactctctgcgggccacggaagtgcaatgctctatgcagccttctacatgttcggatttgacctgactcttgaggatctaaaagccttcaggcaactaaacagcaaaactccgggacaccccgaatacggactcactcccggcgttgaggtgactaccggaaacctcggacagggattcgggaatgcggttgggatggcgatggctgagaaatttttgtcccactactttaacagggaaggataccccgttatagatcactacacctacgtccttgtatcggatggggacttaatggagggtgtttcttacgaggctgcatcccttgcgggacactttaagttaaacaagttaatagcaatatgggacaacaaccacataactatagacggagacactaagcttacgtggacggaagacgtcttaaaaaggtttgaagccctcggttgggaagtgtaccacctggaagacgggtacaacttggatcttctggaagaaacgattctaaaagcaaaagaaagcgacaagcccacctttatatccgtgaggacgcacataggttacggaacgccccttcaggatacaccggaagtccacgggaagcctatgggcaaagagatagtggaggaaaccaagaagaagttcggctggccacttgaggagttttacgtccccgaagaggcactcaattatacgagaaggaaagttgaagaggggaaagctctcgaagaagagtggaacaaactttacgccgaatacagggaaaaataccccgaccttgcccagacgcttgagaaggctcttaacaaggagtggagtttagactggcttgaaaaagtagaggaattcaaagaagacatgcctaccagaaaagcctcggggaaagtgctcaacgtaatggcggattacatacccaccatgattggcggttcggcggacctttcggaatccgtgaacacagtgttgaaaaagtacggagattttgaagccgacacacctacaggaaggaacgttcactacggtgtcagggaacacgccatgggaacgattctcaacggcatggcttaccacggaggaatactcccttacggcggtactttcctcatattctcggagtacatgagacccgctataagaacggcagcactcgcaaacctacaggtaatcttcgtttactctcatgactccataggtctgggagaggacggtcctacccaccaacccgttgaacaactttggagcctgaggagcatacccaacctctgggtagtaagacccgccgacgcaaacgaggtgaagtacgcgtgggagatagccctgaagaggaaaaacggccccacggccataatactcacgagacaaaaagtaaaaaccatagacagatccaagtacgcctctccggaaggcgtaaggaaaggggcttacgttatagctgatacagaaggaaaaccggatgttgtaatcatcgcaacaggttcggaagttcaggttgcactcggagcgaaagagatactggaacaaaaaggaataaaaacgagagtggttaatatggcttgctgtgaactcttcgaagaacagcccgaagagtacaaaagggaagttctgcctcccgaagttacgaagagggtagccgttgaagcgggaagggacacgggctggtataagtacgtaggaagcgacggactcgttattagcctgaacgagttcggtaagtccgctcccggaagcgttctctttgagtattacggctttacaccggaaaacgtggccaataaggtaattgaaaagtggttttcctga

SEQ ID NO: 23823 - DNA, 1449 bp, Aquifex aeolicus
ttgttaaatgagataaattatttcccgcttttttctttcatcctatatattaattccatggaagtcttgactaactcaaaagttgaaaaattaaaaaaggcactgggagaaaagaaggtaaaggactcaatagttgagagaaagctctacgcctacgacgctactccgattcccattcagagggctatcccttccgcggttgtatttcctgaaaataaagaagatgttataaagctcgttgaagtttgttatgaggaagacattcctatatttccgagaggtgcgggttcaggattgacgggaggagctgtacccaccattgaggagggaattgtagtttcctttgaaaaaatggacaaattcaccgtggacgttgataacgcaacagcggttgttcagccgggcgtaataacttaccagtttcaggagtacgttgaaaagctcggactcttttacccgcccgacccttcatctttcaagtactcaactataggtggaaatgttgcggaaaacgcaggaggacccaggtgtctcaagtacggtgtgacgagggaatacgtcctcggacttgaaacggtaataaaaaacggagaggtgataaggacgggaaggccagtcctgaaggacgttgcgggctacgacctcacgaaactgcttgtcggctcggagggaacgctggggctctttacggagataactttaaaactcattccaaagccaaaagcaagaatgactgctctggcactctttgatgatttagagacagtaggaaaagcggtaacgaagattttaacctccggagtattcccttcagctctggaattcatggacagggacgcaataagggctgttgaagacttcaaacccgtaggacttccgagggacgtggaagctctgctacttatagaggtggacgggcatcctctgacggttaaagaggaaataaaggaagtaggaaaaatacttgaggaactcggagcaaaggttcaggtggctcaatcggaagaagaagcccagaagctctggagtgcaagaaagaacctcggtcccgccctcggaaacttaaaaaccggaaagataaacgaagacatagtattcccgaggacttacctccacgaagcacttcccaaattaagggaaatagccaaaaagtacaacctcactatggtagttttcggacacataggagacggaaatctacatgtaaacctcctctatgacaagtcaaacaaggaagaagaggaaagggcggaaagggcggttgacgaggtatttgaactggcactcaattacaacggttccataacgggagaacacggtgtggggcttactaagaggaagtttttaaagtggcagttcggagaaacgggatacgaacttttgaaaggaattaaaaagttgtttgatccgaagaacctctttaaccccggcaaagtccttgaactctaa

SEQ ID NO: 23824 - DNA, 753 bp, Aquifex aeolicus
gtgtggatgtatattcataagatcatgaaactttcttacaaaagagttatcctaacgagggaacttgaggatataaaaaaggataaacctctctttgaaagagaaggctttaaagttttggagcttcccttaatacaaacaaaagttcttgagtttaaccttcccgatgaagaatttgattacattgtttttcaaagcaaaaaagcggttaaaatttttcttggcaaggtaaatcttaaaggaaacaaaaaaattgtagctgtagggaaaaaaacggcggaggaattggaaaaattagggtataaagcggatttcattccggaaaatgaaagtgcaaagggcttgatagaactctttaaaagattacctaaaggaaaggttctaattccacgttctaaaataggcagaacagagttaataaagtttttaaaggaaacgagctttgaagtttttgcgttggatgtttacacaactgaatacgttttttatacaagagaagaactcctggaaaaactaaacaaaggagactttattatcttttacagtccatcggcggtgaaggcattttttgcaaatttgcaaatgcataaaattccaaaggatagtttgagccttaaatttgtagcgattggtaaaactacaaaagaggaattacagaaacactctgttaaaaacgttattacctctgaaagaccgagtactgaggatattgtcaagaaactaaaagaattggcacgtgatttgcaaaaataa

SEQ ID NO: 23825 - DNA, 1008 bp, Aquifex aeolicus
atgagaatgaaaaaaaccgttgctgtaatcggtgcggggaacgtgggggagcacgtcgcctccctcatccttttaaaaaacctcgcaaacgttaaaatgttcgaccttcccagaaaaacggaagagaaagtttttgagccagttaaagggaaggccctcgacatgaagcagatgctcgcagctatggacatagatgcgagggtagagggctatactgtgacacctgagggcgaaggctacgaacccttagaaggttccgacatagtggtaattaccgcgggttttcccagaagaccgggaatgagcagagaggaccttcttgaggcaaacataaggataatctcggttatagcggacaggattaagaggtacgcaccagacgcaatagtaattgttgttacgaatcccgtggacgtcatgacctacgtagcctacaagctccttaactttcctaagaaccgcgtaatggggatggcgggagtgcttgattccgcgaggttcaaaacttttatttccgaagaactcatggtttctccgaaagacatccacgcttacgtgataggcgggcacggtgatgagatggttcctcttatttcaatttctaacgtgggaggaatacctttaaaggatttacttccaaaggaaaagcttgaaaagattatagaaagaacacgctttggtggcggtgagatagtaaacctcatgggaacttccgcttattacgctcctgcggcggcaattgtggacatgatagaggctctcgtccagaacagcaagaggatactcccctgcagtgtttaccttgacggagaagcaggtgagtactacggagttcagggcttttgcgtgggagttcccgtgaaacttggttctaacggggttgaagaaataataaaagtgcctatgatagaagaagaaagggaaatgtggagacgttccgtcgagtctgttaagaaaaccgttgaagttgcggagggtatactaagtgcgggaagttcacgtcaatga

SEQ ID NO: 23826 - DNA, 1980 bp, Aquifex aeolicus
atggctaaagggacggttgcgtggaagatcattaaaaaccaccttgtttcgggaaaaatggagcccggtgaggagatagcgataaagattgaccagactctgactcaggacgctacgggaactatgtgttacctcgagttcgaagcgatgggcgttcccgaggtaaagacggaactctccgtgtcctacatagaccacaacatgctccagacggacttcaggaacgcggacgaccacaagtacttgatgagcgtagctaagaagttcggtatatggctctcaaagcccggaaacggcatatgtcaccaagttcacttagaaaggttcgcaaaacccggaaagacgcttctcggttcggactcccacacacctaccgcgggcggaatgggaatgctcgcaataggtgcgggcggattggacgttgccgcagccatggcgggagaacccttctacctgaagatgcccaagatcgtgggtgtacacctcaaaggcaaaatgcctgagtgggtaaccgcaaaggacataatccttgaactcctcagaaggctcaccgtaaaaggcggtctcggaaagatatttgaatacttcggagagggggtaaaggaactctccgttccggaaagggcaaccataacgaacatgggagcggaactcggagctacaacttcaatattcccctcagacgaaataactagagcttacctcagagctcagggaagggaagaggactgggtagaactcctaccggatcctgacgccgagtacgacgaagttatagagataaacctctccgaattagagcctctaatagctcaacctcactccccggacaacgttgttcccgtaagggaaatagaaggaataaaagtggatcaagtagtgataggttcatgtacgaattcctccttcgttgacctaacgagagctgctaaactccttgaaggaaggagggttcacccggacgtagtctttgcggtagcacccggttctaagcaggcgctagaattaataacccagaacggagcacttcttaacttcctgaaggcgggagcgaggattctggagagtgcatgcggtccctgtataggaatgggattcgctcctcccacgaacggagtttccgtaaggagcttcaacaggaacttcaagggaagggctggaacgcctgacgcaaaagtttacctcgcgtctcccgagacctgtgttgccgcggcaatagctggggagataatagacccgagaaagctcgctgaaagggaaggtgtaaagtggataagggtagaaatgcccgaaaagttcccatacggagacgaagccttcataccgcctcttcccaaggaggaaagggaaaaagttgaaatatacagaggtccaaacataaaacctctccccgaatttgaacccctgcccgaaactatagagggagaagtcgccctcatcgttgaagacaacataaccacggaccacataatgcccgcaggtgcgaagatactccccttgaggtccaacatatacgctatttccgagtacgtttaccactacgttgatcccgaattcgtcccgagaatgaagaaattaaaggaaaaaggaaaagcgggaataattatcggcggagaaaactacggacagggttcctccagagagcacgcagcactagcacccagattcttgggagtaagggcagttatagccaagtccttcgcgagaatccaccacgcaaacctcgtaaacttcggagtagttccattagagttcaagaataaggaggattacgacaagttcagtctaggagatgagatagaaatacctaacctcatagaaagactcaaaaaaggtgaagacatactcgtaataaacaagaccacgggagaggaaatcctgtgtacgtataacctcacacccgtacagaaggaaatactcatagccggcggaagactcaactacataaagaacaaacacaggaaggaggtttccgcatga

SEQ ID NO: 23827 - DNA, 882 bp, Aquifex aeolicus
atgagaggagtaattttgtttttactcttttttacactttcctttgcaaagatttacttaatctcgcctgaagaactccacaaacttataaaagaggagaaaaaccttgtcataatagacctcaggaaaagcataaaggaatactggaaggagcacatacccggagcccagtgggtgcactttgaagccttcagatttccgaaaggtggaactcctgctttcttcttacacacggaaatattcgtcaaaaaactcgaaaaactcggaatagataagaacactcccgtcgttctatacgacgctgaggggactttcatccccttttacgtagcttggggacttgattacataaaccacaaaaaagtatacgtccttcacggaggatttaaccactggaaggataaggatctacctacgacaaaggattatccgaaagttaaagaaaaacgttacggaaagtatacgataaacaaaagtataagagccgacctcgattacgttaaaaaagctttaaacagagaagacgtagtctttctcgatgccaggacaccggaactttacgaaggaaaggccggattctggaagaggctgggacacataaagggagccgtaaacaggttctggaaacaagattttgaagagcacgttaacaagtacggaaaaaagtactacttactaaaaccgaaggaagatataagcctcttttacgagagtctcggtataggaaaaggaaaggaagtaatcctttactgcggacaggggcttatgtccgcggcaacttactatgtgataaagtattacctcgggcttacggataaggtgaggttgtacgacggttcttggaacgagtactcacaaacaaacctgccaaaagaaccctga

SEQ ID NO: 23828 - DNA, 1308 bp, Aquifex aeolicus
atgggctttgtaagggtcggaataatcggttgcggtacggttggaacgggaaccgccaaactcctcatacagaatgcagacctaataaagaagaaaacgggtatagagttcaaactcgtgaaagttgcggacatagactgggagagaaagagggagtttgaagttccgaaagaactgagaaccacagattataaagaagttatagataattcggacgtggtcgttgaactcgtaggcggtaaaactttcgctaagaaggtaatactggaagctctggaagcgggaaagtgcgttgttacagcaaataaacacctcctcgcagaggaagggaaggagatttttgaagaggccaagaagagaaacttatttataggttttgaagcctcggtgggaggagggattcccgtgataaaagcgttaagggaaggacttgcggggaataaaattctcaacatcctcggtatcctcaacggaacgacaaattacatactcacgaggatgtttgaggaaaatcttgactttgaaacggctttaaaggaagcaaaagaaaaagggtatgcggaggcagatccaagtcttgacatagacgggtgggatgcggctcacaagattgctattctcgccatgctcgcctacggtgggtatctagactttaacgacgtttacgtagagggtataaggaacgttgataagctcgacgtagaactgggaaaggaactgggatacacactgaaactcctcgcaatcgcgaaaaaagttgactcggaggttgaggtgagggttcatcccacctttatacactccgaggaagcccttgcaaaggtctccggagtttacaacgcagtcatgatagagggagattttgtagggaaaaccatgttctatggtcagggggcgggttcacatccgaccgcttctgcggtggtggcggacgtgatagacgcggggaggttcttactctgtagctctaaggttcttcctcccgtgaactgggaagaaggagaactgaaggtcaggaagaacttttactccaggtactaccttaggtttgacgttcctgacaagcccggagttctggcaaagatagcgaatgtacttgcggattacaatataagcatagcctcggttctccagaaggaaatggtttgtaaaatcgcgggcagggagggtgaaactatagttcctctggttatcctgactcacaaagcttttgaagaggatatacagaacgctttaaaggagatacagaagctccccgtagttgttgataagcccgtgctgatacgtgtggaagaggaggcttactga

SEQ ID NO: 23829 - DNA, 840 bp, Aquifex aeolicus
atggaattctggaagctacagggatcgggaaacgacttcgtggtaatagacgacagggacgaaaaactcgaaagctttttaaaggaaagaggtgtatcaaaagaagattttgttaggaaggtgtgtgcctttcacacgggagtcggtgcggatgggttgatactcattaaaaatccagacaatcctgaaaacgacttcaagtgggagttttttaactccgacggttccgtggcggagatgtgcgggaacggttcgaggtgtgccgttaggtttgcatacgaaaggggaattgtagggaataaggtcaggtttgaaacccttgcgggtgttataaaggcggaggtttacgaaaacggaaggaaggtaaaggttcagttgacgcctccctcaaagcccgaagagaagacactaaccgtggatggagaggaagtaatcggtgttttcataaatacgggtgttccgcacttcgtagttcctgtggaagatgttgaaaaggtaaacgtgataaagctcggtagggctataaggtttcacgaagaattccagccgaagggaacgaacgtaaacttcgtccagccggtaagcgaggatactataaaagtgagaacatatgaaaggggagttgagagtgaaacgctcgcctgcggaacgggagctaccgcctgtgccattgtttcttacttaaagggtctagtgaagaaaaagcccgtaaacgttctaactagaagcggtgaggtactcacgatagatttttcggaggatttaaaagaagtcttcctaacgggttctgtttacaaggtttttgagggcaggcttagtgaagaagtacttgagtattaa

SEQ ID NO: 23830 - DNA, 1023 bp, Aquifex aeolicus
atgggttacagagtcgcgatagttggagctacgggagaggtaggaagaacatttctgaaggtccttgaagagaggaattttcccgttgatgaactcgtactctacgcttcggagcgttcagagggaaaggttctaacttttaaggggaaggagtacacagtaaaggctcttaataaagaaaattcttttaaaggtatagacatagcacttttttccgcaggaggttccacgagtaaagaatgggctcccaagtttgcaaaagacggcgtcgttgtaatagataactcctccgcttggagaatggaccccgacgttcctcttgttgttcccgaggtaaatccagaagacgtaaaggactttaagaagaagggaataatagcaaatccaaactgttccaccatacagatggttgtggctctaaaacctatatatgacaaagcgggaattaagagggtagtagtttctacgtatcaggctgtttcgggtgccggggctaaagcgattgaggacctcaaaaatcaaactaaagcctggtgcgaagggaaggaaatgccaaaagcccagaagtttcctcaccaaatagccttcaacgcccttccccacatagatgttttctttgaagacggctacacgaaggaagaaaataagatgctctacgaaacgaggaagataatgcacgacgagaacataaaggttagtgcaacctgcgtaaggattcccgttttctacggacattcggaaagcatatccatggaaacggaaaaggaaatatctcctgaagaggctagggaagtgctgaaaaacgctccgggggtaattgtaattgacaaccctcagaacaacgagtacccgatgcctataatggccgagggcagggacgaggtatttgtcggaaggataagaaaagacagggtctttgagccagggctttccatgtgggtagttgcggacaacataagaaagggtgcggctaccaacgctgttcaaattgcagaacttttagtgaaagaaggactaatctaa

SEQ ID NO: 23831 - DNA, 1023 bp, Aquifex aeolicus
atggagcaaacgttaagagtttccgttttcggtgccaccggttataccggtatagaactccttcgctcccttctcacacacccccactttgaagtaaaaaaccttatctctcagtcttacaaaggcaaaaaagtaagggaggtacttcccttcttttcaaacacctacatatccgagatagagttccttgaagaacctgttgaagactacgaacttgcctttttatgccttcctcacgaagtctcctacgagatagttcccaaactgctctcccagggcaaaaaggttgtggacctatccggtgcttacaggataaaaagtcccaaagcttacgaggaattttacggatttaaacacgagagggaagatatccttcagagggctgtttacggacttccagaagtttttagagaggagataaaaaatagcgatctcgtggcaaaccccgggtgttatccaacggctacacttctggcaatataccccttcctcaaggaaagggtgggaatagagagtgtaattgttcacgccctttcgggtgtgagcggagcgggaaggaagccaaaacaacaatttcacttccccgaaatgacggaaaacttcttcaattacgcggtagaaaagcacaggcacactcccgagatggaagacgtaataaggagagtttacggaagagaagtaaaggtaaggtttactcccaccgtagttcctacctcaaggggaatgatatccacggtttacctgaaatcagaaaaattaaacgtaaaggagcttttcaaggaagtttacgaagacgagattttcgtaaaggttgtggacgaaccacctcaaaccaagtgggttctgggaaccaattactgttttatttatccccattacgacgaaaggacaggctattacgttattatttctgcaattgacaacttgggtaaaggagcttctctacaggcggttcaaaacgcaaatttaatgttcgggcttgcggaagacgacgggctccttcaacttcccgttttcccctga

SEQ ID NO: 23832 - DNA, 1107 bp, Aquifex aeolicus
ttggctaaatcattgctttttatcacaagctttttaaaaccgcgttataataaaccaattatggaaaagaactggaacgtaggtacgaagtacttgaacgataaaacgaggataattgttgtaggtattacgggaagggaagcctctcaggtcgttaccgaaagtgaagccctctaccccggatttattaaggttggagttacgcccggaaaaggcggaacggaagttgcgggagttcccgtcttcaacaccgtaaaggaagctctttcttctcccgaaggaaaagacgtaaacactgggctcgtttacgttcctccagcttccgtaaaggacgcggtaatagaactcatcgacgcgggaatcaagttaatctacatagtcacggaacacgttcccataagggataccgtttacttctatcactacgcgaaagaaaggggtgttacgatagtaggccctacttccctcggttgcatagttccgagaattcccgcaaggattggtgcgataggaggtaaaaatccttccatagcctacgcggacggcggactcgtcatactctctaagtctggaggacttaccacgacaacggcggaaatgttcaagagaaggggatggggtgtttacatggctctggcactcggcggagacgttatatcctgtacaacctttgcggacgttctagaagaaatagcggatgaccccaacgtcaagggtgtagttatacagggagaggtaggcggaacttacgaagagcaggcagccgagacgatactcagactttacaaggaaggtaggtggaacaaacccgttgcggcgtttgtagccggtaagttccaagagaagatggaaggtgtttccttcggtcacgcgggagcgatagttgaaaggggtaagggtaaggctacggacaagataaggatgtttaacgaagttggaaaggaaacaggactggttaaggttgctgagttttaccacgacctcgtaaactgcatagaagaactcggagttcccagagactttgaagactccacacccggcggaaaggtagaacctctctacagaacaatagaccccgaaacctgcgagttcaaacctcaggactaa

SEQ ID NO: 23833 - DNA, 876 bp, Aquifex aeolicus
atggctctaatacttgacggaaagagcctctcaaagaagataagggaagaaataaagaaggaggtggaaaattttacttcaaagggtttcagaccgcccgcactcgccgttatacttgtaggaaacgaccctgcaagcgagatatacgtgaacaacaaaaggaaagcctgcgaaaaggttggaataaagtctcttttttatcatcttccgcaggacgtttcagaagaaaaactcctcggacttatatacgaactcaacatgaacgaagaggtggacggaatactcgttcaacttccccttccaaagcacatagaccagacgagggtaatcctttctatatcccccgaaaaggacgtggacggctttcaccccgaaaatatgggaaaactcgtagcacagatagaggacggctttataccctgcacacccctcggtatagacatcctgctaaagcactacggtatagacgtaaaaggaaaagacgttaccatagtgggagcaggctttatagtgggaaggcccttaagccttttgatgctctggaggaacgcaacggtaagcgtgtgccacattcatacgaaagacgttaaaaagttcaccaaagaggctgatatactcatctccgcaacgggagttcctcacctcataaaggaagacatgataaaggaaggcgcggtggtcgtagatgtcggaatttcaaggttaaacgggaagatagtcggtgacgttgattttgaaagagtaaaggagaaggcgagtgccataacgccggttccggggggagtaggacctatgacggtaaccgcacttcttttaaacactttgaaatcctataagaggaagttcgctcacttgatttcaacgacgaatccgtaa

SEQ ID NO: 23834 - DNA, 4725 bp, Aquifex aeolicus
atgagtgaagcaagaaggggtatcttccccttctcaaaaattaaattgatgctcgcttctcccgaggatatcagaagctggtctcacggtgaagttaagagacctgaaactctaaactacagaactctgaaacccgaaaaggacggtctcttctgcgctaagatttttggtcccataaaagattacgagtgtctctgcggaaagtacaggggaaagaggtacgaaggaaagatatgtgaaaagtgcggtgttgaagttacaacttcttacgtaaggagacagaggttcggtcacatagaactcgctgctcccgtcgttcacatatggttcttaaagagcacaccctccaagataggaacgctccttaacctcacttcaagagacgttgaaagggtcgcttactttgagtcttacctcgttattgagtatccaaacgaggaagaagaggaaaagtttgagaaggacgagcacacgataccactcaacgacggcatttccaccaagtgggtaaaactccacgtggtgaacgaggaggagtttgaggagaagtacgccttcaccatagacgaaaagtacgagcacggaatgggggcggaaatactcaaagaagttctatcaaaactcgacctagacgcctactccagaaaactgaaggaaatagtaaagccctactcaataggatttgaagacctcggaaaagaaattgaacagaagtacaagaacctttaccagaaacttatcaaggttatcgcggacgacttcagggcttacggcgttgagataaaaggacttgaagatcacggactcagcctagaacaggctatccacaggattctaaacgaagaactgtacctcaatgtagagacgggagaaatttcccttgaagactgcggagacagctgtctcacgggaagggacgctctgaaggagtactacgaaagggtaagggaacacaaaaaggacatccccatctttgaaaagataaaggaagacataagatccacggtactgagggaaatatccgaagccagaatcaggaaggcgctcagaactctccagctagtagagggcttcaagaagagcggaaacagaccagagtggatgatacttgaagttcttccagttcttcctccggaactacgtcccctcgttgcactggacggaggaaggtttgcaacttctgatctgaacgacttctacagaagggttataaacaggaataacagactaaagagattaatagaactgaacgcccccgacataatcatcagaaacgaaaagagaatgcttcaggaggcggttgatgccttaatagacaacggaaagagaggaaaccctgtaaagcaaaatggaagacctttaaagtctcttgcggactacctgaaaggtaaacagggaaggtttaggcaaaacctcctcggaaagagagttgactattcaggacgttccgttatagtcgtcggtccagaactccagatgcaccagtgcggtcttcccaagataatggccctcgaactcttcaaacccttcgtatacaggagactggaagaaaaagggtatgcgacttccataaaacacgcaaagagactcgtagagcaaaagacacccgaagtatgggagtgccttgaagaagtggtcaaagaacaccccgttctgctaaaccgtgctccaacgctccacagaccttcaattcaggcttttgaacccgttctcgtagaaggaaaagccatacagctacaccccctcgtttgcccgccctttaacgcggactttgacggagaccaaatggccgtacacgtccccctcggaatagaggctcagcttgagtcttacatacttatgctctccacgcaaaacgtactttcccccgcacacggaaaacccctcacgatgccctcacaggacatggttcttgggacttactacatcacccacgaccccatacccggaaggaaaggagaaggaaaagctttcggtacctttgaagaagtcctcaaagctcttgaactcggacacgttgacatacacgcgaagataaaggtaaaagttggaaacgagtggatagaaacaactcccggaagggtactcttcaactccataatgcccgaaggacagcccttcgttaacaaaacccttgacaagaaaggactttcaaagctaatcactgaactctatataagggtaggaaacgaggagactgttaagttccttgaccgtgtgaaagaacttggattcctcaggtcaacgcttgcgggtatttccattggtgtggaagacctgcaggttcccaaggcaaagaagaagataatagaggaagccctcaagaagacggaagagatatggaaccagtacgttcagggtatcatcaccaacaaggagaggtacaacaggataatagacgtctggtccgaagccacgaacctcgtttccaaggcgatgtttgaagagatagaaaagtctaagagaatagaaaacggaaaggaatacccgggaacctttaaccccatatacatgatggcaatctctggagcgagaggtaacagggaccagataagacagcttgcaggaatgagaggtcttatggctaagcactctggtgagtttatagaaacgccgattatctcaaacttcagggaaggtctttccgttctcgagtactttatatccacttacggtgcgagaaagggtctcgcggacaccgccctgaaaaccgcatttgccggatatctgacgagaagactcgttgacgtagctcaggacataaccattactgaacgtgactgcggaaccgttaaaggctttgaaatggaacccatagtagaagcgggtgaagagagggttcccctcaaggacagaatattcggaagggttctcgcggaagacgtaaaagatccctacaccggtgagataatcgcaaggagaaacgaggtaatagacgaaaaactcgcggaaaagataacgaaggcgggaatagaaaaggtaagggtacgctcacctctcacctgtgaggcaaaacacggcgtttgtgctatgtgctacggatgggatctctcccagaggaagatagtatccgtgggtgaggcggttggaattatagcagcacaatccataggtgagcccggaacacagctcaccatgagaaccttccacataggtggtgcagcaacagctcagaaggttcagagcttcgtaaaggctgaaagtgacggtaaagtcaagttctacaacgtaaaactcatagtaaacagaaagggtgaaaagataaacatctccaaggacgcagctatcggaatagtggacgaagaaggcaggctccttgaaagacacactataccttacggtgcgagaattctcgtagaagaaggccaggaagttaaagcagaaactaaactcgcagattgggatcccttcaacacttacataatcgctgaagtaggcggaaaggtagaactcagggacataatcctcgacgttaccgtaagggaagaaagggatccgataacaggaaagacggcgagcgtaatatccttcatgagaccaagagacgctatgctacacactcccagaatagctgtcatcacagaagacgggaaagagtacatctacgaccttcctgttaacgccattctcaacataccgcccgaaaagatatccctcgagtggagagtatgccccacctgctccgagtccgaagagaccactatacagcaccagtactacgtggttaaagaccttgaagttcaacccggtgacatactcgcgagaattccaaaagaaactgctaaggttagggacatcgtcggtggtcttccgagggttgaagagctctttgaggcgagaaagcccaagaatcccgcaatactcagcgaaatagacggttacgttaagatttacgaggacgcggacgaggtgatcatattcaaccccagaaccggtgaaaccgctaagtactccataaagaaggacgagctaatcctcgtaagacacggtcaattcgtcaagaaaggtcaaaagattacggaaacaaaggttgcggaaatagacggtcaggtaaggattaagggaagaggctttaaggtaatcgtttacaaccctgaaacaggactacagagggagtacttcgttcccaaaggtaaattcctgctcgttaaggaaggtgacttcgtaaaggcaggggaccagctcacagacggaacacccgtacccgaagaaatactcaggataaagggaatagaagagctggaaaaattcctccttaaagaagtccagatggtttacaaattgcaaggtgttgacataaacgacaaacactttgaaatcataatcaagcagatgctcaagaaggtgaggattatagaccccggagacagcagattcctcgtaggcgaagaagtggacaaagaagaactcgaagaagaaattcaaaggatcaagctcgaaggcggaaaactgcccaaggctgaacccgtactcgtcggtattacgagagcagcactttccacgagaagctggatttccgctgcatccttccaggaaactacgagagtactcacagacgcttccgttgaaggtaagatagacgaactccgaggtcttaaagagaacgtaataatcggaaacataatacccgccggaacgggtgtggacgagtacagagaagtggacgtaatccctgcggaagaaaaggttctcgaagagaagaaagaacccaaagagggctcttaa

SEQ ID NO: 23835 - DNA, 618 bp, Aquifex aeolicus
atgcttaaactcaagttcaacgaagaaggactcattcccgtaatcgctcaggactacagaacgggcgaagtaagaatgctcgcctacgcaaacgaagaagctataaaaaagactctggagacgggatacgcccattattactcaaggagcaggaaaaagatatggaaaaaaggggagacctcgggagaactccagaaggtaattgaagtaagagtggactgcgacgaagatgcactaatctacgtaatagagcaagaaaaggacagggcatgtcacacgggtgagagaaactgcttcttcagagacatagaaggaaacaaagtggaaaaaccacttccctttgaagtacttcccagattacaggacgtgataagggaaaaaatagaaagaaaggaagaaaactcttacactgcaaagttggtaagccaagggaaggaaagagtgttccagaagttcggagaagaagccgtggaaaccctgatagccttaatgaaaggagaaaaggaagaggtgatatacgagagtgcggatatgctgtacacctttctcgtatccctgagcgtaagcgggatagacataaaggaggtgatggaggaactcataagacgctttaagtga

SEQ ID NO: 23836 - DNA, 1185 bp, Aquifex aeolicus
atgagaaaaggacttgcaagtagggtaagtcacctaaaaccttcccccacgctgaccataaccgcaaaagcaaaagaattaagggctaaaggagtggacgttataggttttggagcgggagaacctgacttcgacacacccgacttcataaaggaagcctgtataagggctttaagggaaggaaagaccaagtacgctccctccgcgggaataccagagctcagagaagctatagctgaaaaactactgaaagaaaacaaagttgagtacaaaccttcagagatagtcgtttccgcaggagcgaaaatggttctcttcctcatattcatggctatactggacgaaggagacgaggttttactacctagcccttactgggtaacttaccccgaacagataaggttcttcggaggggttcccgttgaggttcctctaaagaaagagaaaggatttcaattaagtctggaagatgtgaaagaaaaggttacggagagaacaaaagctatagtcataaactctccgaacaaccccactggtgctgtttacgaagaggaggaacttaagaaaatagcggagttttgcgtggagaggggcattttcataatttccgatgagtgctatgagtacttcgtttacggtgatgcaaaatttgttagccctgcctctttctcggatgaagtaaagaacataaccttcacggtaaacgccttttcgaagagctattccatgactggttggcgaataggttatgtagcgtgccccgaagagtacgcaaaagtgatagcgagtcttaacagccagagtgtttccaacgtcactacctttgcccagtatggagctcttgaggccttgaaaaatccaaagtctaaagattttgtaaacgaaatgagaaatgcttttgaaaggagaagggatacggctgtagaagagctttctaaaattccaggtatggatgtggtaaaacccgaaggtgccttttacatatttccggacttctccgcttacgctgagaaactgggtggtgatgtgaaactctcggagttccttctggaaaaggctaaggttgcggtggttcccggttcggccttcggagctcccggatttttgaggctttcttacgccctttccgaggaaagactcgttgagggtataaggagaataaagaaagcccttgaagagatctaa

SEQ ID NO: 23837 - DNA, 1311 bp, Aquifex aeolicus
ttggatatgcgagaggttgtggtaataggtgcaggaatttctggactttctacagcatacaggttaaaaaaggagggtgtggacgttgtagtttacgaaaaggacgacaggataggggggacgatccacacggtgaaagaaaagggatatctctttgaagtaggggctcagactatacttgcggatcaagaagttatagatttcttgaaagaggcaggaattgaacccgtagaggcttctccttcttctaaatatagatacatatacaaaaagggaaggttaattccccttcccatgtcgcccgtggaatttcttaaaacaccgcttctttcccttaaaacgaagttgaaagtccttacggaaatctttaagagaggtgttgatgaagacatttccatagcggattttgtaagagaacatttcggcgaggaattcctgaattacgtcgtggctccttttatctcgggggtttacgctggtgatccggaaaagttatccctcaagcacgccacacctaaactttatgaagctcagaaaaagtacggaagtttaataaaggcatttatcaaagaaaaaaccgcaggccctaaaggcaagctaatatccttcggggaaggcttgggagagctaataaatgcacttgctcaaaagcttgaagttcatacagaaaacgtagttctgagaatgaggaagtttgaggatttcttcaggcttgatgtgcgcgggaaaaaggttgagacaaaaagtgtcgtagtagcttccccggcctacacttcctcttatctcctgaaggaagtttctttcagtgcgagcgaagagttcgacaagatagattatcctcccgtagtagttgtgaacgtaggtgttgaagggaaattcccgaaggttcggcttcttagttccgagagtggaaaaaagagaattctcggagctatgtttatgtcaaagttattcccgggaagagcacctcagggaaaggaacttttaacggtgttcctgggaggagcaacggacagagaggtaatagagctctccgaggaagaaatagaaaacatagtagaaagagaactgaaagagatacttcaaatagactgtatagactttatgcacgttcagaagtggaagagggctatacctcagtacactctggggtacgacaggttcttgaacctagctcaagaaatggaaaaggattatcctgggctgttcctgacggggaactggctctacggggtctccaccgcagactgcataagggcttctaaaaaggtagcccagaaggtgctttctttcctgcgtcctcaggcgtaa

SEQ ID NO: 23838 - DNA, 1473 bp, Aquifex aeolicus
atggtagaagttgaaaagaagataaaggaaggtttaacctttgacgatgtccttttagtgccccagtactctgaagttctgccccacgaagttgatgtgagcacttatctgacaaagaggattaagctgaacatccccatagtctccgccgctatggatacagtaacggaagcacgtctcgctattgcccttgccagagagggaggaataggtattatccacaggaacctccccataaagaaacaggcggaggaagttgaaaaggttaagaaatccgagagcggtatgataataaacccagtaactgtaaaaccggacacacgcgtaaaggaagcacttgacataatggcaaagtacaagatatctggtgttcccgtagtagatgaagaaaggaaactcataggtattcttacaaacagagacctcaggttcataaagcccgaagactactcaaaacctgtttccgaattcatgacaaaggagaacctcattaccgcacctgaaggtataactctggatgaggcagaagagatattcaggaagtacaaaattgaaaaactcccgatagtggataaggaaggaaagataaaaggactcataacgattaaggacatagtaaagaggaaaaaatacccaaacgcttgcaaggatgaacttggaaggctgagggtcggggcagccgtaggaactggagaggaaacccttgacagggtagcggctctcgtggaagcgggagtggacgtcatagtagtagatacggctcacgggcactccaagagggttctggaaaccgtagaaaagattaaggcaaacttcccggaagtggacgtcatagcgggtaacgtggcaacggctgaaggaacaaaagccctgatagaggcaggagcggatgcggtaaaggtgggtgttggacctggttctatatgcacaacccgtatagttgcaggtgtgggtgttccgcagctcaccgcgataatggaagccgcaagtgctgcaagggagtacgacatacccataatagctgacggagggataaggtactccggggacatagtaaaggctctcgcagcgggtgcaagtgccgtaatgctcgggaacctccttgcaggaacggaagaagcccctggggagacgatttattatcagggaagggcttacaaggtctatagaggaatgggctccttaggagctatgagttcaagactatcttctgacaggtacggtcaagaaaaaatggaaaagttcgtaccggagggaattgaggggagagttccttacaaaggaaaactcgcggatgtagtttaccagctcgtgggtggactgcgttcgggaatgggatacgtgggtgctagaaatattaaggaactgcaggaaaaggcaaagtttgtaaggattacgtgggcgggatacagagagtcacacgttcacgacgttcaaattacgagagaagctcccaactactgggtcgattaa

SEQ ID NO: 23839 - DNA, 2418 bp, Aquifex aeolicus
atgagtttgactaagacgaaaagggtctccgacgttgcaaaggagcttggggtaaaatctaaggaaattatagaattcctcaacgagtattatcccagaccggacggaaagccctggaaggcttcccacggtttagacgaacaggcacttgagatgatatacgacgcgttcggtataaaggaagaagaagaaaaagaagaagtggtaacggagcaagcccaagctcccgcagaagtagaggaaaagaaggaagaggagaaaaaggaagaagttatcgtagaagaggttgtggaagaaaagaaacctgaggtaatcgtcgaagaaatagaggaaaagaaagaagaagaagagaaaaaagaggaggaaaaacctaaaaagagtgttgaggaactgataaaggaaattctcgagaaaaaggaaaaagaaaaggaaaagaaaaaggtagaaaaagaaagaaaagaagaaaaggtaagggtagtagaggtgaagaaagaggagaggaaagaagaaaagaaggaagagaagaaggaagaagaaaagcctaagataaagatgtctaaaaaggaaagagagattatgagaaaactcgaacacgctgtagaaaaggagaagaagaaacaggaaaagagggaaaaggaaaagaagaagaaggaagaggaagtaaagataatttacatacccgaagtaattactgtgagagaactcgcagaacttttagacgtacctgcgaacaaagttatagctgaattaatgaagagaggagttctcgcaaccataaaccagcccgttccacctgaggtagcggtagaggttgccgaaagtttcggataccttgcagaagtaaagaaggaagaagaagaacttgaagaggaagcactcttaaaagaagaggaagaaagggaagaagagctccaacccagacctccaatagtcgttgttatgggacacgttgaccacggaaagaccactctccttgacagaataaggaagacaaacgtcgcggaaagggaaaagggcggtataacccagcacataggtgcttcacaggttgaactgcccgacggcaggaagataacgttccttgataccccgggacacgaagcattcactacgttaagagcgagaggtgctaaggtaacggacatatcggttctcgtggttgcggcggacgacggggtaatgccccaaaccattgaagcaataaaccacgcaaaggccttcaacgttcccataatagttgcggtaaacaagatagacaaacctaacgcggatcccatgaaagtaaggagggaactctcggagcacggtctaattcccgaagagtgggggggagacaccatattcgttgacatatccgcaaaaacgggacaaaacgtggatcagctccttgagatgatactactccttgcggacatactggaactaaaggcaaatcccaacaaaaaggcaaggggcacaataatagagtctaaactggacagaaagaggggacccgttgctaccgttatagtagaggacggaacccttagagtgggtgaccacttcgttgcaggtacaacctacggaagagtacgggctatgtttgacgataaggggagacaggtaaaggaagcccctccctccacacccgtagaggtactcggatttgaagaacttcctgaagcgggtgatgaactcatagtggtggatgatgaaagaactgccagggaaatagcggaaaagagaaaggaaaagaaagagagggaagaaaagctacaaactatcaggcttgaagacatctacaaaaagatacagacaggtgaaacgaaggaactcaggatagtcctcaagacagacaccatggggtccctcgaagcactcaaaaaatcacttgaagaactctcaaacgaaaaggtacaggtaaagatcatacacggtgcggtgggcggtataacagaaaacgacataatgctcgccaaagcgtctggtgccatagtcataggctttaacactagacccgatcccaaggcaagggaactcatggaaaaagagaaggtagacgtcagactttacggagtcatatacgaggctatagaggacgtcaagaaggcactcgttggtctgcttgaacctatcaagaaagaagaagttatcggaatggctgaggttcgtgctaccttcaagatcaagaaggtgggaaccgttgcgggttgctacgtgctcaacggaaaactcgtcagaggtgctaaagcaagactgataagggaaggagtagttatatacgacggggaaatagaaagcttaaagaggttcaaggaagacgtgcaggaagtcacagcaggttacgagtgcggtgttaaattaaaggactacaacgacgtaaaagtgggtgaccagatagaatgctacgaaataaggtacgaaaaaccgacactctga

SEQ ID NO: 23840 - DNA, 1437 bp, Aquifex aeolicus
atggcggaagtgattaagggaaaggtagttcaggtcataggacccgttgttgacgtggagttcgaaggggtaaaggaacttcccaaaatcaaagacggtctcaaaacaataagaagagctatagacgacagaggtaactggttcgaagaagtactcttcatggaagtggcacagcacataggggagcacagagtaagggcgatagcgatgggtccaacagatggtctcgtgagaggtcaagaagttgagtacttggggggacccataaagatacccgtaggtaaggaagttctcggaaggatattcaacgttgcgggacaacccatagacgagcagggtccggtagaggctaaagagtactggcccatgttcagaaatccacccgaactcgttgaacaatccacgaaagttgaaattcttgaaacgggtattaaagttatagacctcctccagcccatcataaagggtggtaaggttggactcttcggcggtgcgggagttggaaagaccgttctcatgcaggagctcatccacaacatagcgcgtttccacgaagggtattccgttgtcgttggagtgggcgagagaacaagagaaggaaacgacctctggctcgaaatgaaggagtccggagttctcccttacacggttatggtttacggacagatgaacgagcctccgggagttaggttcagggtggcacacaccggacttacaatggctgagtacttcagagacgtggaaggtcaggacgttctcatattcatagacaacatattcaggttcgttcaggcaggtgcggaagtttcaacgcttcttggaagactaccctccgcggttggttaccagcccaccctcaatactgacgtcggtgaagttcaggaaagaattacttcaaccaagaaaggttctattaccgcaattcaggcggtttacgttcccgcagacgacataactgaccccgcaccttggtccatattcgcgcacctcgacgctacgaccgttctcacaagaagactcgctgagctcggaatatatcccgcaatagatcccctcgaatctacatctaagtacctcgctcccgagtatgtcggagaagagcactacgaagttgcaatggaagtaaagaggattctccaaaggtacaaagaacttcaagaaatcatcgcaatcctcggtatggaagaactctctgacgaggacaaggctatcgttaacagggcgagaagaatacagaagttcctctctcaacccttccacgttgcggagcaatttacaggtatgcccggtaagtacgtaaaactcgaggataccataaggtccttcaaggaagttctcacaggaaagtacgaccaccttcccgaaaacgccttctacatggtgggaacaatagaggacgttatagaaaaggcaaaacaaatgggggctaaagtttaa

SEQ ID NO: 23841 - DNA, 876 bp, Aquifex aeolicus
atggcgaaactttctcccagggacataaagagaaagatacagggaataaagaacacgaagagaataacgaacgcgatgaaagtcgtttccgccgcaaaactcaggaaagctcaggaactcgtttacgcttcccgtccctactcggagaaactctacgaactcgtaggacatctcgctgcccatgtggacacggaagataatcccctctttgacgtgagggaagaaagaaacgttgacgttatcctcgttaccgcagacaggggtctcgcgggagctttcaattcaaacgtaatcagaacagcggaaaatttaataagggagaaggaagaaaagggtgttaaggttagccttatacttgtggggagaaagggctttcagtactttacgaagaggggatacaacgtaataaagggatacgatgaagtttttagaaagaccgtaaacttcaatgtggctaaagaggtggcagaaatagtaaaggagaggttcttaaacggagaaaccgatagggtttacttgataaacaacgagatggtcacgagggcgagctacaaacctcaggtaagggtcttcctgccttttgaagcccaagaaaaagaagtggaagagcttggaacttacgagtttgaagtctcagaagaggagttctttgactacatagtaaacctgtaccttaactaccaggtatacagggctatggttgagtccaacgcggcggagcacttcgcgaggatgatagcgatggacaacgcaaccaagaacgcagaggacctaataaggcagtggaccctcgtgttcaacaaggcaaggcaggaagctattacaaccgaacttatagatataaccaacgctgttgaagctcttaaagcacaataa

SEQ ID NO: 23842 - DNA, 819 bp, Aquifex aeolicus
gtgataaagtacggcggttccgcaatgcacgacgaggaactcagagagtcctttgctagagacgtggttcttttaaagtacgtgggaataaacccggtaatcgttcacggagggggaccacagataagcaaaacactggagaaattcggtataaaacccaaatttgtagggggaatgaggaagactgacgaggagacaatgcacgtagttgagatggtgctttcaggagacataaacaaggacatagtagcccttataaacagatacagtggggaaaagatttacgcggtcggactgtcgggcagggacggaagactcttgaaggctaaaaagttagacaaagagaggtatttctccgaactcgggcttcccgttcctgaggaagatatcgggtttgtaggggaaatagtggacgtaaatgaagagcttatatttactctgctttcccacaacttcatcccagtaatagctcccgtgggagtaggggaagaaggtgaggcttacaacgtaaacgcggacctcgcagcctcggaaatagcgggagagattaaagcggaaaaactcatataccttaccgacacaaaaggtgtccttgacgaaaagggagagttaatttcttccctttcaaaggataaggcggaagaattaattaagaagggagtaattagggagggaatgattccaaaggttcgttccgcccttagggcacttgagaagggtgttaaaaaggttcacataatagacgggagggtgaagcactctatactccttgaggttttcacaaaggagggggtgggaactgagattactctggaataa

SEQ ID NO: 23843 - DNA, 615 bp, Aquifex aeolicus
gtggtaaaggtaaaaatttgcgggataacaaaccttgaagacgccctattttgtgccaaagagggagcggactatataggcgttataacctaccccaaaagccccagatacacgtcaaaagaaaaaagactggaaataataaaagcccttgaaggattaaacgttaaaaaagtcgcggtagttgtaaacgaaccttacgagtttataaaggaactccttgacgaaggctttgacctcattcagctccacggagatgaggacatagaactggggaaaagggttggactggataaggtaataaaagtattcagagtaaaggaagaaattccgaaagtaggagagtgggaaaaagcttatgccatactccttgacaccttttcaaaagaagcttacggaggtacgggaaaaacctttaactgggaaattgctaagaagctcgtagaagaaggccataaggtattcctttcaggaggacttaatcccgaaaacgtaaaagagggaatagagtttgtaaaaccttacggagtagatgtatcttcgggagttgaaaaggaaaagggaaagaaagattttaaaaaggtaagggagtttataaaaaggactaagtccgagtga

SEQ ID NO: 23844 - DNA, 1542 bp, Aquifex aeolicus
atggaagttaaaagggaacactgggcgacgcgactcggtttaatcctcgcgatggcggggaacgcggtaggacttggtaatttcctcagatttcccgttcaagctgcggaaaacggtggcggggctttcatgatcccatacataatagccttcctcctcgtgggtattcctcttatgtggatagagtgggctatgggaagatacgggggagctcagggacacggaaccacaccagctattttttacctcctctggagaaacaggtttgctaaaattcttggagttttcggactctggatacctctggtggtagccatatactacgtttacatagagagctggacactaggttttgcgataaagtttttggtagggttagttccagaacctccgccaaacgccacggatcccgattccattctcagaccctttaaagaatttctgtactcctacatcggagttcctaaaggagatgagccgattttgaaaccttcactttttgcgtacatagtctttttaataactatgttcattaacgtttccattctcataaggggtatatccaagggtatagagaggtttgcaaaaatagctatgcccacgctctttatcctcgcggtttttctggtcatcagggtctttttactggaaacccccaacggcaccgcggcggacggacttaacttcctttggactcccgactttgagaaattaaaggacccgggcgtctggatagcggctgtaggacaaatattcttcaccctgagtcttggttttggagctataatcacttacgcctcttacgtgagaaaggatcaggacattgtcctcagcggacttacggcggcgacgttgaacgaaaaggctgaggtaatactgggtggttctatttccatacccgctgcggttgctttcttcggagttgcaaatgcggttgcgattgcaaaggcgggagcctttaacctcggttttataaccctacccgccatattctcccaaacggccggaggaacctttttaggatttctgtggttcttcctcctcttcttcgcaggactcacttcttcaatagctataatgcaaccgatgatagccttcttagaggacgaactaaagcttagcagaaaacacgctgttctctggaccgcggctatagttttcttcagtgcacaccttgtgatgttcttaaacaagtcccttgacgagatggacttctgggcgggaacgataggggttgttttctttggtctcacagagctcataatcttcttctggattttcggagcggataaagcttgggaggagataaacaggggcggaattattaaagttcccagaatttattattacgtaatgaggtatataacccccgctttcctcgcggtgctcctcgttgtgtgggcacgggagtacataccgaagatcatggaagagacccactggaccgtgtggataacacgcttttacataatagggcttttcctcttcctcactttcctcgttttcttagctgaacggagaagaaaccatgagagtgcttaa

SEQ ID NO: 23845 - DNA, 1065 bp, Aquifex aeolicus
atgataccccagaggattaaggaacttgaagcttacaagacggaggtcactcccgcctccgtcaggctttcctctaacgaattcccctacgactttcccgaggagataaaacaaagggccttagaagaattaaaaaaggttcccttgaacaaatacccagaccccgaagcgaaagagttaaaagcggttcttgcggattttttcggcgttaaggaagaaaatttagttctcggtaacggttcggacgaactcatatactacctctcaatagctataggtgaactttacatacccgtttacatacctgttcccacctttcccatgtacgagataagtgcgaaagttctcggaagacccctcgtaaaggttcaactggacgaaaactttgatatagacttagaaagaagtattgaattaatagagaaagaaaaacccgttctcgggtactttgcttacccaaacaaccccacgggaaacctcttttccaggggaaagattgaggagataagaaacaggggtgttttctgtgtaatagacgaagcctactatcattactccggagaaacctttctggaagacgcgctcaaaagggaagatacggtagttttgaggacactttcaaaaatcggtatggcgagtttaagggtagggattttaatagggaagggggaaatcgtctcagaaattaacaaggtgagactccccttcaacgtgacctacccctctcaggtgatggcaaaagttctcctcacggagggaagagaattcctaatggaaaagatacaggaggttgtaaaagagcgagaaaggatgtacgacgaaatgaagaaaatagaaggagttgaggtttttccgagtaaggctaacttcttgcttttcagaacgccttaccccgcccacgaggtttatcaggagctactgaaaagggatgtcctcgtcaggaacgtatcttacatggaaggactccaaaagtgcctcagggtaagcgtagggaaaccggaagaaaacaacaagtttctggaagcactggaggagagtataaaatccctttcaagctctctttaa

SEQ ID NO: 23846 - DNA, 1674 bp, Aquifex aeolicus
atgcctaaaaggacggacatcaagaagatattaataataggctctgggcctatcgttattggacaggctgcagaattcgactactcgggaacccaagcctgcaaagccctaaagcaggaaggatacgaagtcattctcgtgaactcaaatcccgcaacgattatgaccgacccagaaatggccgacaagacctatatagaaccccttaccgctgacatacttgaagagattataaagaaagaaaggcctgacgccctccttcccacgctcggaggtcaaacgggcctaaacttggcggtggaactgtacgagaacggtgttcttgaacgctacggagttgagctaataggtgcgaactacgaggccataaaaaagggagaagacagagaactctttaaagaaactatggaaagtatagggctgaaggttccggaaagtgctgtcgttcgctctgtagaagaaggactgaaggctgtagagaagataggttttcccgtgatactgagacctgcttttactctgggagggaccggaagctcggttgcctacaacgttgaggagtttaaagagaagttaaaggttgcccttgagacttcccccattcacgaggttttgctggacaagtccctgatcggctggaaggagatagagtttgaagttgtaagagacaaggcggacaatgtcattatcgtttgtgctatagagaactttgatcccatgggtgttcacacgggtgactccataaccgtagccccaacacagaccttgacggacaaagagtaccagatgctcagggacgcggccattgcggtaataagggcgataggtgtggatacgggaggttctaacatacagtttgccctctcacccgagagcggagacttttacgttattgagatgaacccgagagtttcacgctcttcagctctagcgtcaaaagcaacgggtttcccaatagcaaaagtcgcggcaaagcttgcggtgggctacaccttggacgaacttaaaaacgacattacgaagttcaccccagcctcctttgaaccttctatagactacgtagttgtaaagattccgaggtttgactttgcaaagttccccgaagcggacagaaccctcaccactatgatgaagtccgtaggggaagtaatggctataggaagaactttcaaggaagcactcctaaaggctgtaaggagtttagaactcgacaggtacggcctagctttcccgaaactcacgaacgttgataaggtagaactcgaaaggaatttaattaacccaaacgaccagagactctggtacatagctgaagccttcaggagagggtattccgtagacgaagtttacgaactcaccaagatagacagatggttcctttataacatagaagagatagtaaagtttgaggaagttctccggaaggaagaacttacccctgaaatcctcagacaagcaaaggaaatgggctactccgactgggagatagcaaaaataaagggaattacggaagaagaagtcaggaagctcagaaaggaagagggtatagtccccacattcaagggtgttgacacctgcgcgggagaattcgtggcgtatacaccctactactattcctcctatgagagaccttactacactgtagacgggcaggaaatccttgatgaagattaa

SEQ ID NO: 23847 - DNA, 1533 bp, Aquifex aeolicus
atggcagaagaaaagtccgaagtacttttaaaaatccaagaaaagtattaccctcccaaagaaatagtggagagggcttggattaaagactacgaaaaggtttacgaggaaagcatcaaggatcgcgaaggcttctgggcaaaggtagccgaagaactccactggttcaagaagtgggacaaggttctcgagtggaacttcccatacgccaagtggttcgtaggggcaaagaccaacataacctacaactgcctcgacaggcacgtccagaacggaaagagaaacaaggttgcttacatctacgttgacgagaacgataacgaaaagaagataacctacggagaactcttagaactcgtaaacaggatagcaaacgggctcaaatccttgggagttaagaaaggagacagagtttccatatacatgccaacaaccatagaagcgatagctacgatgctcgcttgtgcgaggataggggctattcacagcgtagtatttgccggattctccgaaggagctctcagaacgaggattgaagacgcaaaggcaaaggtcgtggtcaccgcaagctacactcaaaggagaggaaagaaaatagaccttctcacaaccgttgagagggctatagacggactggacttcgttgagaaagtagtggtgtgggacagggacggagacgccctggaggaaaagggcggactctttgtagacttcaacgaaatggttaagaacgcttctcccgagtgcgaacccgaagttatggacgctgaagacccactctttatcctctacacttcaggaaccacaggaaagccgaagggagttctccacaccacgggtggttacatggttcagacctactacacttcaaagatagtctttgaccttcacgaagacgacatatactggtgtaccgcggacataggttggatcacgggacactcttacatagtctacggaatactcgcaaacggagttacgtccgtgataaccgagggagcacccgattatcccgatccgggaaggtggtggaggtacgtagaaaagtatagagtaaacgtcttctacaccgcacccacagcaataaggatgttcatgaggtacggtgaagagtggcctatgaagtacgatctctcttccctgagaattctcggttcagtaggagaacccataaaccccgaagcttggctctggtattacaaatatatcggaagggagaaatgcgtaatcgttgacacatggtggcaaacggaaacgggagctcacatgataacgacgataccctcttaccctgcaaagcccggaaaggcaggaaagcccttcttcacgatagaacccgaaatcgttgacaaggatggaaacaaggttccccccaataccgttggattcttggtaattaaatctccttggccctcaatgctcaggacgtgctggggtgagcccgagaggtacgaaaagtactggaacaccataaagggtgtgtggagacctagcctcttacgacgaagaagggtacataatgatcctcggtag

SEQ ID NO: 23848 - DNA, 993 bp, Aquifex aeolicus
atgattgtaggaagatttcccagttcaagaccgagaaggctcaggagaaacgaaaacataaggaggctcgtgagggaaacccaccttacccttgacgacctaatataccccatattcgtgaggtggggcgagaacgtagttgaagaagttccctccatgcccggcgtttacaggtacagtgtagacaaggtagttgacgcggtaaaggaagtgagagatttaggaattcctgcgataattctcttcggtattcccgaacataaagatgaagttggttcggacacgtggagtgaagaggggataattcagagagctttgaggaagataaagaaggaagttccggacatatacgtgattacggacgtttgtttttgtgaatacacaactcacggacactgcggagttcttcacgaccacgacgtggaaaacgacctcacccttgaaaacttaaaaaagcaggtggtttcccatgcggaaaacggggcggacatggtggcaccttcgggaatgatggacggaatggtaaaggttataagggaagctctagacgaagctggctttaaacacatacctataatggcatactccgccaaatttgcctccgcttactacggacccttcagggaagccgcggagagtgctcccgcctttggagacaggagaacttatcaaatggatcctgcaaactcaagggaagccctaaaagaggtcctgatggacgttgaagagggtgcagatgtagttatggtaaaacccgccctcgcttacctcgacataatagcgaaggtcaaggaaaacgttctggttcccgtgtgcgcttacaacgtgagcggtgagtactcccttataaaggccgcgggaaaacttgggtggattgacgagaagaaggttatgtgggaaacactcctttccataaagagagcaggagcggatatgataataacttactttgcgaaggacgcggcgagaatgatcattgagggtgaggtatga

SEQ ID NO: 23849 - DNA, 918 bp, Aquifex aeolicus
atggaactcctttctatacagaatctcacgaaagtttacaaagttcccgcgggatttttaagaaagaagaattttttcgccctcaaagaggtttctctctccataaagcaaggagactttctggctatcgtaggagaaagcggttcgggaaagagcaccttgggaaagataatcctgagacttgaaaaacctactaaaggaaaggtttcatttaaaggtaaggacatctttagtatgggaaaggagtatacgaggaaggtttccgctgtatttcaggacccgaggagttcgctcaatcccagaatgaaggtggaggaaatcctcgaagaaccgttaatagttcacagagtaaagggaaggaaagagagagtattaaaggtcctacaaagagttcgcctgagtgaggaactgcttgaaaagagaccgctccagatttcgggaggtcaggctcagagggtggcaatagcgagggctttgattttagaacccgaacttatagtggctgacgagcccaccgcgtctttggacgtatccgttcaggaggaaatattggaactcttcaaggaattaaattcaaaaggtataagctttttctttgtaacccacgacataagagtagtggaaaaggtggcaaacatggtaggcgtgatttacgcgggaatcctcatggaactgggaaagaaagaagaggttcttaaaaatccccttcacccctacacaaagttccttctggagaacgttcccgtgagacacccgaaggacagaaaacccttaaaataccttcaggaggaggaggtgagcattcccgaagaaggatgtcccttctatccgaggtgtcccgaggctatggaagagtgtaaaaaattcataaggaggtcggaggttaatggaagactccttgcctgcaatctatactga

SEQ ID NO: 23850 - DNA, 2571 bp, Aquifex aeolicus
atgtccgttgataaaagcaaagctcttgttctttggctcgatgaagttaccattgaagatatccctatagctggcggtaagaacgcatcgttaggtgagatgataagaaatctctcacctcttggcgtgaaaattccctatggatacgtcgttaccgcaaacgcttactactacttcctcgattacaacaacctgagggacaaaataaggaagattctggaggggttgaacacggacgacctgaaggaccttcagaggaggggacacgaggtaagggaacttataagagggggaacgtttccaccggatttagaagaagctataaaggattattataataagctatcggaaaagtacaaaacccacgccgttgacgttgctgttcgttcttctgcaaccgctgaggaccttccggacgcttcctttgcaggacagcaggaaacttacctgaacgttgttggtgcggaaaatgtcctcgtagctataaagaactgctttgcatccctctttacggacagggccatcgtttacagggaaagattcgggtttgaccactttaaggtaggtatagcggtaggcgttcagaagatggttcgctccgatatgggagcttcaggtgttatgtttacccttgatacggaaacaggttttaaagacgtagtagtaataaacgcagcctacggactcggtgaactcctcgtgaggggagaagtcaccccggacgagtacatagtgttcaaacccaccctaatgaagggatactcagcgataatagaaaagaaactagggagaaaagacaggaagatgatttacggaacgggggacgagagggtaaagatagtaaacgttcccaaggaagaccagaaaaagtttgcactaaacgacgacgaaattctacagctcgcaaagtggggcgtccttatagaagagcactactccaaaaagaacggtagatggacacctatggatattgagtgggcaaaagacgggatactcaacgagctttttgtggttcaggcgagacccgaaactgttcactccagaaagaaggaaaacgtagtgaagatttacaagataaaaacccctgaagaggaaaggaagaacagggtaatagtaaaggggatagccgtaggagacaagatagcaaccggaaaggcgagggttctttttgacttaaaagaggcggaccagttccaggaaggtgagatactcgtcacggacatcacggacccggactgggaacccgtaatgaagaaagctgcggctatagtaactaacagaggaggaaggacttctcacgcggcgatagtcgcaagggaactgggaattcctgcagttgtgggaacgggaaacgcaaccgaaaagataaaaacgggagaagaaataaccgtatcctgcgcagaaggtgaaacgggatacgtctacgaaggtaagatagactatgaagtagaagagataaaccttgaaaacattccaaagccaaaaacaaagataatgatgaacataggaaatcccgagtccgccttcaggtacgcatcactgccaaacgacggggtgggattggcaagggaagaattcataatagcaaactacataaagatacacccccttgcactgctccactacgaggacctcaaagaactctacgagaaactggagagggaaaacctaatagacgaaaaaggctttgtccagtttaaactcatttaccactacgcaaacggaaggcttgcaaataaactcgcaaagggcaaagacaaactcagggttaacttgaggaagatacttcaggacatagaaaacctgaccttcggttacgaggacaaggcgacctactacataaagaaactctcttacggtatagcgaaaatagcggctgctttttacccaaatcctgtaatagtgagattttccgacttcaagtctaacgagtacgcaaaccttatcggcggaattctctttgaacctgaagaagagaacccaatgctcggttggaggggagcgtcaaggtattactctgacgtctttaaggaagccttcggaatggagtgcaaggcgattatcagagttaggaacaagatgggactcaccaacacaaaagttatgatacccttctgcaggacacccgaggaaggagaaaaggtccttcaggtaatggaagagtatggactcagaaaaggggaaaatggactggaagtttacgttatggcagaacttcccagcaacattgtccttgctgacagatacgctcagatatttgacggtttctctataggttctaacgacctcactcagctcactttgggactggacagggattctgaactcgtggcacacctctacgacgaaaggaacgaggctgtaaaaaggctcatcgctcaactcataaaaacagcaaaggagtacggcaggaaagtgggaatatgcggtcaggctccttcggactttccggaattcgctcagtttctcgttgaacagggaatagacagtatatccctcaacccagactccgtactcaagaccatgctcgcggtagtagaaatggagaaaaaactcggagtccttaaatga

SEQ ID NO: 23851 - DNA, 1539 bp, Aquifex aeolicus
atggaaaacatcgagatagtttcctcgggaaaacacacacttcacggattgaacttttacctttcttacttcgacgacgtcgcaaaagtccttccaagagaacattactgctttatagtcggcggatgggtaagagacaggatattgggagaacccgtgggttacaacatagacgttgactttttaacaactgcagaccccgtggaactcgctaagaattttgcaaaaagaattggaggacactttttcgtatttgagaaaaggggattcttaataaagagacccacgatagcaagcgttgttcttcaccttcctccctacaggtacaggtttgacttttccccgctgaagggaaaagaccttgaaaaggcgctcatagaggatttaaaggagagggactttaccgcaaacgcgatagctgttaacctcgacgacgttctgagtataggtgcaaaacaaactatagtgtacgaccctacgggtgggataaaagatctggagcaagggcttctcagacccgtgtccatagaaaacctaaagagagaccccgttcgggttttgagaggcttcaggatagcgattgagaaaaatttacagctcacggaagacttttatgaattcgtaaaggaagatccgagaatagttttaaagtccgcggttgagagaataacccatgaacttttcaagataatgaaggaaaaaaccgcacacaaggttataagggaactctacgagtacggcgttctcgaggcaataattcctgagataggcaggttaagggaggtaaaggatcagggagagcaccacatatacccgcttgatgaacataccctaaagactttagagtacttggaacaagtaatagaggatcgtgcaaagtacctgagtgcggaacttcttgaaaactttggaaaaaagagagttctgggagagtttaccgatgttgaactcctcaagtggggagcactttttcacgatataggaaaacctcaaacttttgctgtaagggagggaaaggtaaccttttacgaacatgataaagtaggggcacaaatagtaagagagataggcgagaggttaaggtggggagacgaagcgacggagtttgttgcaaaactcgtaagacatcacttaagaccctttttcttgagggaagctttcaagaaaggagagctcaagaggaggggaatggccaacttctggagggaatgcggtgatatagctccacaccttttcctcctctctattgcagacgctatggcaagcggggatgaagaggaggacataaaggctcttatggagacgatagcggaacttgaaagctttaacagaaacgagatgaaggaagaaattcagaaacccctcctgaacggcgatgaaatcatggaaattttagggattaagcccggaaagatagtaggtattttaaagaaagcactccttgaggcccaaatagacggaaaagtagagacgaaagaagaagctatagaattcattaaacgaagtacgaagaacttaaaacctcttgatgaaggatga

SEQ ID NO: 23852 - DNA, 507 bp, Aquifex aeolicus
atgaggatttaccttataggctttatgtgctccgggaaaagcacagttggttccctcctctcccgctctttaaacattcccttctatgacgttgacgaagaggtgcagaaaagggaaggactttcaatcccccaaatctttgaaaagaaaggggaagcttacttcagaaagcttgagtttgaagtcttaaaggatttatccgaaaaagaaaacgtagtcatttccacgggaggaggactcggggcaaacgaagaagcattaaactttatgaagagtagaggcacaaccgttttcatagatatcccctttgaggttttccttgaaaggtgtaaggactcaaaggagagaccccttttaaagagacctctcgatgagataaaaaacttatttgaagagaggagaaagatttattcaaaggcggacataaaggtgaagggggaaaaaccccccgaagaggttgtaaaggaaattttattatcccttgaagggaacgcccttggtgggtga

SEQ ID NO: 23853 - DNA, 369 bp, Aquifex aeolicus
atgaaattaagacccctttacgacaaaatagttgttgaaaggcttgaagaaaaggaagagaaaactccttctggtatcatcatccccgatactgcaaaggaaaagcctcagctcggtaaggttgtagctgtaggtcctggaaagcttttagacaacggagaacttaagcctttatctgttaaggaaggtgacgtagttctctttaacaagtacgctggtaacgaagtagagattgaaggaaagatttacctcgttatgtctgaagacgaagttttagctgttgttgaagattattcaagcttaataggaggtgaggtgagatggcagcaaaggcaattatctacaacgaggaagcaagggcaaaactaa

SEQ ID NO: 23854 - DNA, 1638 bp, Aquifex aeolicus
atggcagcaaaggcaattatctacaacgaggaagcaagggcaaaactaaaggctggtgttgataaactcgcaaacgcagttaaggttaccttaggtccaaaaggtagggaagttatcttaggaaagaactggggaactcccgttgtaaccaaggacggtgttacggtagctaaggaaattgaactcaaggacaagtttgaaaatatcggagctcaactcgtaaaagaagttgcttccaagaccgcggacgtagcaggtgacggaactaccaccgcaacggtactcgcacaggcaatattccacgaaggactcagggttgcagcaagcggtgcaaacgtaatggaagtaaagaggggaattgacaaggccgtaaagaaaattgttgaagaactcaagaaactctccaaggacgtaaaggaaaggaaggaaatagaacaggtagctaccatatccgctaacaacgatcccgaaatcggaaagataatagcggacgctatggaagaagttggaaaggacggggttataactgttgaagaaagcaagtccgcggaaaccaccctcgaagtagttaagggaatgcagtttgacagaggatacctatctccgtactttgtaacagatcctgagaagatggaatgcgtactagaaaatccctacatactcatatacgaaaagaagataaccaacgtaaaggaacttcttccaatacttgaacaagtagtaagaagcggaagaccacttctggttatagctgaagacgtagaaggtgaagcactcgcaacactcgttgtaaaccacatcaaaggagtactcaaggcttgtgcagtaaaggctcccggattcggacaaaggagaaaggactacctcggagatattgcagttctcacaggcggacaggctataactgaagacctcggaattaagcttgaaagcgtaacacttgacatgctcggacaggctgaaaaggtagtggttgataaagaacacaccaccataataggcggtaagggagatcccgaacaaataaaggcaaggatagaacaaataaagagacaaattcaggaaacaacctctgactacgacagggaaaagctacaagaaagactcgctaaactctcaggtggagttgcaataataagggtaggtgctgcaaccgaagctgaactcaaagagaagaagtacagagttgaagacgcggtacacgcaaccaaggctgcagtagaagaaggaatagttcccggtggtggagtagcacttgtgagggcatccgaagcacttgaagacctcaaaggtgacaaccacgatcaacaactcggaatagacataatcaagaaggctgtaaggacacccctcaagcaaatagcttacaacgcaggatacgacggatccgtagtactcgaaaaggtgattgaactcggaaaggaaaaaggtgtaagctggggattcaacgcggcaaccggagagtacgttgacatgtacgaagccggaataatagatccgaccaaagtcgtaagaaccgctatagaaaacgcggcatccgtagcaggaacgatgctcaccgctgaagcactgatagcagaccttcccgaagaaaagaagaaagacataactcccactgacatgcctgaacttgactaa

SEQ ID NO: 23855 - DNA, 1260 bp, Aquifex aeolicus
atgagaaactttctctttttactccttgtaatctccctaccacttttcggagggcaaaggattatggataagacgctagaaaacggcgtaaaggtaataataaaagagacaaaaggaaggggactggtttccggggttattttcttcaaagggggcgttcacggagaggaaaagaggggagaaacacagctcctctttactatgctcttaaaaggttcaaagaattaccccaatgcatctgcagtttcgtacccctttgaaaagtacgggggatacatatactcctcttccgaagacgacttttcggaaatcggtttttccactaaagttgaaggactaaaagagggtctgaaggtaattagagatataattcagaacccactctttaaagaagaggttctggaactcgaaaagagaaaccagatagtcgctataaggtcaaagagggagaggggaatgtcttacgcatacgaagaactgcgaacactgacttacaaaggaacaccctacgaatactcctcactgggaaaagatgaagatgtagaaagagttagcagggaggatttaataagacgctttaatcaaattaaaaagggagaaaatgtcgtagtagtccttgtcggagactttaaagctgaagatgtcctacccctcttggaagaagctttttcggatattccgaagggaaagtttgaactttcaagtgttaacaaaaagattgagaaaaatgaagtaaaaagggtaaagagggaagggacgcaggccacgatactttgtgctttcaacgcaccgcctaaagactcaaaggattacttcgttttcaaggtttacaacgcggttctcggagaaggaatgacttcaaagctatttaaggtcttgagggaagaaaagggatatgcttacgctacttactccttttatcccacaaggtactcgtctcccagacttttcgcatacgtcggcacttctcccgaaaagaaggaaaacgcccttcaggatttaatcaaagtagtttccgagggaagggtaagtgaagaggacgttgaactggcaaagaggaaaataataggcgactttctcctggatcatcaaacaaggttaaggcaagcctggtatttgggcttttttgaagttatggggctcggctggaaaatggacgaggagtacacgaagcgtataagtgaagtaaagagggaggaagttgaagaagcggtcagaaaatacatagactttcaccactgtgtagtcgtagaaccttag

SEQ ID NO: 23856 - DNA, 1299 bp, Xenorhabdus nematophilus
atgtccaaaatcgttaaagtacttggccgtgaaatcatcgattcccgtggtaacccaacggtagaagcggaagtacatctggaaggtggctttgttggtctggctgctgcgccatcaggtgcatcaacaggttctcgcgaagcactggaactgcgtgatggtgacaaatctcgcttcatgggtaaaggtgtactgaaagcgctttctgcggttaatggctcaatcgctcaggctctggttggtcaggatgcgaaagatcaggctaacatcgacaaaatcatgatcgagctggatggtactgaaaacaaatctaacttcggtgctaatgcgattctggctgtttcccttgcgaacgctaaagcggcagcagcggcaaaaggcatgcctctgtacgagcacattgctgagttgaacggtacgccaggcaggttctccatgccactgccaatgatgaacatcatcaacgggggtgagcacgctgacaacaacgtggatattcaggaattcatgatccagccaattggtgccagcacgctgaaagaagcggtacgcattggttcagaagttttccacaatctggcaaaagtgctgaaagcaaaaggcatgagtacggcggttggggatgaagggggctatgcgccaaatctggaatctaacgcagcagcgctggccgcgatcaaagaagccgttgaacaagcgggttatgtgctgggtaaagatattactctggcgatggattgcgcagcttctgaattctataacaaagaaacgggcaactatgaactgaaaggcgaaggcaggacgttcacttctcaggaatttacccactatctggaaggcctgaccaaagaatatccaatcgtttctatcgaagatggtttggatgaatctgattgggatggttttgcttaccagactaaagttatgggcgacaaaatccagttggttggtgacgatttgttcgtaaccaataccaagatcctgaaagaaggtatcgaaaaaggcatcgcaaactccatcctgatcaaattcaaccagattggttctctgactgaaactctggctgcaatcaagatggcaaaagatgcgggctacactgcggtgatttctcatcgttctggtgaaaccgaagatgcgactattgctgacttagctgtcggtactgcggcaggtcaaattaagacgggttctatgagccgttctgaccgtgttgctaaatataaccagctgatccgtatcgaagaagcactgggtaaccgtgcgactttcaatggtctgaaagaagtgaaaggtcaggca

SEQ ID NO: 23857 - DNA, 1278 bp, Xenorhabdus nematophilus
atgaaccagtccgaaatgctttactctcaggcaaaacaggtgatccccggcggtgtcaactcgccggtacgcgcctttaatggcgttggtggtacgcctgtctttatccaacgcgccgatggtgcttacctttacgatgttgatggcaatgcctatatcgattatgtcggctcatgggggccaatggtactggggcacaatcaccctgccattcgcaacgccgtgattgaagccgccgagcgtggcctgagctttggtgcaccaacggctgccgaagtggaaatggcaaaacgagtgacagagttggtgccttccatggatatggttcgcatggtgaactccggtacagaagccaccatgagtgccattcgtctggcgcgtggttataccgggcgcgataagatcatcaaatttgaaggctgctatcacggccacgccgactgtctgctggtcaaagcgggttccggtgccttgactataggccagcccaattctccgggcgttcctgccgatttcgccaaacataccctgacctgcgtctataatgacctgaattccgtgcgtgaagccttcgaaaaatacccagaagagatcgcctgtatcatcgtagaacccgtcgccggtaacatgaattgtattcctccacgaccagaatttctgccgggtctgcgtaagctgtgtgatgaattcggtgcgttactgatcattgatgaagtgatgaccgggttccgtgtcgctttgggcggcgcacaagagtattacaacgttaaaccggatctgacgtccctcggcaaaatcatcggtggcggtatgccagtgggtgcatttggcggccgtcaggacatcatggaaaaactggcaccaaccggcccggtttatcaggcgggaaccctctcaggtaacccaatcgccatggctgcgggtctggcttgcctgaatgaagtcgcccaacccggcgttcacccgcgtttgagcgaactgacagacaaattagcttctggcctgaaaaacgcggcatcagcagcaggcgttcctctggtggttaaccacgttggcgggatgttcggtattttctttaccgacgcagaaagcgtgacttgctatcaggatgtcatggcgtgtgatgttgaacgcttcaagcaattcttccacttgatgctggatgagggcgtctatctggctccttctgcgtttgaagcaggctttatgtccatcgcccattcagatgaagatattcagcgtaccgttgatgccgctgcccgctgttttgccagactg

SEQ ID NO: 23858 - DNA, 2454 bp, Xenorhabdus nematophilus
ttaccaatttatgacgttttggactctgttataactaagttgaaaacgtcgaaacaggtattgttgcatgcacccacaggggcaggaaaatcgaccggattgccattggcgatcctgaataaagctcaactgacagggcgcattattatgctggaacctcggcgccttgcagcgcgcagtgtcgcagagcgtcttgccgaacaattgaatgagcctgttggcgtgacggtaggttatcggatgagggcggaaaccaaagtcagtgcctctacacgccttgaagttgtcactgagggtattttgacccgaatgctacaacaagatcctgaattaagcgatgtttctctggttattcttgatgaattccatgagcggagtttacaggccgatctcgcgttggcgctgttgctggatgtacaggaaggtctgcgtgaagatctgcgtattctggtgatgtccgcgacactggacaatcaacgtctttcttctttattacctgatgcgcccgtgattgtttcagaaggtcgtcgctatccggtagcacgatcttatcatccgttgccgattcatcagcattttgaacaatcagtggcttcggcagtgttgcgtttattgcagcaggaaacgggatcattgttactgtttctgcccggcgcgggtgaaatccagcgtgtgttggcgcaacttgaacaaaaaatcaacgacgatactttattgtgcccactgtacggcgcgttgtcgttatccgatcaacggaaggcaatagcacccgcgccagcaggaatgcgcaaggtcgtgctggccaccaatattgcggaaaccagcctgacgattgaaggtatccggttggtggtggatagcggtcttgaacgtaccagccgctttgagccgaagagtggcctgacccgactgatgacccaacgtatcagccaggcgtcaatggtacaacgggctgggcgggcaggaaggctggaagaaggtgtctgctggcatttattcagtcgcgagcaggcggaacgagccacggaatacagtgagccggaaattctgcattcagatctgagcagcctgctactttcactattacagtggggatgtcgtgacagtaatcagttgaactggctggacagtccaccacagcccgcgcttgcagtggctcaatcgctgctgctgcgattggggacgctggatgataatcaacaattgactgcccgtggctggcaaatggcggaagcgggcagtgaaccgcgtctggcggctatgttatgtgcaggcaaagagcagagtgatgaggcgctggtaacggcagcaaaactggtagcgatcttggaagagcctccccgcagtggactgccggatctcactcattggataaattcaaaccaacctcattggcagcagcgcactaatcagcttatcaggaatcttgcgagcaagactgcaaaaataggatctaaaaaaatcagcacagaaaagattaatgctgcatttgtacccgaactattagtacagggatttcctgatcggattgctaaaaaccgtgataatcttgggcgttttcagatagccaatggtttgggtgtggcactggaaccgggtgatccgctgtcaggagagcagtggctgatagcgcctacattgcagcaaaacagtaaaaaccccgatgccagagtcttgctcgcttgcccgctgaacatcgaacacattattcatcaatatccgagcctgtttacagaacagacagccgtagagtgggatgatagtaagggcactctgcgagcatggaaacgtctgcaatgcgggcgtttgactgtcaaagcgcagcttttagcaaaaccttctcaggcggaattacaggaatccctgctgaactggattcgacaggaaggattggcggcgttgaattggtcgccggaagcattgcagttgcgcatccggctgcaaagggcaacagaatggctatctgaaattgagtggcctgcggtggatgatgacaatctgctggattccctcgagcaatggtttctgcctatgttggcgggagtgggggatttgaagggattacgtcaggttgagctgtcgtgtgctcttttggctctgcttgattggcagcaacggcaaatactggataatgaattgcctactaattacactgtgccgaccggaagtaggattaccatccaatatttccacgataaaccgcccttgctgtcagtcagaatgcaagaaatgtatggagaacagcagaatccggtattggcgaaggggcgggttcctgtggtcgttgaactgttatctccggcgcatcgtccactacagattacacaagatctcgcggcattctggcagggggcttatcgtgaggtgcaaaaagagatgaagggacgttatcccaaacatttatggccagacgatcctgctaacacagcgccgacaaggcgtgtaaaaaaatat

SEQ ID NO: 23859 - DNA, 690 bp, Xenorhabdus nematophilus
atggcttatgcattggaattgactcagcttacgaaaacctatgcaggtggtgtgaaggcgttgcgtgggattgatttacgtgtcgaagaaggcgatttctacgccctgttgggaccgaatggtgcagggaaatcgactactattggtatcattagttctttagtcaataagagcagcggtaagatcaaagtgtttggttacgatattgacacggatctcgtcaatgctaaacggcaactggggcttgttccgcaggagtttaatttcaacccatttgaaactgtgattcagattgtactgaatcaggcgggatattacggcgtaccccgcaatgtagcgtatagcagagcagaaacctatctgtcccaactggatctatgggaaaaacgtaacgaacgggcgaatcggctgtcaggaggaatgaagcgccgcctgatgattgtccgtgctctgatgcaccagccgaagttgctgatccttgatgagccgacggcgggggtcgatattgaactgagacgctccatgtgggagtttctgaaggctttgaatgcgcagggaaccaccatcatcttgactactcactatctggaagaggctgaaatgctttgccgtaatatcggcattattcaatatggcgaactggtggaaaataccagtatgaaagatctactcagccaattagaacgcgaa

SEQ ID NO: 23860 - DNA, 531 bp, Xenorhabdus nematophilus
aaacatattgtagaagtgatgatctccgaacaagagattaaacaacgtattgctgaattggggcaacagattacagaacactatcgcaatagcgaccgtgaactggtgctggttggtttgttgagggggtcatttatcttcatggcagacctgtgccgtgaagttcaggttccccacgaagtggattttatgactgcgtccagttatggcaatgagatgaactctacccgcgatgtgaaaatccttaaggatttggatgaagatattcgtggcaaagatgtgttgatcgttgaagatattatcgactcaggcaatacactgaataagatccgtgagatttttgcgctccgtgaaccgaattctctggcgatttgtacgttactgaataaaccctcccgccgtgaagtcgatgtgccggttgagtggattggctattcgattgaagacaaattcgtggtcggttatggcattgattatgctcagcattaccgccacttgccttacattgggcatgttactctgctggaagag

SEQ ID NO: 23861 - DNA, 2244 bp, Xenorhabdus nematophilus
atgctcatgcgcttacgggaaattgtcgaaaaggttgccatggcagctaatttgtctgaagcgcttgaactattggttaatgaaacctgtctggcaatgagcacggatgtctgttctatctatctggcagatcatcagcggcattgctattacttgatggctacccgaggcttaaagaagccagaggaacgagcgatcagcctggcctttgatgaaggtgtcgttggtgtagtcgggcgtttatctgaattaatcaacctcgccgatgtgcgagatcaccccagttttaaatatatcccccaagtaaaagaagaaggtctgcgggcttttttgggcgtaccgattgtttatcgtcgtcagttgcaaggtgtactggttgttcaacaaaatgaacggcggctattcgatgaaagtgaagagtcttttatggtcacgctggccatgcaattggcggttattctcgctcaggcacaaacaaaagggctatttggtcagtatcgtcagacacgcattaaggcgcttgccatttccagtggtatcgtcatggctcagggttggcaagatggttctcagccatcacttgaacaagtttttgaagcgtccacgctggaatatcaggcagaacgttctcggctgaccgaagcccttgagcaggcaaccgccgaatgtcgccgtatcagtaagcgttttacctccagctcacagaaagaaagtgccgctatttttgacctctattctcatttgctgaatgatcccaaactcaagcaggatctgtttttttccgtcgataacgggtttgtggcggagtgggcagttaaaagcgttgtcgaaaaatatgccgaacagtttgccagcttgcaagatccctatatgcgggagagagcttctgatttgcgggcgcttgggcagcgggtattgttccatctggatggttctttcacaggtgatagcgaatggccagagcgctttattctggttgccgatgaactcagtgccaatttactggctgaaatgccgcaggaacaactggctggtgtgattgtacgggatggtgcaactcactctcattccgcaatactggttcgggcgatgggaataccggctatcatgggagccgatatccagcctgaattactgcataatcggatgctaatccttgacggttatcgcggcgagttttttgttgaaccagaaccactgattattcaggaataccgacagattattgaagaagagcaggttctcagcgaattagccgagggggagctgaaacaaaaagcacaactcaaaaatggtgaaagagtgctggtgcagctcaacgcaggattaagcttaaaatacgagcaacagataggtggtagtattgatggtataggcctgtatcgtactgaaatcccttttatgctgcaccgtggttttccatcagaagatgagcagaaaaaccgttatcaagagatgttggcgcttctcccagataaaccggtggtactacgaacattggatattggtgccgataaacaactgccttatatgcccatcagtgaagaaaacccctgtcttggctggcgaggaattcgtatcacgctggatcagccggaaatattcctgattcagctcagagcgatgttgaaagccaatgtgctgattggtaacctgaaaatattgctgccgatgatcaccagtatcgaagaaattgatgaagccagaaagttgatcgatagggcgaaagctgaagttgaacagacaatcggcagtacgattaccatgccccagattggcattatggttgaagtaccctccaccattttcttgttgccgcagttgaagaaacggattaattttatctctattggcacgaatgacttaacccagtacctgcttgcagtggatcgcaataatacacacgttgccgctttgtatgacaatttgcaccctgcggtcattaaggccttgaaactggcttttgatgagagccagcgtgttggtcttcccgtgagtatatgtggagaaatggcgggtttgccgatgggagcgttaatcttaattggccttggttaccgtagcctgagcatgagtggccgaagcgttccacgcataaaatatttactgcgtcatttggataccaacgatcttgagctgcttatcaaagaaatattgaaagcagaaaccagccggcaggtgaaagccctgtctactgagtttatggaggccaatggtctcggtggtttggtgcggggggggatt

SEQ ID NO: 23862 - DNA, 1047 bp, Xenorhabdus nematophilus
atgaaaattatcggaatttcaggtttattaccgtcaagatgcgtaactaatggtgatgtacttaatttaatagagcagcattcaaaaaaaactttccagggtgattttcccaaaacactaagaacaattcaacggttactggaaaaaacaggacttgaaagcagatattggctgggtgaaggtgaaaaaccgatgcgtctgatggaagaagcttttgaacaggctttgagacaggcgaatatcaaaaaatctgaaattgatctattgatttaccctaacgtaactcgtggtttcactgagcctgcaaacagtacttttattgcaaaagctttaggattgaattgccggaattatgatgttcttgatgcttgtaatggttgggtaacggcaatggatattattaatggtaaaatgaaagcgggtgaaatacgttatgcggctattattaatatggaatttggcatgtctgaaggcggtccattcagaaagaatttttctttgaattctgcttctgaattggcctataaatatcctagttttacaataggtgaagcggcttctgtaaccatattgagtaatgaagatacagataattttaaatttgattatatcagcagacccgatttatgtgacatatgtaatatctctttacctaattgggaattgttttgcaatgatagtgatattgagcttatttcccctctgggaggtaaatatcagttcaattcatatgccgcagcactccatgaatatgcaggagaagaagtgcccaaggtattcaaacagcataatattgccagtagtgatatccataagattttcattcatacaggtgcaccaaatatgtgggatggctttggtaaagccgtcgatgccgccgataaaatgcacaatatcggccagaaaaccggtaacattattactgcttctattccttttggcatcgctgatgctcttgggaaagatcaggtcgaaagagataaactttgcatgggatgggcaggcagtggtggaatggtattttccgcgatgtcgtttaaattataa

SEQ ID NO: 23863 - DNA, 2868 bp, Xenorhabdus nematophilus
atgcctaaatatattattcgcatcatgacgatgctttttctgctcttttggggaaccacagcgtatgcaaagttgccttggcagcctttgcctgaaactattaataaaagtgaacgagatcttcgtcaatataaagccatccaattacccaatggcatgacggttttactggtttctgatgagaaggccattaaatcattggctgccatttcagttccggttggccatatggaaaatcctgataaccagcttggtctggctcattatttggagcatatggtgctcatgggctccaagcgataccctcaatctggggggttcaccgagtttttgcagaagcacggtggaagtcacaatgccagcacttcaagcaatcgtaccgcattttatctggaagttgagaatggttcactgacagaagcgacagaacgccttagcgatgctcttgctgaaccgcttcttgatccggttaacgccgatcgtgagcgtcatgccattgataacgaaatgaccattgcccgtgctggtgagggtcatcgcatatggcaggtccgctctgaaacgctcaatcctgcgcatcccaatgcccgttttggtggtggaaaccttgaaacgctgaaagataagcccgacagtaaattacaggccgcactcattgatttttaccagcgctattactctgccaatctgatgaaaggggtgttgtatggtcagcaaccgatcgacaaactggctcatattgcggtagaaacctttggccggattccgaacagacaggcttcagtccccgctattacggttccggcgataacggataaagaaaaaggcatcattatccattatgtgccttcgaagccttacaaatcgttacaactggaattcagcattgctgacaacagcgcggattttcgcagtaaaacagatgcctatctgggatatctgattggtaatcgtagtgcgaacacgctgtctgactggctgcaaaaacagggattggctgagggcatcagtgccagcgccagcccgacgacagatggtaactcaggaacgtttggcatttatgtctcattaacggacaaagggcttgagcagcgtgatcgggttattgcggccatcttctcttacattaatctgttaaagcaaaagggcattgaaaagagctattttgatgaaatggctaaagtgctcaatttatcattcgagtatgcgtcaatcgtgcggaatatgggctacattcagtggttgtctgatgttatgcaggatatccctgtttcccatgtactggacgccggctatcttgcggacgaatacaacccacaagctatcttcagccgtctggctgaactgacacctgaaaatgcgcgtatttggtttactggcccgaaagagccacataacaaggaagcttactttgttcatgcgccctatcaggtcaataaaatcacaccacaacagcggacggaatggcggaaactcgaaaaagaggtttcgctctccttgccagaactgaatccgtatattcctgatgatttatctttgattaaggcatcaggcagtcaaaaacaccctaaaatgattttagagcagccaaatgttcgtttgctctatatgcagagccaatattttatggatgaacccaagtccatcatcacattgaatatgcgtaatgcggatggaatgagtcatgccaaagatcaggttacttattcgttattggcctatttgagtgatatgggattggatcagctgggctatcaggcatctgtaggtggcatgggattaacattagggtattcagaaggcctgcaaattggggtgagtggttatactcagcacttgtctgaactgttaacttcggccatcagccagtacattgcgttcacacccactcaggaagagctgaatcaggcaaaatcgcgctatcgtgaccaagtggaagccgtcaataatggcaaggcttatgaaatggcgacacaccccgtctcccgtctttctcgtgtgccttattttgagcagactgaccgtttgaaagctttggataccatcacgattgacgatattgttaaataccgtcagagaatgattcagcattcggctttacaggcgggaattttcggtaatttaacagaaaagcagagtatcgatatcgttaagtcggcacataagcaactcgcgaatcaggggactacgtggtggagtggcgaccatatcgtggttgatcgtgattatgcggtgaattttaaaggaactgccagcagtaccgataatgcactgtctgaagtctatattccaacgggatatgaccgaatcaatggttatatttattccaacctgttagggcgtattttgtcaccctggttctttgaacaactcagaacatcggaacaattgggctatgttgcttctgctttcaacaccagcgtgggtgaacaatcgggattgggcttcctgttgcagagtaacagcaagcaacccgattacctgcatcaacgctatcagagcttttatcaacaggccgcaaaaaaattacaggcaatgcctgatgctgattttgaacagtataaaaaagcgttactgacagaaatgcggcagccaccagaaactttttatgcagaagcatcccattataattatgattttgggagtaataacttcaaatttgatacacacgaaaaaaccattgccgctacggagaaagtgactaaggcacaactaattgctttttatgataaagcggtgataaagcgtcaaggattggcactgatttcccaaattaccggtaaaaaaggggcagctcatcaatatgctgagctgaaaggctggaaaacttactctaacgtgtcagatttccagaaacagttgccggtt

SEQ ID NO: 23864 - DNA, 1323 bp, Xenorhabdus nematophilus
atgaaagaacgctgtaccgaattggttgaagttttccggcattcagttccgtatataaatgcacatcaaggcaaaacctttgtcattatgttggacggtgaggctatcgcccacgagaattttccaaatatcgttaatgacatcggcctactgcataatctgggcatccgtttgatcgtcgtgtatggcgctcgtccccaaatcgaccaaaagcttgccgaataccatagccagccaatttatcacaagcacatcagagttacggatgccaagacactggagctggtcaaacagtccgcaggtctgctacagcttgatattacggctcgtctttccatgagcctcagcaatacaccattgcaaggtgccaatattaacgttatcagcggtaactttattatcgcccagccactaggtgtcgatgatggcattgattactgtcatagtggcaggatccgccgtattgacgaggaggccattaaccagcagttggataaccatgccattgtattaattgggcccgtagccgtttccgtcacaggtgagagtttcaacctgacgtccgaagatatagcctcacaattggcgattaaattaaaagccgaaaaattgatcgggttttgctcatcacagggcgtacttgatgcagaggggaatatcctgtcggaaattgttcccaatgagggagaagcacggctaaatgagctgggaagtgagggagattattcttcaggtaccgcccgcttcttaagaggagctatcaaagcctgccgtcgtggggttcgtcgtagccatttgatcagctatcaggaaaatggctcactggttcaggaattattctcccgtgaaggcagtggaacccagatagtcatggagcgctccgaacagatccggcgagccaatatcaatgatattgggggcattcttgagcttattcgtccattggaacagacaggtatcttagttcgccgctcacgggaacaactggaaatggaaattgataagttcactctgatagagcacgataatgtaacgatcgcctgcgctgcgctctattcttaccctgacgaaaaaattggtgaaatggcttgtgttgcggttcatccaaactaccggaactcttcccgaggcgaagtattactgaattccatcgctggtcaggccagacaggcagggctggagaaactattcgtactcacaacccgcagtatccactggtttcaggaaaaaggctttgaacctgctgaaatcaatatgcttcctgtggaaaaacaagcgctgtataactaccagcgctgttcgaaaatcttgatgttaaattta

SEQ ID NO: 23865 - DNA, 624 bp, Xenorhabdus nematophilus
atgctgagtcggtcaatgaaaaatttgctgacccaattacgccagcaaggaatacaggacgagcacttgctggaaattatcgccagagttcctcgggaatgttttgttgatgaagctttggcgcataaagtttatgaaaatacggcattgcctattggacatggacagaccatatcccaaccttacattgttgctcgcatgacaaaactgttgagcttaactcctgaagccaatgtgctggagattggaacgggatctggttaccagacggcgatactcgcccatctggccagacacgttttctccgtggagcgtattaaaggtttgcagtggcaggctaaacgcaggttgaagcagcttgatttacacaacatatcaacccgccacggtgatggttggaatgggtggccgtcaaaagggccatttgatgccattattgtcacggcagcgccgcccgaaattccacaggcactattgtatcaacttgcagataacggagtgatggttctgcctgtgggggagcgctctcagtcgcttaaagtggtgcatcgctatggcagtgattttcacagcgaagtgatcgaacctgtccgttttgttcccctaattcaaggcgaactagca

SEQ ID NO: 23866 - DNA, 2550 bp, Xenorhabdus nematophilus
tcaccagcaaaggatttagacagccatactcccatgatgcagcagtatctgcgcctgaaagcccagcatcctgacattttgctgctttatcggatgggagatttttatgaactgttctttgacgatgccaaaaaagccgctaaattactggatatttctctgaccaaacgcgggcaatccgcaggccagcccattccgatggcgggagttccttatcacgcaatcgaaaactatctggcaaaactagtacagctcggtgaatcagcggcgctctgcgaacaaataggtgatcctgccaccagcaaaggccctgttgaacgcaaagttgtgcgcattgtcactcccggcactgtaaccgatgaagccctgctgcacgaacgtcaggataatctgctggccgctatctggcatgacagccaagggtttggatatgccacgctggatatcacctccggccgtttccgtgtctctgaaatggcagacgaagataccattgccgccgagcttcagcgtacccgccctgcggagttgctctatcccgaaagctttggctccatggcactgattgaacgctgtagtggcctgcgccgtcgcccaatgtgggaatttgaactcgatacagcaaggcagcaactgaatttgcaattcggtacgcgtgacctgatcggttttggggtggaaaaatctacgctagcactgcgtgcggctggctgcctgctgcaatatgtgaaagatacccagcgtaccgccctgccccatatccgcaatattacggtagaacgccagcaagaaacggtcattatggatgctgcaacccgccgcaatctggaattgacccaaaatctggcgggtggtactgaaaacacactggcttctgtactcgatcaatgtgtgacacccatgggcagccgcatgctgaaacgctggctgcataccccgattcgcgacagaaacgtgctgcaaaaccgccaacaagccatttcagctttacaagagattggctttgaattgcagccgtttttacgtcaggttggtgatttagagcgtgtacttggccgtcttgctcttcgttccgcccgtcctcgtgatctggctagaatgcgccacgctttccagcaattgcctgatattcatcagatcatggcatcatctgattcaccttatattcaggcactgcaacagcgtgttggtcattttgatgaattacagacgctactggagaaagccgttgttgaaactcctcctgttctggtacgtgacggcggtgtcattgccccgggttaccatgccgaactggatgagtggcgtgcattagccgatggtgccagtgattatctggacagactggagatccgcgaacgtgacaaactcggccttgatacgctgaaagtcggctttaatgcggtgcacggttactatattcaggtcagccgtggacaaagccatttagtcccgattcattatgtacgccgtcaaacgctgaagaatgcagaacgctatatcattcctgaattgaaggaatatgaagataaggtgctgacttccaaaggcaaggcgctggccatcgaaaaagcgttatatgaagagctattcgatctgctgttgcctcatctggctgaactgcaaactagcgcagaagcactgtcagagctggatgtgctggcaaaccttgctgaacgcgctgaaacgctaaactacacctgcccgacactgagcgataaaactggtattcaaatcacgggtggacgccatcctgtcgttgaacaagtcttgagtgaaccctttatctcaaacccactaacactttcgtcacagcgtcgtctgctgatcgtcacggggccgaatatgggggggaaaagtacctatatgcgtcaggccgccttgattacgctgctggcgtatatcggtagttttgttcccgccgaaaaagtgctgattgggcctgtagaccgcattttcacccgcgtgggcgcttccgatgatttggcatcagggcgttctacctttatggtagaaatgaccgaaaccgccaatattctgcataatgcgacagagcatagcctggtcttgatggacgaaatcgggcgcggtacgtccacttatgatggtctgtctcttgcatgggcctgtgcggaaagtctggccaatcgcatcaaggcgatgacgttatttgccactcactattttgagctgacaacgctgcctgaaaaactggaaggtgtggttaatatccatctggatgctgtcgagcatggcgatactattgccttcatgcacagtgtacaagaaggggcggcaagtaagagttatggattggccgtcgcctctctggcaggagttccccgtgatgtcattaaacgagcgcgccagaaattaaaggagctggaatctctctccaacaatgcgacggcaggccacgtcgatacaccgcagttgacgctgctgacggaagaggtatctccggcagttgaagcgttggaaaatctgaatccggatacattgacaccgcgtcaggcattggagtggatttatcgtctgaaaaatatggta

SEQ ID NO: 23867 - DNA, 1434 bp, Xenorhabdus nematophilus
aagaaggttctcatgtcaaacaacattcgtatcgaagaagacctgttaggtaaacgagaagtccctgctgaagcctattacggtattcacactctgcgtgcgattgaaaacttttatatcagtgaccgtactatcaatgatgtgcctgaattcatccgtggcatggtgttggtaaaaaaagccgcggcactggcaaacaaagaactccatactatccctggaaaaattgcggatattattgtcaaagcgtgtgatgaagtcctcaacacaggcaaatgcctggatcaattccctgttgatgtatttcagggcggtgcaggcacctcactgaacatgaataccaatgaggtactggcaaatatcggtcttgaattgatgggacacccaaaaggtgaatatgagtacctgaatccgaacgaccacctgaacagaagccagtcaaccaatgacgcttatcctactggtttccgtattgctgtttataattcaatcataacattgattacctccattgagttattacaagtcggtttcgacaaaaaagccgttgaattttctgacatcctgaaaatgggccgtacccaattgcaggatgcggttccgatgacactgggccaagagttccgcgccttttccgtgttattgaaagaagaaatcaaaaacatcacccgcacagcagaattactgctggaagtgaacctcggtgctaccgctatcggtactggcctgaataccgcgccaggctaccagacgctggtggttgaaaaattagctgaagtcacagggttaccttgcctaccagcagaagatctcatcgaagcaacgtctgactgcggtgcttacgtgatggttcatagcgcattgaaacgtctggcagtcaagatgtccaaaatctgtaacgacctgcgtttactttcttccggcccccgcactgggctgaatgagattaacctgccagaattgcaggccggttcttccattatgccagccaaagtcaacccagtggtgccagaagtcgtcaaccaagtctgcttcaaagttatcggtaatgatatctgtgtcaccatggcatcagaagcaggtcaattgcagcttaacgtgatggagccagctattgggcaagcgatgtttgaatccatttctatcctgagcaatgcatgccgtaatctggttgaaaaatgtgttaacggtattacggccaataaagaagtttgcgaaagctttgtatttaactctattggtatcgttacttacctgaacccattcatcggccaccacaatggcgatatcgtaggcaaaatctgtgcagagacaggcaaaagtgttcgtgaagtcgtattggagcgcggtttgctgaccgaggcacaattggatgatattttttctgttgagaacctgaaacatccgacttataaagcaaaacgttttgacgac

SEQ ID NO: 23868 - DNA, 1620 bp, Xenorhabdus nematophilus
atggcagctaaagacgtaaaatttggtaatgatgctcgcggcaaaatgctgcgtggtgtgaatgtactggctgatgcagttaaagtgactctgggtcctaaaggccgtaacgttgttttagataaatcttttggttcgcctgtaatcactaaagacggcgtatctgtagcgcgtgaaatcgaattagaagataaattcgagaacatgggtgcacagatggttaaagaagttgcctctaaagccaacgatgcggcaggcgacggtactaccactgctactgtactggcacagtctatcgtcactgaaggtctgaaagccgttgctgctggcatgaacccgatggatctgaaacgcggtatcgataaagcagttattgcggctgttgaagaactgaaaaaactgtccgtaccttgctctgactccactgccattgcgcaggttggtacaatttctgccaattccgacgaaaccgtaggtaaattgatcgctgaagcgatggataaagtcggtaaagaaggtgtaatcaccgttgaagaaggtactggtctggaagatgaactggatgttgttgaaggtatgcagttcgatcgcggctacctgtctccttatttcatcaataaaccagaagcaggttctatcgagctggaaaacccatacatcctgctggttgacaagaaaatttctaacatccgtgaactgttgccagttctggaaggtgtagccaaggcaagtaagccgctggttatcatcgctgaagacgttgaaggcgaagcgctggcaacgctggttgtcaacaacatgcgtggtatcgtgaaagtggctgcggttaaagcccctggttttggtgatcgccgtaaagcaatgttgcaggatatcgctactctgaccaacggtactgtgatttctgaagagatcggtctggagctggaaaaagcgactctggaagatctgggtcaggcaaaacgcattgttatcaataaagacactacaattatcattgatggcgtaggcgaagcggccgcaattgctgcacgagttactcaaatccgtcagcaaatcgaagaatcaacttctgattatgaccgtgaaaaactgcaggagcgcgtagcgaaactggcaggcggtgtggcagtgatcaaagtcggtgctgcaactgaagttgaaatgaaagaaaaacgcgctcgtgttgacgatgctctgcatgcgacccgcgcagcagtagaagaaggtgttgttgctggtggtggtgttgcactggttcgcgctgctgctgctatctctgctctgacgggcgacaacgaagatcaaaacgtgggtatccgcgttgctctgcgtgcaatggaagcgccaatgcgtcagatcgtagaaaacgcaggtgaagagccatctgtggttgtgaacaacgtgaaagcaagccagggtaaccacggttataacgctgcaactgaagagtacggcgatatgatcgagatgggtattctggacccaactaaagtcactcgctctgcactgcaattcgcaggctctatcgctggtctgatgatcacgactgaagcgatgattaccgatctgcctagagacgacaaagctgacttaggtggagctggtggcatgggcggt

SEQ ID NO: 23869 - DNA, 975 bp, Xenorhabdus nematophilus
cgcaatttactaagattacatgactatactccttcagaaattaatgtatttctgacactatcgagtgaattaaaatcgaataaaaaatcaggtaaagagtcgcctttactgtcaggtaaaaatatcgcgctgatttttgagaaagactccacccgtacacgctgtgcctttgaagtcgctgctcatgatcaaggtgccagcgtcacctatttaagctcaaatggcagccagattggacataaagaatccatcaaggacaccgcacgggtacttgggcgtctgtatgacggcattcagtaccgtggatatggtcaggaagttgtcgaaacgctggcgaaatacgccggcgttccggtctggaatggtttaacgaatgaattccacccgactcaactgttagccgatttactgacgatgcaagaacatagccagaagccactgactgaaatcaaacttgcctatttgggcgatgcccgcaataacatgggcaatacaatgctggaagccgctgcattaaccggtatggagctgcgtctggtcgctcccaaaacgtgctggccggatgcagcattgattgccgaatgccaaactctggcagaaaaaaccggcggcaggatcgccctgacagaagacattgcgaccggcgttaaagatgccgattttctttacactgatgtttgggtttcgatgggagaacccaaaacagtctggcaagagcgcattgcgctgctaaagccctatcaagtgaatatggatgtcattcaactgacggagaacccggaggtgaagttcctccactgccttcctgcgttccacgatgaagaaacaacgcttggcaagcaactggctgaggagttcaatctgtatggtgggctggaagtcactagtgaagtctttgaatcaaaacacagtattgtgtttgatcaggcagaaaaccgtatgcacacgattaaggcagtgatggtagcaacgcta

SEQ ID NO: 23870 - DNA, 861 bp, Xenorhabdus nematophilus
tatgctgtcacaattggcgcagccaatatggatttcaccagttatgcctctgaaaagttagtgtatgaagattccaacccagggaaaataatatcgacgccgggaggtgtcggaagaaacattgcacaaaatattgctgcactgaaaagtgaaagccatttcatttctgttgttggtaatgattataatggcaaggtattattcgaacaaacgaaactagctggtgttaatattagatatttccataaattagatgaagaaaaaacatcgatctgtaattccatcattgatgaaaatggcaaatgcatagtctctgttaatgacatggacattatggaaaagctcacgcccacattattatctcagtccgaagagttaatccgacgtgctagtgtattagtcattgactgtaatctgacagaaggagcattggaatggctatttaatcatgctggaaatgtgccgatttttattgataccgtttccacatttaaggcgactaagatccgccattggctatcttatatccacaccctgaaacccaatcgatctgaagctgaaattctcagtggaatagaaattgagacccaaaaagatgccgctatcgccgcatcctggttccatcaacaaggtgttcaacgtttaattttaagtatgggtgcggaaggtgtgtactacagtgaactagataataaatcaggctattcacgtgcgattaccaccagtgtgctcaatgccagtggagctggtgatgcgatgatggcaggtcttgcccactgttggttacagagtatgtctctggaagacagcattcgttacgcacaacgatgttctgcactcacgctgtcttcagaggatact

SEQ ID NO: 23871 - DNA, 1491 bp, Xenorhabdus nematophilus
tcaataaatttagcgcaacgatttgtcatggaaaactcgtctcttgataaagactgttttatcgggccagacggctcattgagttattcccagcttgcattttttgtccaaaaaagtgcttctgctatgtcgttaaaaaaaatagaaaaaaatacagcagtcatcctctgcctcaatgacagccgggaattagctattattttttttgccagtttagcaattggagcgttaccggtcgttattaacccgaaattaccggctaatactcttgattacatactgggggaatttgataccccttttattttcctcgatgaggataatcaaatatctattgcagctgaagcgaaagaaaatactatccgtattaaaaggagtgccgatctttcggcattctgtgattggatgcctgaaaacaccaatgataaatggcatgattttttggaaaaaacccattttgagcctgctttcattcaatatacctcaggatcgactggaaaacccaagggagtgattcacagcgttacatcaattttgtcttcctgtgaacatttttctaaacatcaattaggtttaactacaacagacattatctattcaacaccaaaaacattttttggttatggtatgggaaataccctatttttcccgctatttatcggcgccactgcaattatagatagcctttggccttcaataacaagggttacggataatattaaacaatttcaaccaactgttctgttggcggggccgatgatatttcgtttattacttgaagatgatgaatttaaacaaaattgccatcttcgtctggtcgtttcttctggctcaatgttacctgcacctctaaaagaatcctggtttcagcggctcaatatagtgatacatgatgcatttggcgcgactgaaacatgccatgcttttgcgacaacttatggtcatccatcccgatcaggaagcattggaaaatttattgccgggtgtacaggaaagattgttgataaagatggaaaaaccgttccggctggggaaactggcgtgcttatgctgagttcagaatccttagctctgggatattggaataaccatcaagatacaaagatcaagttttccaacggttggtatcgcactggagatctattttcgcaagacgacgaaggattcctttattatcacggccgtgaagatgaacagttcaaggtattaggacgctggttggtgccggtagaaatagaaaaactcgtccattccgcttttccagaaattggtgatgcatttatgatcccttggatggatagtatccaagaatgcagacctgttttatgtctgaaaacttcttccagtgaatttgaagcaatcagccaacagatagccaattttatcagccaccaagtagaaagttataaacatccctatgtttatctcaatttagaacaattcccactgaatggaaacggtaaaattgatcgtaagtcgatgatcgaaata

SEQ ID NO: 23872 - DNA, 933 bp, Xenorhabdus nematophilus
atggctaatccgttatatcgcaagcatatcatttcaattaatgatctgagtcgcacggatctggaattggtattgcagacggcagcagcattgaaagccaatccacagactgaattactaaaacacaaggcgatcgcaagctgcttttttgaagcctctacacgcacccgcctctcttttgaaacagccattcagcgactcggcgcttccgttgtcggttttgctgatagcaacaatacttccttgggtaaaaaaggggaaacactggccgataccatttctattatcagccagtataccgatgcaattgtgatgcgccatccacaggaaggcgccgctcgtcttgcttctgaattctccggccatattcctgtcattaacgccggtgatggtgcaaaccagcacccaacccagactctgctcgatctgttcaccattcaagagactcaacacaagctggataacctgaaaattgctatggttggtgatttgaaatatggccggactgtccactcgttaacacaggcactggcaaaattcagcggcaaccatttctgctttatcgccccggatgctttggccatgccaagctatatcctgcatatgctggatgagaagcaggtcagctacagcattcaccataattttgaagatgtcatgcctgaactggatatcctctatatgacccgtgtgcagaaagagcgtcttgacccttccgagtacgccaatatcaaagctcagttcgtgctgcatgccgctgatctggttaatgttaaagagaatttgaaagtgctgcatccactgccacgtatcgatgaaatcaccgtagatgtcgataaaaccccttatgcctactatttccagcaggcaggtaacggcattttcgcccgtcaggcattgctggcactggtattgaatgaaaatgtcgtcata

SEQ ID NO: 23873 - DNA, 462 bp, Xenorhabdus nematophilus
atgacccaagaccatcaattacaagtagaagctattaaatgtggcaccgttatcgatcacattccggctcacatcggtttcaaattattgtctctgtttaaactcacagaaacagagcagcgcattaccattggtttgaacctgccttccaatcaactcggcagaaaagatctgatcaaaattgaaaatacctttctcacagagcagcaggcgaaccagctcgcgatgtatgctccccatgctaccgtcaataatattgaaaattacgaagttgtgaagaagatacccatcaatttgccaaagcagatagacaatgtcctcgtgtgtccgaacagtaattgtatcagtcacaatgagcccgttgagagcagcttttatgtcattccaaccgccgatgatgtgatagtccgctgcaaatactgtgagaaggaatttgaccgtcaggcagtcattaacaacgac

SEQ ID NO: 23874 - DNA, 783 bp, Xenorhabdus nematophilus
atgaatataaatttaaaagggaaaattgcattagtaacaggttctacagcagggattggattagctattgctcagggtatgcataaggctggtgcttctgtcattttgaatggaagaagtgaagagaggctcatacaggcggttaataaatttaactgcttggatcgcgtttttactgtagctgctgatgttggcaccaaagaaggctgtgaactcattaacaaaaattttccggatattgatattctggttaataacgccggaattttttctcctaagccaatttttgaaattagcgatgatgaatggattaattattttaatattaatgtcctaagtggaattcgtctggcacgttcatacattccacttatgattgggaaacgatggggacgtgtggtattcatctcaagtgagtcagccttacaaatcccggtagaaatgccacattatggcctgaccaagacggctcaagtcgcagcagcaagaggattcgcacaagctgctacaggaacaggagtcactgtcaacagcgttttacctggacccactgaaagtgaaggggtagagcgatttgtcagagaacttatcacggacccaacactttcaatggaagaagcaggaaaacgctttattgaaacagcacgtcccgcatcgttgctgggtcggttagccactgctgaagaagtcgccaatgctgttctctttttagcttcaccactcgcttctgcaataacgggtactgccctgcgtgttgatggtggcgtcattcaaagtattttg

SEQ ID NO: 23875 - DNA, 762 bp, Xenorhabdus nematophilus
ttagcgggtaaagcagtaatcatcactggggcaggttcaggtattgggcttgctgctaccacggaatttttaaatgcgggggcgtatgttataggagcggatattaaccttgagaaactttatgagttgcagagaggggaatacctatttccttatcagtttaatgtcagagatccctcagatattgatggtcttatcaatacagccatcagccaatttgggaagatagatatcctgattaataatgctgcattagtagaaccgaggaaaagttttcttgatgtaaccgatgacgactggaattctacaatcgaaaccaatctgcttggttacatccgaatggctcgcggtgtactaccttatatgtgcaatcagaaaaagggtattttactccatatcgcttctgaagcagcattaatgccaaatttgattctccctgattacagtatcttgaaatcttcagttctaactctgtctaaggtgatatcaagggagtttggaaaatatggcattcgatctaatgttatttctccagcttttattcatacctctatctacgataaacctgaaggattgataactcagcttgaacaaaagtataaagttggacgtgaagaagcattgcaacgttatattgaagaagttgatatcgctgttggtcggttagggcaacctgaagaagtggcggttttactcttatttttggcctcagaatctgctgcattcattactggggcaaattatttagtcgatggcggagtg

SEQ ID NO: 23876 - DNA, 2208 bp, Xenorhabdus nematophilus
gaacagcctttcagcggcgacgataaaaatgggcagggcgtccatccggcaaacagcgacagcctgctggcgcgttttacccagaatatgactgaacaggcgcgtcagggcaaacttgatcctgtgctgtgccgtgataacgaaatcgatctgatgatcgacattctctgccgtcgccgcaaaaacaacccgatcgtcgtgggtgaagcgggggtgggtaaaagtgccctgattgaaggtctggcgctgcgcatcatcaatgaccgcgtaccggataaattgcgccacagtgaactgatgacactggatctgggggcattgcaggcaggggctgcggttaaaggtgagtttgaaaaacgcttcaaaggcatcatggctgaaattagtcaatcatctaagccgatcatcctgtttatcgatgaagcgcacaccctgattggtgccggtaaccaggctggcggactggatatttccaatctgctgaaacctgcattggcacgtggtgaactgaaaaccatcgcagcgactacatggagcgagtacaaaaaatacttcgaaaaggacgcagcactgtctcgtcgcttccaattagtgaaagtctctgagccaagcgcggaagaagccactgtgatcatgcgtggtttgcgcgccatttacgaacaggcgcatggtgttctgatcgatgatgaagcactgaaagcctctgcggtactgagtgaccgttatctctctggccgccaactgccggacaaagcgattgacgtactggataccgcctgtgcccgtgtcgccattaacctgacatcgccaccacgtcagatctcctcactgacgactgaattgcaccagatgcaaatggaaatcgatgttctgaaaagagaacagcggatggggctgaatgaacatgcggacagactggaagaactgcaaaaccagcaggtagagatccaagaagaactcgtcacgctggaaaaaaactggcggcaacagcaagagttggtgacacagatcatcgaattgcgcggccaactcctggcggatagcgacgagtcagttgcagcagaaacgacggataaaaccatcgaaaatgcggttgaagagacggctcaagacgcgaaagagcaggaagctattgcgcaagacgagccagaagccgccgctgatgagcaatccctgatcgaaaaactggctctgctcaacgcacaactgacagagttacagcagaagcaaacgctggtttctccccatgtagacaaaacgcagattgcctcggttatcgctgagtggacgggcgttccattgaaccgcctgtcacagagcgaactgtctatcgtgaccgaactgcctacccatctgggacaaagcatcaaagggcaggatgttgcgatccagaacctgcataaacacctgctgaccgctcgtgcagatttgcgtcgtccgggacgtcctctgggcgcattcctgctggtggggccaagtggtgttggtaaaaccgaaaccgtgctgcaaattgctgaactgatgtttggggggcgccaatacctcaccaccatcaacatgtctgagtttcaggagaaacataccgtttcccgcctgattggctctcccccgggctacgtaggttatggggaaggtggtgtactgaccgaagccattcgccagaaaccgtactccgttgtgctgctggatgaagtcgaaaaagcgcatcctgatgtactgaacctgttctatcaggccttcgacaaaggcgaactggccgatggcgaagggcgtatcatcgactgtaaaaatgtcgtgttcttcctgacttctaaccttggttatcaaactatcgttgatcatgccgagcagccagatcaacttaacgacctgctctaccctgaactggccgcgtttttcaaacccgcattgctggcgcgtatggaagtgatcccttacctgcctttgggtcacgaaacgctgaaaaccatcattcagagcaagctggctcgactggatagcctgctgtctcagcgctttaacgccgaagtcacgatcagcgatgacgtatcggaagagatcctgcaacgtgccacccgtgcggaaaacggcgcccgtatgctggaatccatcattgatggtgcactattaccgcctgtttcattactgctgttgcagaaaatggccgcaggcaccgcaatcagtgccattcgcttaaccgtagcagaa

SEQ ID NO: 23877 - DNA, 759 bp, Xenorhabdus nematophilus
gacattgcaggaagcaaaattcaggtacgtgatctgaacttctattacggcaaatttcacgcgctgaaaaacatcacactggatatcgagcagaataaggtgacagcctttatcggcccgtcggggtgcggcaagtccacgttactgcgcactttcaacaaaatgtatgaactgtatggcgaacagcgggcagaaggcgaaattatcctggatgacaccaatattctgaccgataaacaggatatcgccctactgcgtgccaaagtcggcatggtgttccaaaaaccaacgccattcccgatgtccatttatgacaatattgctttcggtgtgcgtttgtttgagaaactgccaagggctgaaatggatgaacgcgtccaatgggcgctgacaaaagccgcattgtggaatgagaccaaagacaaactgcaccagagtggttatagcctttccggtggtcagcagcagcgtttatgcattgcccgtggtatcgcgatccgcccggaagttttgttattggatgaaccgtgctcggcacttgacccgatctccaccggacgcattgaagagttaatcagtgaattgaaatcggaatataccgtggtgatcgtcacccataacatgcagcaggccgcgcgctgttctgaccacactgcatttatgtacctcggagagttgatcgagttcagtgacacagacacgctgtttaccacacccagaaagaaacagactgaagattatattacaggccgttacggt

SEQ ID NO: 23878 - DNA, 1485 bp, Xenorhabdus nematophilus
atggaaaccaaagacttgattgtgattggcggcggaattaacggcgcgggtattgcggcagatgccgctggccggggactttccgtcctgctattggaaggtcaagacttggccagtgcgacttcgtctgccagttccaagctgatccacggtggcctgcgctatctggaacattatgaattccggctggtcagtgaagcactggcagagcgtgaagtattactgaaattagcaccccatattgcattcccaatgcgttttcgcctgccccatcagccgcatctgcgcccagcctggatgatccgcattggcctgttcctgtatgataacttgggtaaacgcgttagtctgccaagcagcaaggggctgaaatttggtgcgaattccgtgctgaaaccttccatccgccgtggctttgaatattccgactgctgggtcgatgatgcccgtctggttgtcctgaacgctcaggaagtccagaagcatggcggtgaagtccgtacccgtactcaagtgacccgcgcatggcgtgaaaagggttactggatggttgaagcgaaagatctcaccacgggcaaaaccgatacatggcgcgccaaaggcttagtcaacgcgactggcccgtgggtcaaaaacttctttgatgatgggctgaaactgaaatcaccttacggtatccgtctgatcaagggcagccatatcgttgtacctcgtgcgcatgatgaacctcaagcctatattctgcaaaacgaagataaccgtatcgtgtttgttattccgtggaatgatgagttttccatcatcggcaccaccgatgttgaatacaaaggcgatccaaaagaagttaaaattgacgatcaagagatcggctatttgctgaaagtttataacaaccacttcaagaaacagcttaaccgtagtgatgttgtctggacttactccggcgttcgcccactgtgcgatgatgaatcagattcaccacaggcgatcacccgtgattacacgctggatgtacaggatgaacaggggcagatgccattgttgtccgtctttggcggtaagctgacaacctaccggaaactggctgaacacgcgctggagaaactggtacagtactatccaaacgcaggtaaggcgtggactaaaaacggtaaattaccgggtggtgaactggaaggccatgatcgcgatggttatgcacgcctgctacgccagcgtcataactggctgccagaaggtgtggcacaacgctatgcccgtacttacggcagcaactgccagataatcctgaaaggcgcagaagccctgacagatttaggcgagttcttcggccacggcctgtatgaagccgagttgcgttatctggtcgaacatgagtgggtgactcagttagacgatgctatctggcgccggactaaattgggtatgtggctgaccgatgaacagaaacagcgggttgctgactggctggcacagaacgttcaa

SEQ ID NO: 23879 - DNA, 711 bp, Xenorhabdus nematophilus
atgtcaatgatactcactgatattgaagcaggtgtcctcagcattacgctcaaccgtccagaacgcattaacagctttaacgaggaaatgcaccagcagttaagtgaagcgctaaagatcgctgaacaagatgaatccgtgcgctgtgtcctgctctcaggcgctggacggggcttctgtgccggacaagatttaaatgatcgcaacgccatcatctcagagggtgacgttcctgatctcggccaatccgttgaacgtttctacaacccgctgatccgtcgcctgacttccctgcccaaacccgtgatctgcgccgtcaacggagtagcagcaggcgcaggtgtctccgtcgcactggcctgtgacattgtgatcgcttcccgtaccgccagctttattcaagccttctgccgtattggtctgacaccggatgccggcggtagctggttcctgccccataaaatcggccatgcccgggcaatgggaatggcattattgggagacaaaatcagcgcggaacaagcactggaatggggcatgatctggcaggtcgtcgaacccgaagcgttagaagataaaacacgggaactcgctcaacatctggcgacccagccaacggtggcgctgagttgcatcaaaaaagccacttatgccgccgcagccaatagcttggatcaacagcttaatctcgaacgtgatttacagcgcctg

SEQ ID NO: 23880 - DNA, 1615 bp, Xenorhabdus nematophilus
gacgcagtgaagacttccgtgaaggtgtcagtgcattcatagacaaacgccagccacagttcaaagggagataaccatgaacacgccagcacatcatcatccgatccttcacggcccgattgctgtcattggcgcgggaacgatggggatcggcattgcacaggtcgccgctcaggcaggatattccgtcctgctgtttgatgtgaataatgaagcggcacagcgtgcactggagacgctgcacacccgtctgcatcaacgtgtggaggcaggcaaagcagcagctggcgcaacccaagccctattacagcgcatcacacgggttgactcattgcaggcactggcaccgagcgcactggtgattgaagcgattatcgaacaactggaggtcaaacagaacctgttccgccaactggaacccctctgttcagccggaacgatctttgccagcaacacctcatcgctctcgattaccgccattgcccgtgtgctggcttcaccccaacgcatggcggggctgcattttttcaaccccgcaccactgatgaaactggtggaaatcattcagggtctggaaacgtcgtctcaaacgattaccacactcaaaagtctcgtcaccgattggcaaaaacagcctgtagtttgccgctctacgccgggttttatcgtcaaccgcatcgcccgcccgttttatgcggagactttgcgcgcactggaagaaaacgttgcttcccccgccacactggatgcagtaatgaaagaatcgggcggttttgcgatgggggcgttacagcttaccgatttgattggtcatgacgttaattatgccgtaaccgaatctctgttccacgcatttcacggtgatccgcgcttccagccttcactgcgccagaaagagctggtggaagccgatcatctgggtcgtaagcgcggtcaggggttttatgtttatgatagcaaagaaaaacatcagccattaccccggttggaaaccctccaggagcaaatacggcctgcgcggattcaggcaacgggcgattggggaactctgccacattttgccgcgctattaaaaccgttgttacaacaatatggaatcgcccccgaagaaagcaaaaataccgattcccagccgccagcattacagcttgatgacgttatattaacgctgacacaaggtaaaaccagcgcacagcttgctgatgaaatcagagcgccagtggtacagtttgatcttgccgccaatcatcagacggcttccatcatcactcttagctccgcctgccagaacacccggccgcagacggcaaaagtgatcagtttcctgcaatctctcggcaagcaggtgattctcctgccggattaccctgccttactgacgatgcgtaccgtggccatgttgtgcaacgaggcgctggatgccatcaataaaagcatcgccagcgctgcagatatcgatctggcgatgtgttacggcgtcaattatcccatcggcccattggcatggggggaacaactgggctggcggcacattctcagcacactggaaaacttacagcaattttatggcgaaccccgttaccgacctgcacctttgttgcgccaactggcggca

SEQ ID NO: 23881 - DNA, 1209 bp, Xenorhabdus nematophilus
atgacccatgcgtttatctgtgacggcatccgtactcctatcgggcgttatggtggtgcgctttccggcctgcgggctgacgatctggccgctctgccgctacaggcactactggcacgttatccctcgctggattggcaacagattgatgacgtcattctgggctgcgcaaatcaggcgggagaagataaccgcaacgtggcacgcatggcggttttactggcagggttaccctattcggtatcggcgaccaccctcaatcggctgtgcggctccggtctggatgccttggcctttgccgcccgtggtattaaagccggcgaagcgcaactgatgctggcgggcggggtcgaatccatgacccgtgcccctttcgtcatgggtaaaaccgacagcccattcagccgccaagcccaaatctttgataccacccttggctggcgctttatcaatcccctgatgcagcagcagtttgggacagactccatgccagaaactgcggaaaatgttgccgcccagtttcaaatcagccgtgacgatcaagatgccttcgccctgcgcagccagcaacgtaccgccaacgccgaacaacggggaattttcgcggaagaaatcacccccattaccctgccctctacagacaaaaaaggcacaccaaccatcgtctcacgggatgaacacccacggccggagacgacattcgaacaactgcaacggctgaaaacccccttccgggttgatggaacaatcaccgccggcaacgcctctggcgtcaatgatggcgcggcggcactcatcatcgcctcagagacggccgccttgcagcaggggctgacaccccgggcgcgcattatcgcaaccgccacctgcggcgttgaaccccgcatgatggggatcgggccattgccagccacccgcaaggtactggagctcactggcctgagcctgaaccagatggacgtcattgaactcaatgaagcttttgccgcacagtcactggccgtcatgcgtcagttggggctaccggatgatgcagaacaggtcaatccgaatggtggtgcgattgcattgggtcatccattgggcatgagcggggcacgtctggcgctgacggccactctggaactggaacggcgtaccggccgctatgccttgtgcacgatgtgcatcggcgtagggcaagggatcgccatgattattgaacgcata

SEQ ID NO: 23882 - DNA, 1647 bp, Xenorhabdus nematophilus
atgactgaacagcaaccttggtggttagatagcgttatctaccagatttatccaaaaagttttcaggacagcaccggaagcggtacaggtgatatcaatgggatcacccaacggctggattatctacagcacctcggtgttgaggctatctggatcacgccgttttatccgtctccgcaagttgataatggctatgatgttgccgattactgtgccattaatcccgattatggctcaatggaagactttgacaatttagtggaaaatgcccatcgccgtggtatccgcatcattttggatatggtctttaaccacacttcaaccgaacatccgtggtttcaggctgcacaggatatcaatagcccttcgcgccagttttatatctggcgcgaaggctccagcgattccctgcccaataactggaaatccaagtttggcgggaatgcgtggcaatggcatgctgaaagccagcaatattacctccatctgtttgcgataaaacaggctgatttgaactgggaacatgaacccgtccgcgccgagctgaaaaaaatctgtgagttctgggcagatcgtggtgttgatggcttgcggctggatgtggttaatctcgtctcaaaacagcaggattatccgagtgacgatcacggagatggccgccgtttctataccgatggcccgcgtattcatgaatttctgcaagaaatgagccgtgatgtgttccagcccaagggcttgatgaccgtaggtgagatgtcttccacaggtcttgagcactgcctccgttacagcgctttggatagcagtgcgctgtccatgacgtttaattttcatcatttgaaagtcgattatcctaacggtgaaaaatggactctcgccaaacctgactatattgccttgaaaaagattttctcaacctggcagcaaggtatgcatcaaaaagcatggaacgcgcttttctggtgcaatcatgatcagccccgcattgtttcccgatttggggatgaacaccagcatcacaggacgtcagccaaaatgctggcaatggtgctgcacggtatgcaaggtacgccgtatatctatcaaggtgaagagctgggcatgacgaaccctcactttgagcgtattgaagagtatcgggatattgaaagcctgaatatgtatcaggagcgcattgagcaaggcatggcaccagaggaaatactggcaattctggcgcagaaatcccgtgataacagccggacgccgatgcagtgggatggttcagccaacgccggctttacctctggcacaccgtggatagcctcttgcgataattatccagagctcaatgccgaagctgcattgcaggataaagattctgtcttctattgctaccacgaattaattaaattgcggaaacaacaacccatactgacctacggtgattatctggatctgttacccgaccatccttcgctttggtgttatctgcgtcgctggcagaatcaggtcatgttagttatcgcgaatttaagtgatgaaaaccagctatggtctccagaaccttctctcacagataaagaatggcaggtattaataagtaattatccatcgccttcttcaatagaaaaagagatgtcaattaaaccttatgaatcaatatac

SEQ ID NO: 23883 - DNA, 840 bp, Xenorhabdus nematophilus
atggaaatcactcacgttattcgtggtgaagaccatatcaacaacacaccacgtcagattaacattctgaaagcactcaacgcaccagtaccagaatatgcgcatgtttctatgatcctcggtgacgacggtaaaaaactgtccaaacgccatggtgcggtcagcgtaatgcaatatcgcgatgatggttacttgccagaagcattgctgaactatctggttcgtttgggctggtcacacggtgatcaggaaattttcaccgttgaagaaatgactgagctgttcagccttgatgctatcagcaaatcagccagtgctttcaatactgaaaaattgctttggctgaaccatcattacatcaataccctgccagcagaagaagttgctgttcatttagcatggcatattgaacagcaaggtatcgatacccgcacaggcccagagttagtggatctgatcaaactgctgggtgagcgttgcaagacattaaaagaaatggccagcgctggtcgttacttctatgaagagtttgcagagttcgatgctgatgccgcgaaaaaacatctgcgtccggttgcgcgtcaaccattagaagttgtgcgcactaaactggcagccattaccgaatggacacctgagaatattcatcacgctattcaggcaacggctgacgaactggaagttggaatgggtaaagtaggcatgccactgcgcgttgctgttaccggcgctggccaatcaccaagtgttgatgtaaccattcacgccatcaatcaggctcgttcactggctcgtattgataaagcactggcttatatcgcacagcgtgaagcgcaataa

SEQ ID NO: 23884 - DNA, 1170 bp, Xenorhabdus nematophilus
attggtaataaccagaaagaggtgcttaaatctctgaaagaaggcctttccgggataactttttccgaagaattcaaagaaatggggcttcgcagccaggtttggggaaatatcaaactggatacaacgggtttgattgaccgaaaaacacagcgctttatgagtgatgcttctgtttatgcttatctggcaatggacgaggcaattaaagattccggcctgtcagatgatcaggtttctaatttacgcacagggctggttgtcggctctggtggcggttctcctcataatcaggttgtctgtgcggacggtatgcgtgcccgtggcttacggggtgtcgggccttatatggttacaagaacaatggcttccggcatttcagcctgtctggctacaccatttaaaattaaaggcgttaactattcgatcagttccgcttgttcgacctctgcgcactgtatcggtcatgctgttgagttaatccagcttggcaaacaggatgttatttttgctggtggaggtgaagaacttagctgggaaatagcctgtgaatttgatgcaatgggtgcgctttccactaagtataatgaaacgccggatcgtgcttcccgtacttatgaccaaaaccgtgacggctttgttatcgcaggcggtggcggtatcgtagttgttgaggaattagaacatgcattagcccgtggcgcgcatatttatgctgaagttattggctacggagcaaattccgatggtatggatatggtagcaccttcaggcgaaggggctgttcgctgtatgagaatggcaatggacggtattgatggtgaagtagactatatcaatacacatggcacatcgacaccggttggtgacctgaaagagctggaagctatccgagaagtatttggtgataacacacctgcaatttcagcgactaaggcgatgaccgggcattctttgggagcggcgggtgctcaggaagcaatttacagcctgttgatgctggagcacgggattattgcaccgagcattaatatcgaagagctggatgaaaaagcgcttggtatgaatattattacagaaccgaccgaacgcgagctaacaacagttatgtccaatagcttcgggttcggtggtacaaatgcatctttggttatgcgtaaatattctgac

SEQ ID NO: 23885 - DNA, 1038 bp, Xenorhabdus nematophilus
atgatttcaggcatcttagtatcaccaggtattgctttcggtaaggcattattgctgaaagaagaccccatcattatcaatcataaaaaaatcactcctgaacaggtcgaacaagagatctcctgctttaaacaaggccgggataaagcttctgctcagttagaagtcatcaaaaatacagccgaaaaaaatctgggtgcagaaaaagccgaaatcttcgaaggacacatcatgttgctggaagatgaggagctggaacaggaaattattacgctaataaagaaaaatctggctacagcagatgccgccgttcactctgttatcgaagatcaggccaaggcactggaagagctggatgatgagtatttaaaagagcgtgcagctgatgttcgtgatattggtaaacgcctgctgaaaaatattctgggtatgccgattattgacttaggatccattgcggaagaagttattctggttgcaaatgacctaacaccttcagaaaccgcacagcttaatctggataaagtgctggggttcattacagatctaggtggccggacatctcatacttcaattatggctcgctctctggaactacctgcaattgtcgggacaactaacgcaacaactcagattaaaaatggcagctacctgattttggatgctgttaataatcatatctatatagacccatctgacactgaaattgaacaactcaaaaaaatcaaaaacgaatatctgtcagaaaaaaccgaattagcaaaactgaaggatttaccagccattacgctggatggtcatcaagtagaagtctgcgccaatatcggcacggtgcgtgatattgcaggcgcagaacgcaatggagcagaaggcgtcggcttgtaccgtaccgagttcctgtttatggatcgcgattctctgccgactgaagaagaacagtttgaagcctataaggctgttgccgaatccgttggtaatcaggctgttattatccgtaccatggatatcggcggtgataaagaactgccttatatgaat

SEQ ID NO: 23886 - DNA, 754 bp, Xenorhabdus nematophilus
aatgaatgcctgcaaagcaggaattaacgagattattctggttacacactcatccaaaaactcgatagaaaatcattttgataccagttttgaactggaagcaattctggaaagaagggttaaacgccagctattggatgaagttcagtctatttgtccgagccatgtgacaatcatgcaaacccgtcaggggattgcaaaagggttggggcatgcagtgttatgcgctaagccactgattggagatgaaccgtttgccgttattctgcctgatgttattttggatgagtacagcacagatttatctaaatacaacctgagcgaaatgttgtcacgttttaacgagaatggtgcgagtcagatactagttgagccagttccttatgaaagcgtttctgactatggtattgttgactgttttggggaaaatttacaacctggtgacagtaagccaattgcccgtgttgttgaaaaacctaaacctgaagaggcaccatcgaatctttccattgtaggtcgttacgtactatctgaaaaaatctggccactattagcaaaaactgcgccaggtgcaggggatgaaattcagcttactgatgctattgctatgctgatggaaaaagagccggttgaagcatatcacttaaaaggccgtagccatgattgtggtaataaactgggttatatgcaggcgtttgttgaatatggaatgaagcataagcaattgggagaatcatttaaagactggattatg

SEQ ID NO: 23887 - DNA, 615 bp, Xenorhabdus nematophilus
atgaaaataccatcattttttcgtttactccctctctccgctgttttgctgacggcctgtaccgttacacaggcaccagacggaacagggtcaatgagctccccgcaatggaatgatcgcaaaacacaattgcaaaatttgactcattatcaaacccggggatctttcgcttatctggcaaatgaaaagaaagtgtatgcccgttttttctggcaacaatatgcggccaataactacaagctacttctgctcaatcccttagggacaactgagctggaattatctgttcagcctaatatcacccagattactgacagtgaagggaaaaaatatatcagtaataatccggaagaactgatttataagctgaccaatatgaatattcctttggataatctgaaaagctggattatcggcctgcccggcaatgcccaaaattttgagctggataaaaactatctgcttaaatcggtaagcgataaagaaaatggtgaaatctggcaggtaaattatcagggatacgatacgtcaatgactccggccttaccaaaccggctggaactgacccaaggtaaaaaccgtattaaactgaaaatggataactggactacccaa

SEQ ID NO: 23888 - DNA, 837 bp, Xenorhabdus nematophilus
atgactttaacctggccttctccggcaaaattaaatttatttttatatatcaccggacgccgttctgatggctatcatgaactacaaacactgtttcagtttctggattatggtgatgaaataaccattactccccgtcaggataatcagatccgcctgctgacacccgttaaaggcgtgccaaatgacgataatctgatcgtccgggctgcgcggttattacaagaccacgctgaaaagcagtcaaccggcacccaataccggggcgcagatatccacattcataagcgcctgcccatgggtggcgggctgggtggtggttcttccaatgcggccacggtactgattgccctgaactatcactggcagacaaacctgtcggatgatgaattggcacaacttggcgttactctcggcgcggacgttcctgtcttcgttaaagggcacgcagcttttgccgaaggtatcggtgaaaaattgcaaccagcctcacctgaagagaaatggtttctggttgctcaccccggaattgagatcccgaccccaaaaatattcacagatcctgaattaaaaagaaattctccgatccgcactttacccgcattattacaggcaccattcaaaaatgattgtgagccaatcgcaagaaaacgtttccgtgaggttgaacagcttctttcatggctgttagaatacaccccgtcacgcctgaccgggacaggtgcatgtgttttcggcgagttcgaatcaccagcatcagcccgtaaggtgttaaatcaagccccagagtggatgcagggctttgttgcgcgtggcgttaacatttcaccattgcat

SEQ ID NO: 23889 - DNA, 1290 bp, Xenorhabdus nematophilus
gataccaaaactggcgcgaaaagagctgaaaatatgctgtggcataaaatccctaaatctatctatttccgtcgtggctcattaccagtcgctttggaagaagtggcaagggatggtgccaaacgagcctttatcgtgacagattctttcttatttaataatggttatgccgatcaagtcatcagggtcttaaaatctcataatgtagaaacagaagtattttttgaagttgaagctgatcctactttaagtattgtccgaaaaggtgctgaacagatgcgtttgttcaaaccagatatcattattgctctcggtggtggctcaccgatggatgcagccaaaatcatgtgggtaatgaatgagcatcctgaaactcattttgaagaattggcattacgctttatggatattcggaaacgtatctataaattccctaaaataggtataaaagcaaaaatggtagcgattacaaccacctctggtactggctcagaagtcacaccttttgctgttgtgactgatgatatcaccggccagaaatatccattggcagattatgcactgacaccggatatggctatcgtcgatgcaaaccttgtcatggatatgcccaaatcattatgtgcttttggtggcttagatgctgtaacccatgcgctggaggcttatgtttctgttttagccaatgaatactctgatgggcaggctttacaggcgctaaaactgctgaaagattttctccctgccagctaccagcagggggctcaaaaccctgtggctcgtgaacgagtccataatgctgcaactatcgccggaatcgctttcgccaatgcctttttaggtgtttgtcattctatggcccataaacttggttctgaattccatattccacacggattagcaaacgctctgcttatctgtaatgtaatacgttataacgccaatgataatccaactaaacaaactgcattcagtcaatatgaccgccctcaagcaagacgccgttacgctgaaattgcagaacatttaggattaagtaaaacgggtgaccgcaccgctactaaaattgaaaaactgctggcatggttagaagaattaaaatctcaacttaatattccagactcaatccgtgcggccggagttcaggaaagtgattttctggcaaaaattgataaactcgcagaagattcctttgatgatcaatgtaccggtgcgaaccctcgttacccgctaattgctgagttaaaacaattgttgctggattctttctatggacgtaaattcatagaa

SEQ ID NO: 23890 - DNA, 1254 bp, Xenorhabdus nematophilus
atgactttattagcactcggtataaatcacaaaacagcgcctgtttctttgcgtgaacgggtagccttttctcccgatacgatagggcttgcacttgataacctgctccagcagccgctggtgaggggcggggttgtgctgtcaacctgtaatcgcaccgaactgtatctcagtgttgaacaacaggacaacctgaaagagcaactcatcaattggttatgcgaatatcaccagttaagccacgatgaactcaacacgagcctttactggcatctggggagtgatgctgtcagccacttaatgagggttgccagcggactggattcactagtgcttggtgaacctcaaattttaggtcaggtgaaaaaagccttttctgaatcgcagagctaccaatccttatcaggcgaattagagcgcctgttccagaaatcattttctgttgccaaacgggtcagaactgaaacagaaattggggcgaatgcggtttctgtcgcttttgctgcctgtacgctcgcccggcagatctttgagtcgctttctcagttaaatattctgctggtgggagccggggaaacgattgagcttgtcgcccgtcatcttaaagagcaccgggttaaccatcttatgattgccaaccgcacgaaagagcgggcgtatacgctggcgaatgaggtgaatgcggaagtgatatccctgtcggaaattgatacccgactggcagaagcagatatcgtcatcagttctacagccagccctttaccgattattggtaaaggcatggtcgaacgggcactaaaattacgccgtaatcaacccatgctgctgattgatattgctgttccccgagatatcgagccggatgttgagaaattgagtgacgcctatttgtacagtgttgatgatttacaggccattattcagcagaatcttgcgcaacgtaaagcagcggctgtgattgctgaaggaattgtacaacaagagagcactcattttatggattggttgcgttcgcagggcgcagttaatacaattcgcgaatatcgggaacaggcagaaaaaatcagggctgagatgactgcaaaagcattaatgtccatacagcagggtgctgatgcagaacaggtcatcaaccagttaactcaccaattgacgaatcgtctgatccatacaccaactaaatcactccaaaaggctgccagtgacggcgatttagaacgcctgaatctcctgcgggacggccttgggctggat

SEQ ID NO: 23891 - DNA, 960 bp, Xenorhabdus nematophilus
aaggatgtagtattgcagaaaatgcacgaaaaacgcgttgagaaagcattggttgttgatgataacttccatttgctcggcatgatcacagtgaaagattttcagaaagcagaacgtaaaccaaacgcttgtaaagatgagcagggtcgtctgcgtgtaggtgctgctgttggtgccggtgctggtaatgaagagcgtgttgatgcgctggtagcggctggtgtagacgtgttgctgattgattcatcccacggtcattctgaaggtgttttgcagcgtatccgcgaaacccgcgctaaataccctaatctgcaaatcattggtggtaacgtagcaaccggtgaaggcgctaaagcgctggtagaagcaggtgtgaatgccgttaaagtcggtatcggccctggttctatctgtactacccgtatcgtgaccggtgttggtgtaccacaaattaccgcgattgctgacgcagtagaagcactggaaggaacagggatcccggttattgctgacggtggtatccgcttctctggtgacatcgctaaagcgattgccgcaggtgctgcatgtgtgatggtgggttcaatgctggcaggtacagaagaatctccgggtgaaatcgaactctatcagggccgctcattcaaatcctatcgtggaatgggttctctgggagcaatgtccaaaggttcttctgatcgctacttccagactgataatgcggcagataaattagtaccggaaggtatcgaagggcgtgttgcttataaaggactgctgaaaaacatcgttcaccaacaaatgggtggattacgctcctgtatgggtctgacaggctgcgctacgattgatgaactgagaactaaagcagaattcgttcgtatcagtggcgctggtattcaggaaagccacgttcatgacgtgactatcacgaaagaatcaccaaattaccgtttaggt

SEQ ID NO: 23892 - DNA, 291 bp, Xenorhabdus nematophilus
atgaaaattcgtccattacacgaccgtgttatcgtcaaacgtcaagaagttgaatctaaatctgctggtggaatcgttctgaccggttcagctgcgggcaaatctacccgtggtgaagttcttgctgttggccatggtcgcatcctggaaagcggtgatgttaaagctctggatgttaaagtgggtgatatcgttatttttaatgaaggttacggtgttaaagcagagaagatcgataacgaagaagtgttgatcatgtctgaaagcgatattctggcaattgttgaagcg

SEQ ID NO: 23893 - DNA, 891 bp, Xenorhabdus nematophilus
ttgtccaaccgtctgtacacaagcctgggagacgctgctgtcggtcgtttcagcgacggtgaagtcagtgttcaaatcaatgaaaatgtacgcggtggcgatgtattcatcatccagtccacttgtgcaccaaccaacgataacctgatggaattggtcgttatggtcgatgcgctgcgtcgcgcttctgccggacgtattactgcggtaattccttactttggttatgcccgtcaggatcgtcgtgttcgttcagcgcgtgtgcctatcactgccaaagtcgttgcggactttttgtccagcgttggtgtagaccgtgttctcacggttgacctgcacgccgagcagatccaaggcttctttgatgttccggttgataatgtatttggtagcccgatccttctggaagatatgctccagaaagggctggaaaacccgattgttgtttctccagatattggtggtgttgttcgcgcccgtgctattgctaagctgctgaatgatactgacatggctattattgataagcgccgcccacgtgcgaacgtttctcaagttatgcatatcattggtgatgttgcaggccgtgactgcattctggttgatgacatgatcgacacaggtggcacgctgtgtaaagccgctgaagcactgaaagagcgcggagcgaagcgggtgtttgcttatgcaactcacccaatcttctctggtaatgctgtagaaaacatcaagaactcagtgatagatgaatttattgtctgtgacacaattcctctgtctgatgaggtcaaggcgttgaacaaagttcgtactctgacactgtctggcatgcttgctgaagcaatccgccgtatcagcaatgaggagtcaatctctgccatgtttgaacac

SEQ ID NO: 23894 - DNA, 471 bp, Xenorhabdus nematophilus
atagacaggaagagtatttagatgagtgataatcatactctgcaaattgaagaaattttgaaattactgccacatcgctacccatttttactggtagaccgagttctggatttcgaaaaaggcaaatttctgcgagcagttaaaaatgtaacggttaatgaaccattttttcaggggcatttcccgggtaaacctattttccccggcgttctgatccttgaagcaatggctcaggcgacaggcattctggcattcaaaactgttggtacgctggagccaggagaattgtattactttgcagctattgatggcgcacgttttaagcgtccggttctgccaggtgatcaaatgattatggaagtagagtttattaaagaacgccgtggtgttgcgcgtttcagaggtgtagcgaaagtcgatggagaagtggcttgcgaagctgaaatgatgtgtgcccgccgccgtgaggct

SEQ ID NO: 23895 - DNA, 1374 bp, Xenorhabdus nematophilus
atgtcgcataatcctactgctactctcggtactgttcaggcaagtgccagtaatcgtgttcagctgagaagaacactgaccttatttcaggtagtcatgatgggccttgcttatatgcagccgatgactatttttgacaccttcggtattgtttccaaattgacggatgggcatgttgcaacatcttatgctattgcgttgattgctattttatttacagctttgagctatgggaaactggtaaaaagattcccgtcagcgggttctgcctacacttacgtacaaaaatcaatgaatccccatcttgggtttatggtaggttggtcatctttgttggattatctgcttatgccgatgatcaacatcctgctggcaaaaatttaccttcaggctattttccccggcattgatccgtgggttttcgtagtgggtctggcggtgttaatgaccgttttcaacttgagtggcattaatgttgttgccaatcttaacggtcttattgttgtagtacagattgctgttatggtggtgttcgtcggtttgttaatgcacggcatatataacggtgaaggtgcaggcacattatggagtgcccgaccatttacatcagaagaagcacaattaattccaatgattacaggggcaacgatactctgcttctcattccttggttttgatggcattacgtctttgtctgaagaaacgcctaatgcgggcaaggtgatccctaaagcgattttccttactgcattaatcggtggtgttatctttattgcggtatcttatttcctacagctctatttccctgatgtatcccggtttcaaaacccggatgaatctcagccagaaattatgttgtttgtcgccggggcattattccaggctattattctggtcttctcctgtgtcacggtaatggcttccggtatggctgcgcatgcaggtgtggctcgattgctctatgtgatgggacgtgatggcgtactgccagagaaagtctttgcttatgtccatccaaaatggcgcacgccttcaatcaacgttattctggtcggaattgttgcactatcaagcggatttttagacttagtcacggcaacagcactgatcaatttcggagcattggttgcatttactttcgtgaatttgtcggtaattgctcaattctatgttcgtgaacgccgtaacacgacgctgaaagatactatcaatttcctgcttctgcctctgtttggtgcaggaacagtgggtgtactgtggatgaatctggaagccagctctatggagttaggtttgatttgggggggagtaggtctgctttatatgttcttcctgacccgtagtttccgtcagcctatgccacaattcagtgag

SEQ ID NO: 23896 - DNA, 2688 bp, Xenorhabdus nematophilus
atgtcgtctaaattgaaaacggactgtgcctcaacactttccattaacagtgaaacttctggcagtaagacctaccattattacagtttacctctgttatctgagcaactgggtgaaatatcccgcctccctaagtcactgaaagttctgcttgaaaaccttttgcgtaatattgatggtgattctgttgttgaagatgacctgaaagcgctggtggcatggcaacgaagcggtcatgctgagcgggaaattgcctatcgtcctgcccgtgtattaatgcaggatttcaccggtgtacccgccgtcgtggatcttgctgcaatgagggaggctgttttaaggcttggtggcaatgtagatcaggtgaatcctttatcaccggttgatctggtgattgaccactctgtcatggtggataaattcggaactgagcaggcgtttgaagagaacgttcagattgagatggagcgtaactatgaacgctatttatttttacgctgggggcaaaaagccttcaatcgcttccgggttgttcctcccggaacaggtatttgccatcaggttaaccttgaatatttaggcaaggcggtttggtatgaaaaccgtgacggaagggattttgcctacccggatacattggttggtaccgattctcataccacaatgattaacggtctcggtgtgcttggatggggcgttggcggaattgaagccgaagccgcgatgctagggcagccaatttccatgctgatcccggatgtggttggtttcaaactgacaggaaaattacgcgaagggatcaccgcgactgatctggtgctgactgtcacacagatgctgcgtaaacatggtgtggtcggcaaatttgttgaattttacggcgatggtttggctgatttgccattggcagatcgggcgacgattgccaatatgtcgccggaatatggcgcaacttgtggtttcttccctgttgatgatattaccctgagttatatgcgattaaccggacgcagcgaagatgaaattacgctggttgaggcttatagcaaacagcagggattatggcgtcatgccggagatgagccaattttcaccagcagtcttgagctggatatgtctacggtagaagccagtttagcggggccaaaacgtcctcaggacagagtcgcgctgggtggtgttccacatgccttccagtcctcgattgatctggatattaatagaaagcaggggctgcaatcatctatccctgtgacagtagataatcagacattttctttgcaggaaggggcggtagtgattgcagctattacctcttgtactaatacttccaatcccagtgtattgatgacagccggcttacttgctaaaaaagcggttgagaaggggttacaacggcagccatgggttaaaacgtcactggctccgggttctaaagtagtaacagaatatctgaatctggccggattcatgccttatcttgaaaagttaggctttaatttagtgggatatggctgtactacctgtattggtaactcagggccgttacaggatgagattgaggctgcgattaaacagtctgacttgacagtcggagccgtcctttccggcaaccgaaactttgaagggcgtattcatccattggtcaaaactaactggctggcttctccgccactggtcgtggcctatgctctttccggtagtatgaaacgcgatctgaccagtgaaccaattgggcaggatcagcaggggcgtgatatctatctgaaagatatctggccgagcagtaaggaagttgctgaagcggtggaaaaagtcagaaccgagatgttccacaaggaatatagtgcggtgtttgacggcgatgaaaactggcaagcactggaagtcgaaagttcagctacttattcctggcagccggattcaacctatatacgtcttccgcctttctttagccatatgacacaggagcctgagccggtaacggatatccatcaggctaatattctggccattttgggtgattcagtaacaacagaccatatttctcccgccgggaatatcaaggcagacagtccggctgggcgatatttacaggatcatggcgtagcaccgaaagattttaactcgtatggttcaaggcgcggaaatcacgaagttatgatgcgtggaacatttgctaatattcgtattcgtaatgaaatggtgcccggtattgaagggggatatacgcgccacatcccgtcacaaagccagctggctatttatgatgcggctatgcgttatcaggaagagaaaaaaccgcttgccattattgctggtaaagaatatggctctggttccagtcgtgactgggcggcgaaaggaaccagcttattgggggtaagagtggttattgcggaatcttttgagcgaattcaccgttccaatctgattggaatgggggtattaccgctggagtttccacagggcatcactcgtaaaactcttaacctgactggggatgaattcattgatatcggcggattgaatgatataaagcctggtcagattattgttgtgaaaattacttaccctaatggggaggtaactcaagttaatgcccattgtcgaattgataccaatacagagctcgcctatttctataatggcggcatattgcattatgttatccgcaatatgttgaag

SEQ ID NO: 23897 - DNA, 1790 bp, Xenorhabdus nematophilus
aattggatgataaatggtaaatccttccaatttttcggcggaaaattcatccttgacgggttccatctcaaaattgggatcaccggatcaaaatgatcaaagctctggggtgtaatacgatatcactctatctaatgtggaattttcatgagctacctgatgggtcttttgatttctcatcgtcagacaaaaatatcgcacacttcatcaatctatgtgcaactaacaatatgtgggtattgttacgtcccggaccatattcttgcgcagaatgggattttggtggattaccaccacgtatgttagccgatccccagttccatgactcttcagataagttacaaatacgcggcaatttcccaaattacatgtcagccgtactaaaatggaatacagctctttataaacagatcattaaaggacggacgctgacctcaggtggcccaatcatgctgatagcgctagaaaatgaatatacctcttggagtccggacgatcccgctcacccaactgcgctggcatcacaatgggtaagtttaggctatacagagaagttttgtgtttgtgaaggctgggcgaacgctttcaaaaataataacattccactaccggccaatacggcatacgggctgacagctgaaggagatagtgtttcacatcataatgaagctaaacaatactatcagatcgcaagttttggtgcagaatgctatcccggctggatatgtcattggaccgaggaaaaacaaacaattaacatcgatacttttgcagatatagtcgcaacgctggcaaaagcaggttgttcatttgtcatttacgttgggcacggaggtactaactttggctttacggctggcagtaatggaaagttaatttcatcagccccagtgataacctcttatgactatggcgcaccagtatcagaaaatggccggcaaaatgcaaatttccaagttattaaagctgcctatgctgaaaatgcttcatatatagtaccttctaatccaattcctacgcctatccccagtattactgacggcgaaatctcgccgatatcgaacagccaattcgttttcagtgattttctatctaatgtcattccgaccattccaaaccccataccacagaccattgagtagatcgcgttgactcttaacagccaacaaccagccagtgctggtatttatccggctggcatcgctgtttatcaaacagagctacctaaatcaggttatgatctctctgtggaattcaatcggccacccgattttgcattggccttcctcaacggggttcgtgttacaagcgatgtattaacgacggtaaaagggggaaaaatatctcctgtaatttcattcaaaattgatgatgtgccgccaaattctatattacagatcgtctgtatgccattcggacgagcaaattatggtggtgatgaaatgagaacggatggacgtggcctttctagcaacgtaattctgaatggtgatatgctgacaaactggaagatgactctttatccgctattggcatcacaactggcgaaactgccttttggtatcaataagcccacgggtcctcgtccattttttgctaaagcaattcttactattgatattcctaaagacatgtatattgatatgtcctcatggggtactggctacgttttagtgaacggacacaatctcggccgttattggacgttggcaggccctcagacccggctatattgcccaggagtgtggttaaacagtggcagtaatacgattatcattttcgaatttact

SEQ ID NO: 23898 - DNA, 927 bp, Xenorhabdus nematophilus
gtaatgagtgtggcaaaactagcagtgatgggcagtattaatgtcgatcatatattgaacctcaaattttttcctcagccaggagaaactgtacagggaaaacagtatcaggtggcattcggcggaaaaggagcaaatcaggcggttgctgctggtcgctgtggagctgatattacatttattgcctgtgttggtcaggacgatgttggtaaaaatatctgccaacaattggggaaagataatatcaatacttctgcaattaggatgatagaaggtgaatcaactggtgtcgcactgatttttgttaatcagcagggcgaaaatattattggcatcaatgcgggtgcgaatggatcacttacacctgaatgtatccatcatcatgaagtagtgatcaaagaagctgatgctctgttgttacaacttgaaataccgttgaatactgtcctactggctgcggagatggcgaaaaaacatctaactaaagtgatcctgaatcctgctccagcacaagaagtatcagataagctactttctttggtggatattatcactcctaatgaaacagaagcagagcatctgaccggaattgcaataacagataatactgaagcaggaaaagcagctcagtttttgcatgatagaggtattgaaacagttatcatcacgttgggtagtcgcggagtatggcttagcgaacaaggtaaacaaggaaaagtgatttctgggtttccggtaaaagctattgatacgattgctgcaggagatacatttaatggagctttggttacagggttgttagaaggtaaagacattttgtctgcaattcgttttgctcatgcagcagcagcgatagccgtgactcgtcgcggtgcacagccttcaattccatggcgaagtgaaattgatgcatttctggctgaacag

SEQ ID NO: 23899 - DNA, 1407 bp, Xenorhabdus nematophilus
atgaaaaaaaccaaaattgtttgtactatcgggccaaaaactgaatccgaagaaaaactgaccgaactgcttaactcaggcatgaacgttatgcgcctgaatttttctcacggtgactacgaagaacatggtcagcgtattaaaaatatccgctcagtcactgcaaaaatcggtaaaaaagcagctatcttactggatactaaaggccctgaaatccgtaccatgaagctggaagatggcaacgatgtttccctgacagctggccagactttcacctttacaactgatcaatccactatcggcaatcaggagcgcgttgccgtaacctattcaggcttacccgccgatttatctgtaggtaatacagttttggtcgatgatggtctgattgccatgacagtaaaagagatcgccggcactgaagttatctgtgaagttctgaacaacggtgacttaggcgaaaacaaaggcgttaacctaccgaacgtttctattaacctgcctgcgctggcagagaaagataaacaggatcttatctttggctgtgaacagggtgttgattttatcgcagcctctttcatccgtaagcgttctgacgttctggaaattcgtgaacacctgaaagctcatggtggtgaacatatccagattatttccaaaattgaaaatcaggaaggtctgaacaattttgatgagatcctggaagcctcagacggtatcatggttgcccgtggtgatctgggtgttgaaatcccggtagaagaagtcattttcgcgcagaaaatgatgatagagaaatgtaactctgcacgtaaagttgtcatcactgcgactcagatgctggattccatgatcaaaaatccacgccctacccgtgccgaagctggtgatgttgccaacgcaattttagacggaactgacgcagttatgctttctggcgaaagtgcgaaaggaaaatacccagtagaagccgtttccatcatggcaactatctgtgaacgtacagatcgcgttatgggcagccggattgaaaataccaaaacacagaaattgcgtgtaactgaagcggtttgccgtggcgcagtagaaattgcggaaaaactggaagcccctctgatcgttgttgcaacttatggcggtaaatctgcaagatctgtgcgtaaatacttccctaatgcacggatcctcgcattaactaccaatgaaatcactgcccgccagttattgctggttaaaggtgtttctacacaggtagtcaaagaaattgcctctaccgatgacttttaccgtatcggtaaagaagctgcattagccagcggtatggcaagtaaaggtgatatcgttgtgatggtatccggtgcattagtaccaagcggcacaacaaatacatcttctgttcatgtgctg

SEQ ID NO: 23900 - DNA, 945 bp, Xenorhabdus nematophilus
gggaattttatgcgagtccaaaaaccgatcaactcaggatttagttcatcatcgacagcctcggatgtacttaaaggtattgatattaaaggtaagacagcttttatcacaggtggacattcgggactgggatatgaggccaccaaagcactatcagaagcaggcgctcatgtggtcgtgggggcaagggatatattgaatgcttctaacgccctaagcaaactaagcaatattacagttcttccacttgatctttccgacattaattctgtcaggaaattagcgaattatatctatgctaatagatgtctctttgattatgtgatttgtaatgcaggcattatggcgtctccagaaaaacgggttggcccgggatgggaatcacagtttgccacaaatcatgttgggcattacgtactggtaaatctcatatggaataatattcgagtaggagggagagtagtgtgtgtttcatctgctgggcatcataactctccaatcagatgggatgatattcaatttactagcggttatgacaagtgggtggcatatgcacagtctaaaactgcaaatatactttttgcattacagctggatgaatatgggaaagataagaatatcagggcgttttctctgcatccggggaaaatatttaccccacttcagcggcatttgtcttatgaagagatggaaagcgagggatggatggataaggatggcaatccaattgacccaacctttaaaactccggcacaaggtgctgcaactgaggtatgggctgcaacaagctcagctttgaatggactgggagggctttattgtgaagattgtgatgttgccgggcttgcatcagattataaagagccttttgccggtgtttgtgagtacgcaattgatctatcagaagccttaaagttgtggaacttcacagctaatctcactggt

SEQ ID NO: 23901 - DNA, 744 bp, Xenorhabdus nematophilus
gagatgaacagcttcaagggaaaaaccgtctgggtgacgggtgccgggagcggtatcggttaccgcacagctctcggctttcacgaagcaggagctaaggtttttggattcgatctcaagttccctgattcaatgccgtttgagacgctcattctggatgtcagtaacgattgtgcagtgcaaaaaatctgccctccactgctgaaggaaaacgggctggatgtactggttaatggtgcgggaattttgcgtcttggctcagcagaaacattaagccgtgaagactgggaaagttcaattaacgttaatgctggtgcagcatttaatctgtttaaaatactcattccacatttccagcgtcagcgcaatggtaatatcgtttcgatagtctctaacgccgcccatgtaccgcgcgttaatatggcagtttactgtgcgtctaaagccgcaatgcgcagcttgtgcctgagtgtggggcttgaactggcaccgtttggggtacgatgtaacattgtttcgccgggttccacgctaaccccaatgctggaagggatgctcaatggtgacatagcgcatcagcgtttgattcacggcattaccgaacaatttaaactaggcattccactcgggaaaatcgcacaacccgatgaaatagccaatgtcattctgttcttagcttctgagcaagcaagtcacatcacgttacaggatattgtcattgatggaggtgctacgcttggcgcc

SEQ ID NO: 23902 - DNA, 1579 bp, Xenorhabdus nematophilus
ttcaaccgttggccccaggatctggctgaacgctatcgcttgaaggggtattggattgaccgtccattgagcgatattcttgatattcactgtgagaacgatgccaaggcactgttttgtggtgagcggagctggaactaccgcgagcttaatgagtcagtaaaccgattagccgcttctctgcaccgacgcggcgtgcgtcagggacaaactgcgctggttcagctcggcaacgaggcggaattttatatcgtcttttttgccttattacgtctgggtgttgtacctgttaacgcgctttatagtcatcaaagcagcgagttaaccgcgtatgcactccaaattaagccccaaatactcattgccgatcgccaacatcgccagtttcatgatgatgttcttattgatcgtctaatcgataaatgcccagaactgaatatagtcgtgcttcaccatacagattcagaccactcgctttcacgtctgatatcggaagagccgggcgacttcactccaacgccaactccggcagatgaggtcgcatttttccagctttccggcggcagtactggcacacccaagctgatcccacgcacccacaatgactattattacagtatccgcgccagcaacccaatctgcaacgtaagcagtaaaacccgatatctctgtgcactgcctgctgcacataactaccctatgagttcaccgggagctttgggcgtttttctatgcgggcggtcaggttattctcgtccccgatccaagtccggatggatgtttcccagctatagaacgtcatcagatcaatcttgtcgccctagtaccaccagcggtcagcatctggctggaatataccactctcagaggccacgccgacgaactcgccagtctggaggtcatgctggtcggcggtgctcctctgggagaaacactggccagacgcattccagcagagctgggttgccagctccaacaggtatttggtatggcggaaggtctggtgaactacacccgactagatgatgacgatacacatactttcaccactcagggtcgccccatcagcgaggatgatgagatatgggtcgcaagtcaggaaggtcttccggtaccgctcggagaaccgggattgttgatgaccagaggcccatacacttttcgtggatattaccgaagcccggaacataaccaaacggtgttcgacagccacggattttattgctctggtgacgtagttattcagcttccaggcggatatctgaaagtcgttgggcgcgagaaggatcagataaatcgtggtggcgaaaaaattgccgctgaagaggttgaacaccttctgctgcgccatccagcagtggtatacgccgcattggttgctattcttgaccctctgatgggtgaaaaaacttgcgcatatgtagtgacgcgcgagcatgaatcggtaaaaccagtggtgttccgtcgctggttgcgagaacagggtatcgccgactacaaaatccccgatcgtttcgaaagcctgcctaaattaccgcttactccggtaggaaaaattaataaacaggcgctacgtgca

SEQ ID NO: 23903 - DNA, 753 bp, Xenorhabdus nematophilus
atgaagcttatcaggctcccagccctttcagataactacatttggttactttgtgacgagaacaggcattgtgtcattatcgatcccgctgaatcacagcctgttatggatactttagcagctaaccaacttattcccattgctatcctgttaacacaccatcaccacgatcacgttggcggtgttgctgggctacttaagcaatatccaacattacctgtatatggcccggaagagactcaaagtaaaggggcaactcacgttgttcatgaaaatgatcttattgtgacaggtaatttttcttttcaggttcttgccctaccgggtcatacccttggacatattgctttctatcaggccccttatctattttgtggggataccttgttttcggcgggttgtggcaggctcttcgaaggtaccgctgaacagatgttttcttcccttgagaaaattgcctcgctgcctgatgaaacgttgatctgttgcgcccatgaatatactgccgcgaatatgaaatttgcgctggctgtattacctgaaaatcaggctattaacgattatcataagaaaattatcgagttacgtgaaaaagatcaggcaaccgtccctaccacattgaaaatagagaaaaaaattaacgtttttctaaattgtcacgatattgatttacaaaaaaatatcggtattaaacctaattcaataccactttcttctgtttttcagcaattaagggcttataaagatcgattt

SEQ ID NO: 23904 - DNA, 1707 bp, Xenorhabdus nematophilus
atgcgtatattacttccatttctcgcactatatcgccgccactggtttctcatcagcttaggcatggttctggcaacactaactctgttagccagtattggcttacttacactgtctggctggtttttggccggtacggctgtggcgggctttgccggaaaatatacctttaattacatgctgcctgctgcgggtgtccggggcgccgcaattttccgtactgccggacgttatggagaacggctggttagtcatgatgctacttttcgagtgttggcccatctgcgggtatttacctttcagaagatcctgccactttcgccgggagggattgcccgttttcgtcagggggagctattaaacaggattgtggctgatgtagaaacattagatcacctctatcttcgtgtcctgtctccattgcttgctgcactcgctgtgattgtagttctgacattaggtctaggctttcttgactggactctcgcctatactctcggcggtattatgctgggattattactgatcttaccttttgtgttttatcacacaggtaaaccttatggcaggaatatcacagcattacgtgggcagtatcgaactttactcaccagcacattgcagggtcaggcagaattaaccgttttcggtgctcttaaacgtttccgccagacaatgtccgaagttgaatatcaatggctaaaaagccagcaacagcaagccaacctgaccggactttctcaggccatcatgatttttgctactggcatgacggtaacattaatactgtggctggcagcagcagatgtaggcggaaataatcaacccggtgcattgattgccctgtttacattctgtgccctttcagcgtttgaatctctgggaccagttactgttgcattccagcacatggggcaggtgatctcgtcagcaacccgcgtttcccagctaatgcatcagaaagcagaagtcatctttccggctgacgggccaaaaagcacagacaatctcagccttgagataaaaaacatagaattcacttatcctaaccagcctatgcctgtattgcagaatatttcactgtctcttcaggcaggtgaacatatcgccttattaggtaaaactggctgcggtaaatcgactcttttacaattattaacccgggcgtgggatgttgataacggagaaattctactcaaccaacagcctatttctctttatgatgaagccacactgcgatcaatgatatcagtcgttcctcaacggatacatgtgttcagccatactctgcgggaaaacctgttgatggcaaaaccaggtgccccagatgaagaattagaaacggtattgcaacaggttggcttaggaaacttgctagaaaacaatgaaaagctaaactgttggatgggcgaaggcggacgtcagctttcaggtggtgaacaacgccgcttgggtattgccagagccttactgcataactcaccactcatgcttctggatgaaccaacagaagggcttgatgcagataccgaacaacaaatcctggcactattgcgccatagttgtcaggataaaacacttattgtaattacccatcggttaacaggcttacaacacatggatcggatctgtgtgatggatgggggacgtatcattgagcaaggacaacacgatgtgttattgtcccaacaaggacgctattaccaa

SEQ ID NO: 23905 - DNA, 1626 bp, Xenorhabdus nematophilus
attcttcaggcgcttatcatggatcatgttccccgtgaaaatctcatcagccaatttgcgatgctactggcttcttttaccctgcgagcgattgtcagtgctattcgggagcgtatcggctttatctgtggcaaggttgtacgtcagcaaatccgcagcatggttttggataagctgacccaattagggcctgtctgggtaaagggtaaacctgctggcagctgggcaacgattatcctggaacagatcgaggatatgcaggatttttattcccgctatttacctcaaatgaccctcgcagccactattccagtgcttattctgatgacagtatttccaatcaattgggctgccggtgttattttattggtaacagcacctttgattccgctttttatggcattagtcggattaggagcagcagatgctaaccgacgcaattttactgcgctcagtcgattaagcggtaattttcttgatcgtttgcgtggtctcgaaacattgcgcttattccatcggggaaaagctgaagttaagcaaattaccgaatcaaccgaagatttccgcctcagaacgatggaagtgctgcgcatggcgtttttatcttctgcggtattagagttttttgctgctgtttctattgccgttgtcgctgtctattttggtttttcttatctgggagaattgcattttggcagttatggccttggtgtcacattatttgccggttttctggcgcttatcctggcaccggaattttttcagccgctacgtgatctgggcactttctaccatgctaaagctcaggctgtcggggcagcggaatcacttttcacgctattaaccagcggtgaggaacatgcctcatacggcggtaaaaaaatcctgtcagataaaaatgctgttagtattgaagcaaatgagctggaaattttgtcgcatgatggtcatcgtcttgccggccctttgaactttacggttgagcaacatcagcgtattgcattagtgggtaaaagcggtgcggggaaaagttctcttatcaatgtcttactcggttttcttccttatcgcggctcactaaaaatcaatggaagtgaactcaatgaacttgatctcgacaaatggcgtgaacaattaagctgggttggacaaaaccctcacctgccagaacagaccatacttgataatattcgtctaggtcagtttgatgcgacacaggaacaaattcagagtgtcatgcaacaagcctatgttacggagtttgtctctgaactgcccgatggcataaacaccgttattggtgataatgcagcacggctatctgttgggcaggcacagcgtattgctgttggcagggctttattgcatccctgccagcttctgctgctggacgaacctgccgccagtcttgatgctcacagtgagcaacgggtaatgacagccttgaaccaagcatccagtcagcaaaccacactattggttacacacttactggaagaaacgccggaatatgatcaaatctgggtgatggaaagtggactcattatcgaaaaaggcaactatgaaagcctgagacaatctcaaggcgcattttcccgtctgttgtctcatcgcagtatggagctt

SEQ ID NO: 23906 - DNA, 459 bp, Xenorhabdus nematophilus
atgtatcaccattatctgaatactccagaaggttttcctaaaccttatgtgcacgtcactgctaatgatgaaggcgttactagtatttattttgttaatgaaaagaaagaattagaatctaaaaatgcgataactaagcagtgtgtaaaagagttacaagaatattttaaaggaaagcgagatacatttacggttcctttaagtatgcagggaactgaatttcagcagcgggtttggaagcagctctgtaatatcccatttggtgagatgtggagttacaaacaattagcactaacactgggttcggtaaattattgtcgtgccgttggtatggcgaactcacgtaatcctatttcactgattgtcccctgccatcgggtaattggccatgatggtaagttagtcggatatacaggggggctgaatattaaggaatggctgctggagcacgagaagaaa

SEQ ID NO: 23907 - DNA, 1332 bp, Xenorhabdus nematophilus
atgagtaaccgtaaatattttggtaccgatggtatccgtggcaaagtcggcaacagcccgattacccctgattttgttttaaaacttggctgggctgcgggaaaagtactggcgcgccatggttctcgcaaaattattattggtaaagatacccgtatttctggttatatgctggaatctgctctggaagcaggcctggcagctgccgggttatctgcctcatttaccggtccgatgccaacacctgccgtggcatacctgacacgcactttccgtgctgaagccggaattgtgatttctgcttcccataacccttactacgataacgggattaaatttttttccattgatggcaccaaacttcctgatgatgtggaagaagcgatcgaagccgaaatggaaaaaccactgacttgcgtagaatccgctgagttagggcgtgctaatcggattgttgatgcagctggtcgttatattgaattctgtaaaggtacattccctagtgaacaaagcctgaatggattgaaaattgtactggattgcgctaatggcgcgacttaccatattgcgccaaatgttctcagagaactgggtgctgaggtgatagctattggctgcgagccaaatggcattaacatcaatgaagaatgcggtgcaacagatgttcgcttattacagaagcgggtattggaagaacaggctgatgtcggtctggcatttgatggcgatggtgaccgcattatcatggttgatcatctgggccataaagtggacggagaccagatactttacatcattgcacgtgaagcattacgccaagggcagctgcgtggcggagctattggtactttgatgagtaatatgggactggagctggcattgaagcagcttggcattccatttgaacgtgcaaaagtgggtgaccgctatgtactggaaaaattacaggaaaaaggctggcgtctgggcgcggaaaattcaggccatataattttgctggataaaaccactacaggtgatggcgttgttgctggtttgcaggtattgagcgcaatggtacgtaatgacatgaccctgcatgatttgtgtagtggcatgaagctgttgcctcaggtactggttaatgtgcgttttgcgggcaataacgacccacttcaatcagaacaggtactggaagtagttaaagaggttgaaaacgagttaaatggccgaggtcgcgttctgctgcgtaaatcaggtactgagcctctgatccgtgttatggtcgaaggagaagacgaagagcaggtcactgcattggcccatcgtatcgctgattcagtgaaagggatg

SEQ ID NO: 23908 - DNA, 1944 bp, Xenorhabdus nematophilus
atggcgaaaaacctgattctctggttagtcatcgcagttgtcttgatgttattgttccagagttttggtcccggcgattctagtggtcgtagggtggattactctaacttcatcagtgagttatcacagaatcaaataagtgaagtacgtatttctggtcgtgacattgatttcactaagaaagacaacggtggaaaatacagcacgtatatgccagttccagatgagaagctgctggatacactgctaaacaaacaggtaaaagttgttggtgaaccaccagaacaacagggcctgttagcgtctatctttatttcatggttcccaatgctgctgctgattggcgtttggatcttctttatgcgtcaaatgcaaggtggtggcggtaaaggagcgatgtctttcggtaaaagcaaagctcgtatgctgacggaagatcagatcaaaacgacatttgcagacgttgctggttgtgacgaagcaaaagaagaagtgggtgagctggtggaatacctgcgtgaacccggccgtttccagaaactgggtggtaagataccgaaaggcatcctgatggtagggcctccgggtacaggtaaaaccctgctggcgaaagcaattgcaggtgaggctaaagtaccattctttaccatttctggttctgacttcgttgaaatgtttgttggtgttggtgcttcccgtgttcgtgatatgttcgaacaggcgaaaaaagccgctccttgtattatttttatcgatgaaatcgacgcggtaggccgtcagcgcggtgctggtctgggtggtggacacgatgaacgtgaacagacactgaaccagatgctggttgagatggatggcttcgaaggtaatgaaggcatcatcgttatcgctgcaactaaccgtcctgatgtactggaccctgcactgctgcgtccgggccgttttgaccgtcaggtggttgttggtctgcctgatgtacgtggtcgtgaacaaattctgaaagttcacatgcgtcgtatcccgctggataccgacattgatgcttccatcattgcccgtggtacaccgggattctcgggtgccgatttggcgaacctggtgaacgaagctgctctgtttgctgcccgtggcaacaaacgagtcgtttcaatggtggaatttgagaaagccaaagataagatcatgatgggagcagaacgtcgctcaatggtcatgacggaagagcagaaagaatctaccgcttatcatgaagcagggcacgccattattggccgtctggttcctgaacatgatccggttcataaagtgacgattatcccacgtggtcgtgcgttgggtgtgactttcttcctgccagagggtgatcaaatcagcgccagccgccagaaactggaaagccagatttctactttatacggcggacgtctcgcagaagagatcatctacggcccagagaatgtttctacaggtgcatcgaacgatatcaaagtagcaacatctattgcccgcaacatggtcacgcagtggggcttctcagaaaaactggggccattactgtatgcggaagaagagggtgaggttttccttggtcgttcagttgctaaagcgaaacacatgtcggaagatactgctcgcttaattgatcaggaagttaaggttctcgttgaccgcaactaccagcgtgcacgtcagattctgatggataatctggacatcctgcactcgatgaaagatgcgttgatgaagtatgaaaccattgatgcgcctcagattgatgacctgatgaaccgtactaccgttcgtccaccggcaggttgggaaggcgataacagaaatggcggtaatagcaataatagtaataaccgtcaggatacatcgtctcagcagcagtctgcgaaacctgcggatggtaacccaaccgcataacctactcaaaccaaaggcaac

SEQ ID NO: 23909 - DNA, 597 bp, Xenorhabdus nematophilus
ataatgcgcatcattgcaatacggcatgcagaaactcaatggaatatagaaagaattcttcagggacgtcttgatagccctgtgactgaaaatggtttccgacagataaattcattattatcagcaataaaagattttcccatcagcaaagtgatttcatcttcttccggtcgagcctgtacgacaggtcaggttttagcagattatttcggttgcaggatggaaattaatgaaaatttatgtgagcaaaattttgggatattagagggattgccctttggacaggccgattatcactaccccaacattacatcacggctttttgccggagatccaacggtaactatacctgaaggcgaatctaccattgaagtagcgcaaagagccatcagttgcatacaaaatctggcaacaaataatagtaatgctacgatatgcttggttacacatggccgtactctgcaatccctgttatggcaactaaaaggcggtaatttacaagaggaaacaacacgatatagtcaccaaaattgtagttactctgttattgatgttaaaaatgagagaattcatgtggttcgctggggtgttgcaacg

SEQ ID NO: 23910 - DNA, 1041 bp, Xenorhabdus nematophilus
atgtacaaaacagatgagctacgaacccgccctattgataagctgataacacctaaaaccctttctgagcagtatccgatatcagaaaaaatacgccagaatgtgacgctgtcacgaaaacgaattgaagatattcttaccggtaaagatcaacgtttactggttattatcggtccctgttctattcacgataccgatgctgcccttgattatgcgtcacgcctgcaagtattgcgtgaaaaatatcagcatagtctggaaatcgtcatgagaacctacttcgagaaaccgcggactgttatcggctggaaaggattaatttcagaccctatgctggacggttcctgtcaggtcaataaagggatctcacttgcacgtaatttattaattaatatcaatgaattgggaatgcctaccgcgacagaatttctggatatggtgaccgggcagtatattgcggatttaattagctggggcgcaattggtgcaagaacaactgaaagccaaatccatcgggaaatggcttccgccctctcgtgtcctgtcggatttaaaaacggtactgacggcaatactcacattgcgattgatgcaatacgtgcagcaagtgccagacatatgttcctgtcaccggataaagacgggcagatgacaatttaccaaaccagtggcaatccctacgggcacgttatcatgcggggcggaaaaaaacctaattactacgctgaagatattactgcaacctgtcagaaactgcgtgaattccgcttaccggaaagactgatcattgattgcagccacagtaactgccagaaaatccaccgtcggcaactggatgtcgccagagatatcagccagcagcttaattctggttcaacagccatcgctggtgttatggcggaaagctttttagttgaaggctcccaaaaaatcatgttgggagaacctctgacctatggacaatcgattactgactcatgtcttagctggcaggatacagaagagttccttcatatactggccgaagcagctaaaaaacgt

SEQ ID NO: 23911 - DNA, 1585 bp, Xenorhabdus nematophilus
ttgaatgaatatgacggcaatgcattatcacctattttatttctaaaaagagccatattaagtaatggtgattaccttgcggtaatagatggagagcaatgttgtcacatggcgacaatatggagaacgttgtgaaagagttgctgtggcacttcagcaaatggggattggaaaaggctgtgttgtatctgctttattgcctaatattcatgaattgctggaactgcactatgctgttcccttgtctggcggaatactgaatgccttaagtatcaggacagatgcagctacactgaattttatctttgaaaaaattaatcccacaatattaattatagataaaaactaccttgcattactggatggtgtttcctttaaaaacccggtcaaaattgttgtcattactgaaaataatactcctctaccagaatcagcgttggatttgattagctatgagtcactgatatctgagtacccttctgaaaccctgaatttttatccgattgatgaacaggaagccatcagcattaactcgacttcgggaaccagtggcacacctaagttagttgtatactcacaccgtggcgcataccttaatgcaatttcgaatatcctggactgggatatgcccaaatacccgatttatttatggacactgcccatgtttcactgcaatggaaggtgtttcccctggactattgcggcacgggcaggcactcatgtctgtatacgcaaatttgatgcacagaaagccatacaaattatgctgaagcatcaggtgacacactattgtggcgcgcctatcgtgcattattccttaggacgggaagcacaaaagctcggcatctctttcaacaacaatgtctatgggttgattgccggcgccccaccaacagagaagatgttttccctgcttgatgcagccggtatcagagctacccacgtttatggcctgacggaaacttatgggccggtcgttgtttgtgaagataaacccgattgggccacactgccaaaatcagaaacaattttaaagaagatgcgccagggaattgtttccaatttacagggggaaatcagcgttattgatgaaaataacgggctggcagtaccttttgatgggcaatccattggtgaaattgctattcggggtaatattgttgccgcttacggccctgtcgatcgagtcacattcgatatgacaagtcagtggttttttaccggggacttggctgttattgacagcgatggttatataaaaattatcgaccggaaaaaagatattattatttccgggggtgaaaatatttccagtcttgaactggagaatgcgctgtcgagttatcccggcgttctggctgtggcggttgtggcaaaacctgatgaatactggggtgaagttcctcatgcgtttattgaaattgatgataatacctcaattactgagcaggaactggatgattatctccgaactattgttgcacgctataagcgccccaaaggttatactttttcagctttaccacgtaacgcaagcggaaaaatactcaaagagacattaagaaaactcgctaataatttataa

SEQ ID NO: 23912 - DNA, 723 bp, Xenorhabdus nematophilus
aatttaaccggaaaagttgcatttatttctggaggaacaaaaggtattggcaaaggaattgctcaggtatttaagcgggtgggtgcaattacgatcatttcaggtacggataaaacgaaaggaatgcctgtagctgaagaacttggagtggattttatcgcccttgatgtaactgatccctctgcatgtaaaaatgtgattaatgaaattgtcgaaaaatatggcagactcgatattctttgttcaaatgcgggtatttttccacaacacaatattaaagatatgacggttgaagattgggatttagtctatagcgttaacctgaaaggcacatttttattgactcaggctgcactgaatgtcatggaaaaacagcagtatgggcgcattgtgattacttcatctatcaccggagagattgtaggaatgcagggctatagccactatggtgccagtaaggcaggccagctcgggtttatgcgcagtgcggcattagaatatgcaaaacaaggaataacaattaattccattatgccgggtatgattatgactgaaggcttaatggcatttggtgaggataatctgaaacagattgaaacagtaattccaatgggcgctttgggatcaccagaagatattggttataccgcttgtttccttgcttctgatgaagcgaaaaatatcaccgggcagacaattgtggttgatggcgggcaggtatta

SEQ ID NO: 23913 - DNA, 963 bp, Xenorhabdus nematophilus
attgcagcgctaggaatttggcatccttcaactgtagttgataataattggtttatagagtattacgctgaacaaggtattgatgttagaggattactgaatagtcttggttataaaaaccgttatcttatccgtgactcatctgatacaacactgacaatgtcagttgcagcttctaataatgctatccgacaactcggttgtcaggctaatgatctggatttagttgtatttgcttcacagacaccagaatatcttattccttcaacagcgctcaaaatacatcatgccattggaggcggggaaagagcctaggcgtttgacattaatgcaaattgtgcagggctattagtagcggtagaaacggtttccagagtaatgatggtgcacccttcctgtcagcttgcactagttgtaggtggggattatcttggcgctcacagtagtcattcacctgtctatcattcatgtttttctgaggctgctgttgctgttattcttcataaaactgaacaaggaaatggctttatagattcagaaaatcggatacaaacttcagtaattaacaattcactttttccagagtgtggattatctaatattcatcaacataatatttcagcacaagtgaaattcacaccttttgatgattccatttgtatcgatgttgcagtcggatcaatacaattattactttcacgaaataatttaattattgaagatattaagggatttatgttttcacagttttctataagtaacattaggctactttgtaaagtccttggcgtggatcagagtaaggcattatttattggtgataagtatggttatactgcgactaatagtccatttgttgcactttatgaagcgttggaaaggaaagaaattgcacgaggtgacttaatcgttttttggtcggttggtgctggttggcaaagtaccgctattttgatggagtat

SEQ ID NO: 23914 - DNA, 1431 bp, Xenorhabdus nematophilus
caggcgcccaaaaatctgcgtcgtgagctaaaagcacgacatatggcgatgatagccattggcggttcaattggtacggggctatttgttgcttccggagcaacaatttcacaggctggccccggtggagccctgctttcatatgcgctgatcggcctgatggtctatttcctgatgaccagtctgggtgaattggctgcttacatgccggtttcagggtcattttccacttatggctcaaagtatgttgatgaaggcttcggtttcgcattgggctggaactactggtataactgggctgttacgatcgcggttgaccttgtcgctgcccagttggttatggggtactggtttccggatgcaccgggatggatatggagtgccttgttcctcagcctgattttcctgctgaatttcatctcagtaaaaagctttggcgaggcagaatattggttctctttgattaaagtctctacggtgattgttttcattatcgttgggattttaatgatcgtcggtattatgaaaggtgcagaaggagcagggtggcataactggactataggtgaggcaccatttgctggtgggtttgcggccatgattggggttgccatgattgtcggtttctcatttcaggggactgaactgattgggattaccgccggagaatcaaaagatcctgccaaaaacattccccgtgctgtgcgtaaagtattctggcgtatcttattattctatgtattcgccattttaatcattagcctgattattccttatactgacccaagtttgttaagaaatggcgtaaaagacatcagtgtcagccctttcacgctggtttttgaaaacgcaggtctgttgtcagccgcagcggtaatgaacgccgtgatcttaaccgcagtgctttctgccggaaactcaggcatgtatgcttctacccgcatgttatttacattggcacgggaaggtaaggcgcctaagatttttggacatttgtcaaaaggcggtgttcctcgtaatgcactttatgccacaactgtggttgccggattatgctttctaagctccatgttcggtaaccagacagtgtatctgtggctgttgaatacctcgggcatgactggatttattgcatggcttggtattgcaataagccattatcgtttccgtaaagggtatgtcgctcaggggcgtaatatcaacgaactgccctatgtctccggctttttccctgtcgggcctatttttgcctttgttttgtgtctattgatcaccttaggccagaactatcaggcatttttgcaggatacgatagactggtacggtgttacggcgacttatattggtattccgttattcttgctcatttggtttggctataaactgaaaaataaaacacgtttcgtcaaatacaatgagatggactttccg

SEQ ID NO: 23915 - DNA, 981 bp, Xenorhabdus nematophilus
agccgtgcgtggcgtgaaaatgatcactggatggtagaagccaaagatctcgtcaccggtgagagcaaaacatggcgggcaaaaggtctggttaacgcaactggcccgtgggttaagaatttctttgataatggcctgcaactgaaatcaccttatggtattcgtcttatcaaaggcagccacatcgttgtcccacgtgttcatgacgaacctcaggcttatatcctgcaaaacgaagataaccgcatcgtgtttgtgatcccgtggaatgatgaattctccatcatcggcacaacggatgttgaatataaaggcgatccaaaagacgttaaaattgacgatcaagagatcgattatctgctgaaagtttataacgaccatttcaaaaaacaacttaaccgtactgatgtcgtttggacttactccggtgtacgtccgctgtgtgatgatgaatcagattcaccacaagccatcacccgtgactacacactagatgtacaggatgagcagggccagactccgttgctatccgtcttcggcggcaaattgacaacttaccgtaagctcgcagaacatgcgatggataaactagcacagtactatccaaacgccggtcaggcgtggacgaaaaacggtaaattgcccggcggcgagctggaaggccaagaccgtgatggatatgcccgtttacttcgccagcgttatgactggttgccagaaggcattgcgcgacgttattcccgcacttacggtagcaacagcaatatcattctgggtgatgcgaaagaactggcagatttaggtgaattcttcggttatggactgtatgaagctgaactgcgttatctggtcgaacatgagtgggttactcagctggatgatgcgatctggcgccgtaccaaactaggtatgtggctgacagatgagcagaaacagcgcgttgctgattggctggcacagaacgttaaatcagcataatca

SEQ ID NO: 23916 - DNA, 387 bp, Xenorhabdus nematophilus
atgagtcatgtacccgttgaattaaaatataccgagtcacacgagtgggttcgttctgaagggaatggcgaatacaccgtgggtattaccgaacatgcccagcagttattgggcgacatggtgttcattgacttacctgaaatcggaatgcaggtaaatattggtgatgattgcgctgttgttgaatcagttaaggctgcttctgatatttatgcaccactgagtggcgaagtcattgctgttaacccggctctggaaggctcgccggaattagtgaatagcgagccttataatgatggctggttgttccgcatcaaggtgactgatgaaagtaaattgtccgagctgcttgatgcagaaaaatatcgggcattactggtagaagaa

SEQ ID NO: 23917 - DNA, 594 bp, Xenorhabdus nematophilus
atgattagtctttatactgacagttcccctaacggatttaagataacgattgctctggaagagcttgagcttccatatgtagtaaaccatgttcatattgagaaaggtgaaaacttactaccagaatttttacagcttaatcctcatggccgtattcccgttttgtctgacagcgagacaaatacgactatttttgaatctgcggcaattcttctttatttagcggataaaacaaataaattacttccttctgagcataatgcccgttggcaggcgattcagtggctgatttttcatgcatccagtgttggcccaattataggtcagagagttaattttgaaatttttgatgagggaaaaaacaaagaagccactgagcgctataagaagctgacagagcgggctttttcaaccatggataatcatttagccaataatttatattttggtggaaaagagtattcaattgctgatatcgcgaattttggctggacgcatattgcacgtattatcaactttgattttcaccattataaaaacttaagcgaatggcatcatcgaattgcagccagaccagcagtgcaacgtggaatt

SEQ ID NO: 23918 - DNA, 966 bp, Xenorhabdus nematophilus
ggccgggtgattcaggaactgctttttggaagtaccagtgccatcgttactgaaaaacgtgcccgtaccgtacaaagcccaggcggaacaggcgcactgcgtactgccgctgattttattgccaagcaaactaatgccaaacgtgtttggatcagtaacccaacctggccaaaccataaaggtgttttttccagcgcaggtttagagatccgcgaatataactattacgatgcagaaaaacacgctctgaatttcgaaggcatgctggcaagcctgtctgaagcacaagcgggtgatgttgttctgttgcacggttgctgccataacccgaccggtatcgatcctactccagaacagtggcaaaaactggcagatttatctgcggcaaatggctggctgcctgtattcgatttcgcttatcagggctttgctaaaggtctggatgaagatgcggaaggtctgcgcatttttgccaaaaaccataatgaattgatcgttgccagctcttactccaaaaactttggcctgtacaatgagcgtgttggtgcctgtactattgttgcagcagacagcgataccgcagagaaagcgtttagtcaggctaaatttattgtacgtaccaactattctaacccaccggctcatggtgcttctgttgttacgacaattctgtccaacgaagaactgaaagcagagtggattcaggaactggcaacaatgcgtgagcgcattcagcgtatgcgccaattgttcgtcaacaccttacaagaaaaaggtgcaaaacaggatttcagcttcatctgtgctcaaaatggtatgttctcattcagcggtctgactaaagaacaagttgaacgcctgcgtgaagaatacgctgtttatgcagtcagctccggccgtattaacgtcgctggtttaacactggagaacatggttcctctgtgtgaagcgattgttgctgtactg

SEQ ID NO: 23919 - DNA, 1272 bp, Xenorhabdus nematophilus
atgaatccttcagatattgactttgacctgcgacacatctggcatccatatacttccatgagcaacccactaccgacttatccggtcgattctgccagtggtgttgaattggtattgtcagatgggcgtaaattaattgacggtatgtcttcatggtgggcggcaattcacggctacaatcatcccgtacttaatgaagccgcaaaatcgcaaattgataaaatgtcgcatgtgatgtttggcggcattactcatccaccagcagtagaattgtgtaaacaactggtagcaatgacgcctgcatcactggaatgtgtttttctggccgattccggctcggttgccgtggaagttgccatgaaaatggctttgcaatactggcaggcaaaagggcagcagcagaaaagacgacaaaaattcctgacactacgtcatggttatcatggtgatactttcggcgccatgtctgtttgtgatcccgaaaactctatgcacagtctgtatcagggctatctccccaatcatttgtttgctgatgccccacaatcccgctttgatggcgaatggcagccagaagatatctcttctttccaacaattattgttacagcatcatgatgaaatcgccgccgtgattctggaacccattgttcagggagcgggtggaatgcggatctaccaccctgaatacctgcgtcaggtgcgcaacctttgtgatgaataccaaattttgctgatcgcggatgaaatcgccaccggcttcgggcgaacaggcaaactatttgcctgtgaacacgccaatatcgaaccagatattttgtgtttaggtaaggctctgacaggcggctatatgactttatccgcaacattaacgacccgccatgttgccgaaaccatcagtcagggtgaagcaggctgttttatgcatggcccgacatttatggggaatccgctggcctgtgccgttgccggagccagtctgaaattactcactgaaagcccgtggcaacaacgcattcactcaattgaatccggcttaaaagcagagttattgcctctgaaatcatataattcggttgaagacgtccgggtattgggtgccattggtgtggtggaaatgaaacaacctgttgatgtagcagcattacagcgccactttgtccaacagggagtctggatcaggccattcgggcgtttaatttatttaatgccgccttatgttattcagcctgagcagttattgaaactgacaaatgctattgctgatgcggta

SEQ ID NO: 23920 - DNA, 987 bp, Xenorhabdus nematophilus
atgagctggtcagattctctttcccggcgattggccgaacgccggggcacatcgttatggcgccgcagacaggctcatcaaagttcaaatggacgacatctctacacctctgatgggcaacaatatctgaacttttccagtaatgattatctcggattgagccagcatcctgaggttattgctgcgtggcaacaaggcgctgagcaatacggtgttggtagtggcggctcagggcatgtaaccggatatacctcggctcaccatgcgctagagcaacaactggcggagtggcttggttattcccgtgccttgctgtttatttctggctattcggctaatcagggcgtgatagcggctctaatggaaaaagaggatcgcattattgctgatcgcctgaaccacgcctccctgatggaggcggctatgcattcaccggctcagtttcggcgttttttgcacaataacccgatttcgctaaaacagcatttaggcaaagcatgtgcaggtaaaacactggtggtgacagaaggtgtttttagcatggatggagacagcgcaccactcagtgaaattacccggctggcacaatctacaggtagctggctgatggtggatgatgcccacggtattggtatttatggtgatgaggggagagggagctgctggttacagaatgttaagccggagatcttaatcgttacttgtggtaaggcatttggtttgagcggggctgcggtattgtgtgatgaacagaccgcagaatactttgttcaatattcccgacacctgatttatagcacttctatgccaccggctcaggcagttgcactttccgaggccacgcgccagattagggcaggagatgaattgcgccagcgtctgcaaaataatatccagtattttcgtcgtgaagcacaaaacttatctttttctctgacggattctgaaaccgctattcagcctgtgatcatcggtaataatgaacgc

SEQ ID NO: 23921 - DNA, 1473 bp, Xenorhabdus nematophilus
atgaatagaattccggttattggttcaggatttggcggtatcgccttagcgataagattacaagcagctaatatacccacattgcttctagataaaagggataagcctggcgggagggcatacgtttatcaggataaggggtttacatttgatgcgggaccaacagtaattactgatccttctgctattgaagaattatttttactcgctggcaagaaaatgtctgactatatagaattattaccaattagtcctttttatcgcttgcagtggcagtcgggagagatatttgattatggtggcgatcaagttaaattagagaaacaaatagctaggtttaatccaggtgatgtgcagggatatcgtgaatttattcgttattctaaggccgtttttaaaacgggttatttaaaatatggcatgtctcctttcttgtctttcaggagtatggtttgtgcaatgccttcgttggtacaattatctgcatggaagagtgtttatggtattgtttcgaaacatataaaaaacgagcatctgcggcaagctttttcatttcattctcttcttattggtggaaacccttttacaacatcatctatttacacgttgattcatactttggaaagagaaggtggtgtttggtttcctcgtggtggaacaggggccttagttaacgcattagttaaattattcattgatataggcggggtatgtaaattgaatacccaagtcgaaagttttatcacgaatgataatcagataactgctataaaattaaatgatcagcgtgaaatatattgtaaagcagcggcttcaaatgcagatgttatccatacttatgaaaagttattaggcaggcattgtgtgggtaagagacgttccgactcattgaaagaaaaaaagatgagtaattctttattcgttatttattttggtttgaataagttacacatccagttagctcatcataccatttgctttggtaatagatataaagaattactggatgatatttttgaagggaatagcattcctggtgatttttctctttatctccattcaccttctgtcacagacccgactttagcaccgcccgggtgtgcaagttattatgttcttgctcctgttcctcatctgggaaatgctcaaatcaattggcttgaagaaagtcctcgtttacgtgatcgtatattctcttatctggaaaaatattatattccggggttacgtgatcaattagttactcataagatttttactccatttgattttcgggacgagcttaatgcttatcacggttctgctttctctatagcgccattattactacaaagtgcttggtttcgccctcataatcgcgatagtgatattgaaaatttatatattgttggtgcaggaactcaccccggagcaggtattccgggagttcttgcctctgctaaaatcactgcgaatttaatgatagaggattta

SEQ ID NO: 23922 - DNA, 1431 bp, Xenorhabdus nematophilus
ctttaccgtcatctggtagggctgccactgccctatttcaaacagcgtcagacagggcaaatcatcgcccgcgtcagagaaatggctcagatccgccagtttctgaccggttctaccctgatgttattgctcgacctgatcttcattgtgctgttccttggcgtcatgttccattactccagcctgctgacgtggattgtcaccggatcactggttctctatttcctgctctgggtaaccgtcggcccgattatccggcataaagtggaagccgaatatgaagcagatgctcaggcaaccagtttcctgactgaagcggttaccggtatcgaaaccatcaaaaccacagcaacagaaaagcgctttctgcaccagtggcaggccgtactcagccgacagttaattcagcgtttttccgcccagaaaagcgggcttgcggccgggcaagggatcgcacttatccagaaaattgtggccgcattattattgtggtggggtgtcaaaagtgtgctggccggagaactctctcccggagaactgattgcctttaatatgctggccgggcatgtcacccagccaatcctgcgtctggcacaggtatggcaggattttcagcataccctgatcgccctgagacgtgtcggcgatattcttgatgagccgatggaaaacagtaaacaaggattggtttcttcccctgaactggccggacaaattgaatttaaaaatattcgtttccgctatcatgaggatacccctgaagtactggcgaacctgtcgctatcaatcagtgcgggggaatttatcggtattaccgggccatccggctcaggaaaaagtactcttacccgtttattacagcgcctctatataccacaacatggtcaggttctggtggatggtatggatttggctattgcagatccggtatcgctgcgacgtaacatgagcgtggttttacaggaaagcatcctgttttctggcagcattgctgacaatatccgcctgtgtaaacccaatgccaccgatgaagaactgtatcgcgctgcggctctggctggagccatcgatttcatcaatcagtttccccataaatttgctcatccggtcggggaaaaaggcggtaatctgtccggcggccagcggcaacgtatcgctctggcaagagcattactgaatgatcccaagatcctgatcctggatgaagcaacctctgcactggattatgaatccgaagccgccattatgagtaatatggatgagatccgccagaacaggactatcatcagtattgcccaccggctgaatacgcttcgtcatgcagataaaatattcgtcttagatcagggaagaattattgaatccggttcacatgccgacctgttacaacaacatgggctttatgctcaactctggcatcagcaaactgag

SEQ ID NO: 23923 - DNA, 675 bp, Xenorhabdus nematophilus
atgtccgctccccttacatggcatgatgtcatcggcaatgaaaaagcacagccttactttactgatacattgacgtatgtcgccaacgaacgtaaagcaggtaaaaccatttatccgccacaacaggatgttttcaacgctttccgctataccgaactggctgatgtgaaagtcgtgatcctgggacaagacccttatcacggcccgaatcaggctcatggcctggctttttcagtacagccgggcattcccgctccaccttcactcgttaatatgtacaaagaactggaatctgatattgcaggatttcagcgtcccaatcacggctgcctgcttagctgggcaaaacaaggggttttattactgaatacagtgttaacagttgaacggggtaatgctcactctcatgcaaatctgggctgggagactttcaccgataaggtcattgctgcgatcaatgaacaccgaagtggtgttattttcctgctctggggtgctcatgctcagaaaaaaggccgtattattgatacccagcgccatcatgtcctgaaagcaccacatccttctcctttatcagcacatcgcggttttttggggtgcaagcacttctcgcaagctaaccacctccttgaagcccaagggttagcatcaattgactggaatccggtacttcct

SEQ ID NO: 23924 - DNA, 738 bp, Xenorhabdus nematophilus
tatatgagattccaaaatagcgtggtaattattacaggcggggcaagtggaattggtgaagctacagcaaaagcatttgctgccgaaggtgctcatgttgtgattgccgatttctcagatcatgggaaaaaagttgctgaggaacttcatccaaaaggcaatgaaagtatttttattaaaactgacgtcacaagcgaagagagcattaagtatatggtctcgaaaacgattgaaaaatttaaacgtatagatgtcttatttgccaatgcagggatagccgccgataacagtgcagataaactgacggttgccagctggcagaaaactatcgatgtaaatctgaccggggtttttctgtgcgataagtttgttatccatgaaatgcttaaacaagaatcaggcggggtgatcgtcaactgtggttcgatccatagctttgtcagccgggaagccattacagcttatacagcctctaaaggcggtgtaaagttattaagccagactttagcgattgactacgccaaaaataatatcagggtgaatacagtctgccccggctatatcaacactccgctattaagcaagatccccgaagaactaaaagagcagcttatttctcttcatccactgggacgtttaggaaaaccagaagaggtggcgaaagccgtattattcttagcaagtgatgatgcatcatttattaccggcacgacattacttgtcgatggtggatatacc

SEQ ID NO: 23925 - DNA, 624 bp, Xenorhabdus nematophilus
atgttaagtcggttaatgaaaaatttgctgacgcagctacaccagcagggtattcataatgaactcctgctggaagtgatatccaaagtacccagagaatgttttgtcgatgaagctctggcacataaggcatatgagaatacagcattgcccatcggacacgggcagactatatctcagccatatatcgttgcccgcatgactgaattactggatttaacgcctgaatctaaagtactggagattgggacggggtctggttatcagactgcgatacttgctcatttagccgggcatgtcttttctgtagaacggattaagggattgcagtggcaggctaaacgcaggttaaagcaactcgatttacataatatctcaacccgccatggagatggctggaatgggtggccgtcaaaggggccatttcatgccatcatcgtcacagcagcacctccagaaataccacaggcattattacatcagctggcagatggcggcgtgatggtattgcctgttggtgaaagctctcagtcgctgaaagtggtacatcgctatgggaacgattttcatagtgaagtgatcgaatctgttcgtttcgtacctcttatccaaggcgaactggca

SEQ ID NO: 23926 - DNA, 2485 bp, Xenorhabdus nematophilus
tatctggaagttgataatggtgctttatcagaggcgactgattttatggccgatgcactggccgagcctgtgctgtatccggtcaacgcagatcgtgaacgccatgccgttgataatgagatgaccattgcccgtgcaggtgaagggcaccgaatctggcagatccgttcagaaacgcttaatccgtctcaccctaacgcccgttttgctggtggtaatctggaaacactgaaagataaacccgacaggaagttacagacggcacttgaggatttttatcagcgctactattcagccaacctaatgaaaggggtgctgtatggaaaacagcctatagacaaactggctcaaattgccgcggagacttttggtcgtattcctaatcggaatgcttcagtgcctgctattacagccccggcgataacggagaaggaagaaggcatcattatccattatgtgccatccaaaccgtacaaatcattgcaactggaattcagtattcctaatgaaattgctaattttcgcagtaaaacagagggttacattggctatctgattgaaaaccgcagtgaaaatactttatctgattggttactgaaacaaggactatccgaagggatcagcgccagtgctaacccaaatgttgatggtaattcgggttcattcagtatttatgtcgaattgactgacaaaggccttcaacagcgtgatcaggttattgcggccatcttttcttacattaacctgttgaagcagaaaggcatccaacagagctattttgatgaaatggttaaggtattcaatttgtcattcaagtacgcatcaatcgtacgggatatgaactatattgagtcgttagccgatacgatgctgatagtaccggtttctcatgttctggatgccccctatcttgctgataaatataatcctcaggccattctcagacgattggatcaactgacacctgaaaatgcccgcatctggtttaccagcccggaagagccacacaataaagaagcttattttgttcaggcaccgtatcaggttaataaaatcagtccaaaacagtttgaggaatggcaagaacttgaaaaaggaatgtcattttccttaccggaactgaacccttatattcctgataacttaactctgattaaaacatcgggtagccagaaacatccccgaatgattctggaacagcctaatgtgcgtttgctttatatgccgagccaatattttgctgatgaaccgaaagcaaacatcgtgctggagctacgcaatgctgatggtatgaagagtgctaaagaacaggtgacttactcactgttatcttacctgtctgatcttgcactgcatcagcttggctatcaggcatcagtcgccggtatgggggcatcagtcgggtatgcggatggtctgcaaataggagtatatggttacactcagcatctacctgaattattaacttctaccattagccagtatatggcatttacgccaactcagactgaattgcaacaagcgaagtcctggtatcgtaaccaactggaaatcgcgaatgaaggtaaagcttatgaaatggcaatgcagcctgtttcccgcttatccggtgtgccttatatcgaacaggctgaactcctgaaatcactggatggcgtcagcattgatgatgttattaaataccgtcagaagatgatccaaagtgctgctttacaagcgatgatctttggtaatttaactgaaaagcaaggcattgatattattaactctgcacataaacagctcgggaatcggggaacagagtggtggagtggtgagcatatcgaattggatcgcaattatgcggtgaatttcgaaggtactgccagcagcaccgataatgcgctggctgaaatttatattccaacgggatatgatcgcagtactggtgctgtctattccaatctgttgagtagcattttatctccctggttctatgatcaattaagaacaacagaacagctgggctatgcagttttcgctttcaatacaagggtcggagagcagtgggggctgggattcctgctgcagagtaacagcaagcagccggattacctgcaccagcgatatctgagcttctattcagcaggctgaaaagaaattacaggcgatgtctgatgctgaatttgagcagtataaaacgtcattactcacggaaatgcgtcagccgccacaaacgttttctggagaggcatcccgttacagtcatgactttggtcgtaataacttcagttttgataccagagaaaaattactgacttctcttgaaaaagtgactaaagcacaattgatggagttttacgataaagcagtcatgaaacgtcagggattggcacttatttcacagattaccgggaagaaaggctcgcttcatcaatatgcgcagttgaaaggttggaaaacttatccgaatgtatccaccttccagaaaaaactaccggttaag

SEQ ID NO: 23927 - DNA, 2271 bp, Xenorhabdus nematophilus
gtcatgaaggtattgatagcaaaaaatgaggtgggtacaaagcatcatagtcattatattgaaaacgcaatacatcgcttggcagataaattaattgaacgggatgttgaagttgttattgcggactcttttgatgatagctatacgataattgctgctaatgagcccattgattgtttaatggtcagttgtgcattgatggatgaagatttatatcagcagatccaaaaattactgaataagctatttgagcgtcaggaagatgtaccggtatttttattaagtgatcgggaaaaggcagtctttttactggatcatgcgatgttggaacaattaactgaattcgcatggatacttgaagattcctcagattttattacgggcagggctattgccgcgatgcaccgttatcgtcagcaattattgccgccattaatgtcagctttgatgaattacagaaaaatctatgaatattcatgggcggcacccgggcatcaggcaggagtagggtttaataaaacgcctgttggtcgtatttaccatgattattatggagaaaatctttttcgctctgatatgggaattgaacgatcttctttgggatcattgctggatcacaccggagcgttcggcgagagtgaaagaaatacagccagagtgtttggtgccgatcattcgtattctgttgtagtcggaacatcaggttctaaccgaactattatgcaggcctgtatgacagaagatgatatcgttcttattgaccgtaactgtcataaatccattgaacaggggcttattctgacaggcgcaaagccggtttatatgctaccgagccgtaatcgatacggtattatcggcccgatttatccgcaggaaatggagacaaaaacactccagaaaaagctgaaacagaacccgctgaccaaagatatggtgaagaaaaagcctgtctatactgtggtgacaaactgtacttatgatggtgtttgctataacgccaaacatgtacaaaacctgctggataaaagcgttgatagaattcattttgatgaagcatggtatggttatgcccgttttaatcctatctatcatgatcattatgccatgcggggtgaccccaaaacacataaagggccaaccgtttttgctacacattcatcccataaactcttgaatgcactatcacaggcctcttttatccatgtgcgagatggccgtaatccgatagatttttcaagatttaaccaagcctatatgatgcatgcgacaacgtcacctctgtatgcgatctgtgcttcaaatgatattgctacttcaatgatggacggtaacagtggttattcgcttactcaggaagttattgaagaagcagtcgattttcgtcaggcattagcacgtttgtatcgggatttcagtaaaaaaggtgactggttctttaaaccgtggaatcaggagcaagtgacagatcctgccacaggcaagaaaatgctttttgcggatgctccgcgggatttgctgaccacaaaacagagctgctggacgatgaaccctggtgacagttggcatgggtttgaagatttgccaaatgactggagtatgcttgatcccattaaagtcagtatcctcactccgggtatgggagacaacggtaagttattgaaacagggagtgccggcagcactggtgacagcatggttaagccagcatggtatagtgccgacgcgtaccacagatttccagatcatgttcctgttttcaatgggaattaccaaagggaaatggggcacattacttaataccctgctttcatttaaacatcattatgatgctaatacgcctttgagtaaggtatttcctgatttagtgcacgattatccggatgtctatagcacgtcaggagtaagagatctaggcgacaaaatgttcgcttatttacacaaaaataacccgggtgagaaactgaatcaggcatacgcgatactgcctgaagttgacatgatacccagggcagcctatcaggcgattgtgaccaatgatgtggaattagtcgcgctcgataaacttcctcatcgtattgctgcgaactcaattattccttatccacccggtattcctatgttgatgtcaggggaaaacttcggtgataaaaacagtccgcagattagctatctgcatgcattgcaaaaatgggatcatgaatttcccggctttgagcatgaaacggaagggacggaaatcattaatggtatctaccacgttatgtgcgtaaag

SEQ ID NO: 23928 - DNA, 1083 bp, Xenorhabdus nematophilus
atggcaggcaacagtattggacagtttttccgtgtcaccacatttggtgaatctcacggtcttgcattgggtggaattgttgatggtgttccacctggtattgttatttcggaagccgatttgcaaatcgatctggacaggcgtcgtcccgggacttcccgctataccacccagcgccgtgaacccgatgaggttcgcatactttccggtgtttttgagggagtgacgaccggaaccagtattggcttattaattgaaaacaccgatcaacgttcgcaagactacagtgcgatcaaagatgttttccgtcccggccatgcagattatacctatgaacaaaagtatggattgcgcgattatcgcggaggtggccgttcatctgcccgcgaaactgcaatacgtgttgctgcgggagcgattgccaaaaaatatttattcgaaaaacatggtattcgtatccgtgcctgcctgactcagatgggagatattcactgcgaaatgaaagactgggatctggttgagcagaacccatttttctgtcctgatgaaagtaaattaactcagcttgataaattattacgtgccctgaagaaagaaggggattccattggtgccagagtgaccgttgtggctgaaaatgttccggccggattaggagaaccggtttttgaccgtctggatgccgacattgcccatgccctaatgagcattaatgctgtgaaaggtgtagaaattggtgatggttttggcgtaattggcctgcgtggcagcgaaaacagggatgaaatcacctctcagggttttaccagtaaccatgcgggcggcattctgggggggatcagtagcagccagcctattgttgcccacattgcgctgaaaccgacatccagcattatggtttcaggtaaaacaattaatcggcagggcgaagaagtggatatggttacccggggtcggcatgatccttgtgttggtatccgcgcagtgcctattgcagaggcgatgatggcgattgtcctgatggatcatctgttgcgccagagagcacaatgtgcggatgtgtcaccttcgcttccaagctgg

SEQ ID NO: 23929 - DNA, 1335 bp, Xenorhabdus nematophilus
atgcaaaacacctcacaactcaagcgtgggctaagcgttcgtcatattcggtttatggcactggggtcggcaattggtaccggacttttttatggttctgcgggagccattcaggccgcagggccggcggtattgctggcgtatattatcggaggagccgctgtttttatggttatgcgggcattgggggaaatggcggttcataaccctgtgcccggttcattctctcattatgccagccattatctggggccgctggcgggttttctgaccggatggacttatgtctttgagatgctggtggtctgtctggcggatgtcaccgcatttggcctctatatgaaattctggtttccccatgttgatcaatggatttgggttctcggtatcgtcttttttatcggggcaataaacctgtgtaacgttaaagtttttggtgagatggagttctggctttccatcataaaagtggttgcgattatagcgatgattattggtggctttgcaatcatgatgtacgggttcgagcagggaaccggtttatcaaatctgtgggaacatggcggctttatgccgaatggcgttactgggattattgcgtcatttaccattgtgatgtttgcattcggtggtattgaagttatcggtattaccgccagtgaagcgaaaaatccggtatattctattccacgagctatcaatgctgtccccgtgcgcattctgctgttttatgttcttaccctgtttgttctgatgtgtatttatccgtggaatcaggttggtcagaacggcagcccattcgtgcaaattttctccagcctgcaattcaactatgccgcccatattttgaaccttgtcgttatcacggcagcaatctcagccattaacagcgatatctttggtgccgggcgaatgatgtacggcatggcgcagaaaaagcaggcacctgcttttttcaacaaactgacaaaacatggcgtgccatgggtgacagtattggtgatgtcagccattttgctggtcggtgtatggctgaattatatcttaccggaagaaatcttcttgattatcgcttctatcgcaacctttgccacggtatgggtatggctgatgattctgttatcgcaatacatgatgcgtcggaaaatgcctgcggaagaagctaagcaactgcaattccctgtaccgttctggccgatagcaccaatgctgacaatcgcatttatggcattcatcatattggtgctgggttatttcccgcatacacgtgttgcgttatatgtggggctcggttgggtagcattactgactgcctgctatttcctgtgggtcaaa

SEQ ID NO: 23930 - DNA, 1125 bp, Xenorhabdus nematophilus
cgcattgctggtagagcaaagaatattaatgcctcagtgacggtagggctggcagatatcgttgctaaattgaaaagtgaaggtcgtgacattattggattgaatgaaggtgagctggatttcagtactggggctgctattgttaatgacaccatccgggcattgatagatggcaggacacgttatagctggctcaacggtgaacctgaattaagagagaaaatctgccaaaaagtatttgaagataaccggattaaagcgacgcctgaaaatgtcatcgtaaccaatggctccaaacaagttatttatgaaatattacagacagtcattaatcccggtgatgaagtcattattcccgtgccctgttgggcaacatatcttgaagcagtcaaattagccggtgggaaagcggtattaattgaaaatattggtgttgatctggatgttgaaaaaataaagcaggccattaccgaaaataccaaacttatcattatcaatacgccgaataatccgaccggggctgtttactcgaaagctgcattacagaccctgtgccaaatcgtcaaagaaaaacagattttcatgttatctgatgaagcctatgaacaaattgtctttgatggtgaacatcatagtctggctgcccttgatgacaatgaatacatcatcacggtgcaaacattttcaaaaagctttgccatgacgggctaccgtattggttacatgatagcccaccctgaactaatcaacagagtctctgacctgcatggtcatatgaccgataatgtctgcacttttgctcagtatggtgcaattgcctcgctcgaaatgcccaaagatttttatcaggaaaggttagagatactcaaacaacgccgggatcgggcataccgatatacccgcgaacttttcgattgtgagcttcctgccggcgcattttatctgttccccaatgttgaaaaatacctcaatgatcgttgtcgtgatgccactcaattctgtgaatatctgctcactcatgcaggggtagccctgatcccggcagaagcctgtttgtatcgtggacacgtacgagtttcttttgcagcgcccatggatgccattgagcaggggtttgaacggatc

SEQ ID NO: 23931 - DNA, 1632 bp, Xenorhabdus nematophilus
gataatgtccttattctggcgttactgaaaaaagcactcagcgatattgatgcaatacggtttaacgatttgcaatccgggcgtcagctaagctggcgccaattactgtgcagtattgcccgcatttatcgttatatgcatgaattgaacgttactcgtggtcagcgggtggtgacaatttcgcataattgctgggaattactggctattgaattcgcctgtcagcttaaaggtgctatttatgcgccggtatacgccaattattctgaggagatgatgacttactgtctgtcattggcagaacccgcattagtcatcacggaaaaggtatcacttgcacagacactggcacagcatagcccgtggcaggtgatgacactggaacaggccggacctttccctgattttgccggtattgacagggaaactgacctgatcagcccggataaagccgtcagtcatgaagctatcggagaggcgttactcagggctattacgacagatttacaggccacgcaggcagaacaggcattctgtttgatgtttacttctggttccagtggtaaaccgaaaggtgtgttgctcagtcagaacaatattctgtcacagcagcaggctctgcaaacattatggcatttcgatggcccgcaatcttttctcagttacctgccgtggcatcacagctttggtggattatttgaaaaatacacggctattttcagtcaggcgatgttacatattgataatagccggggcatggatattgaccggatgtgcactaatctgagtcagttaaaaccgacacgttttttcagtgtacccaagatactgacagtcgttgccaacaaaatgaaacattccgaggcgtttcaccgggcagtggcaccgacattgcagatgatcttctccgctgcctccaaattgcctccggatatcgaagactattttaagcattgtggtatctacgttgctgagggctgggggctgacggaaaccagcccatgcctgacacttaaaggcccgggctatgaagaacacaacagcgtaggccgccctttacccaatgtcattctcagtattgatgaagatagcggggagattttggcaaaagggccgaatgtgatgctgggctattatgccgatgaagccgctaaccagcgttgcttcaggcagggatggttcagaaccggcgatctcggcaagatgatcaagggtgaacttgtgcttctggggcggttagattcagtcaaaaagctgtctaatggcgaaaaggtatccagcgatgccattgaacaaagtctgtttgagaaaaccgatattatcaaccatgccattattgatattgaacaacgcccctacgctacggctttattgtttattaaccctgagctgtgtcgccagcgatttggtgagaattgcacactgcaacactcatcccgtttgcaggagcatattgctgaggtggtacaacagcataatcagcaggtggaggatagttcgtttaaattgattgcggtggcggtcactgaaacctcactgtctctggagaaaggggaagtcacaccgtcatttaaagtgtcgcagcgtactgtacgcgagaattatcaggctgtgcgtgatgccttatacgat

SEQ ID NO: 23932 - DNA, 1284 bp, Xenorhabdus nematophilus
cgtcgtcaggtataattgtcgaaaatggcacttttctttgcggccattatttttgcagccccgcatgcgacacgcaattcagatagtgaatatccttatcgtcaacatagtgattttctttatttaactggatttaatgaaccagagtctgttcttatcctgatcaaaagtgatgaaactcataatcacagtgtgttgtttaaccgggtgcgtgatttgacggcggaaatctggtttggtcgccggctcgggcaagaagctgcgccggaaaaactgggcgtggatcgtgctttaccttttgatgctcttgacgagcaactctacctgctgctgaacgggctggacgtggtttatcatgcccagggcgaatttgaatatgcggacgagatagtcttcagtgccctggataaattgcggaaaaacagccgtcgtaatctcactgtgccatcaatcatagctgactggcgcccgtggttgcatgaaatgcgtctgtttaaatcagaagctgaattggaaatcatgcgtaaagcggggaaaatcagtgcacaggctcataccagagcgatgcagcattgtcgcccggatatgtttgaatatcagcttgaagcggaaattcatcatgaatttacctatcatggtgcacgttatcctgcttataacaccattgttggttccggcgaaaatgcctgcattctgcattacacagaaaatgatcgctgtatgaaagctggcgatttggtgcttatcgatgccggttgtgaatataaaggttatgcgggtgacattacgcgaacatttccggtcaatggtaaatttacccgccctcagcgagaaatttatgacattgtgctgaaatccatcaatgtctctctggagctttataaaccggggaccagcatgcgagaagtgacggggcaggttgtgcgtatcatggttgaagaattggttaagctgggcattttgcatggcgaagtcgaatatttgatcgagaccaatgcttatcgccaatttttcatgcatggtttaagtcactggctgggtctggatgttcacgatgtcgggcactatggtgtggatcgtgatcgtattctggaaccgggcatggtactgacggttgaaccggggctgtatatcgcgccggatgctgatgtaccgccggaatatcggggaattgggatccgtattgaagacgatattttgattacagaatcaggtaatgaaaatttaactgaatatgtcgttaaagatcctgatgagattgaagcgctgatggcacaggcaaaa

SEQ ID NO: 23933 - DNA, 1023 bp, Xenorhabdus nematophilus
atgcaatccctgacgttacaacccatctctcacattcatggaactattaacttacccggttctaaaagtgtttccaatcgtgcgctattacttgctgctcttgctcagggaacaacatgcctgaccaatttattggatagtgatgatattcgccatatgctcaatgcgttaacagcactgggtgttgcttatcgattgtctgaagatcgtactacctgtgaggttgatggtattggtggagtaataaccgataaaaatgagctggaactgtttttgggaaatgcaggaacagcgatgcgcccactggctgcggcattgtgtctcggaaataatgacgttgtgttaaccggtgaaccacggatgaaagagcgtccgattggtcatttagtggatgctctatgtcaggctggggcaaaaattgactatcttgagcaggaaaattacccaccagtgcgaatcagaggtggtttctcaggtggaaaagtgactgtcgatggcagtgtttccagtcaatttctgactgcgttactgatggccgctcctttagcattaaatgatagtgaaattgatatcaaaggagatttggtttctaaaccatacattgatattacgctggcattaatgaacagtttcggggtaactgtagaaaacgatcactatcaggtttttcggatcaaagggcaacagaagtaccagtctcccgggcattatctggttgagggtgatgcttcttccgcatcgtattttcttgctgccgcagcaattaaaggcggaaccgtgcgtgttacaggtattggtaaaaacagtttgcagggtgatacaaaatttgccgatgttctggaaaagatgggcgcgaccatacgtaagggtgatgattttgtggagtgtgaacgtggcacactgactggtattgatatggatatgaatgccattcctgatgcggccatgactatcgcgacaacggcattgtttgctaaaggtgaaacagttatccgcaatatctataactggcgggtaaaagag

SEQ ID NO: 23934 - DNA, 1083 bp, Xenorhabdus nematophilus
atgagtcaggtatataatttcagtgctggtccagccatgttaccagcagaagtattacgtcgagcagagcaggaactttgtaactggcatggactgggaacatccgttatggaaatcagtcatcgcagtaaagagtttatgtcggttgcgtctgaagcagaaaaagatctccgggatttattatcgatacctgaaaattacaaagtgctgttctgtcatggtggtgcccgtggtcagttttccgctctaccattaaatctacttggtgataaaacgtcagcagactatatcgttggcggttattgggctgaaagtgcagctaaagaagctgcaaaatattgcacacccaatgtcattaatattcttactgaaacagatggcgttaaaagtgtaaaaccaatgaatgaatgggatttgagtaatgatgcggcctatgtgcattattgccctaatgaaaccattggtggtattgctatttttgaagagcctgattttggtgatgataaaattgttgttgctgattattcttcaaccattctttctgcacctattgatgtgagccgctatggtgttatttatgcaggcgcccagaaaaacatcgggccggcagggattaccgtcgttattattcgtgaagatttattgggtaaggcccataagcacacgccatccattctggattacaccgtgcaggtgaacaacgattctatgtataacacaccaccaacatttgcatggtatctctccggtatggtgttcaagtggctgaaagagcagggtggattacaagaaatcaaaaaacgcaatcatgccaaagcgaaatctctgtatcacgcgattgataacagtgatttttatatcaaccgtgttgcgccacaaaaccgctctattatgaatgtaccttttcagttagctaatcctgctctcgacggtaagtttttagaagaagcttatgcgcatggtttgcatgcattgaaagggcacaaagtcgccggaggtgccagagcttcaatttataatgcgatgcctcatgaaggggtaatggcattggttgagtttatggctgattttgaacgccgtaat

SEQ ID NO: 23935 - DNA, 1434 bp, Xenorhabdus nematophilus
aagaaggttctcatgtcaaacaacattcgtatcgaagaagacctgttaggtaaacgtgaagtccctgctgaagcctattacggtattcacactctacgtgcgattgaaaacttctatattagtgaccgctccatcaacgatgtccctgagttcattcgcggcatggtcatggtgaaaaaagcggtagcactggcaaacaaagaactccataccattcccggcaaagttgctgatatcattgtcaaagcgtgtgatgaactgctcaacacaggcaaatgtatggatcagttccctgttgatgtttttcagggtggcgcaggtacctcactgaacatgaatacgaatgaggtgctggcaaatatcggtcttgaattgatggggcatcagaaaggtgaatatgagtacctgaaccccaatgatcatctgaacagaagccagtcaactaacgatgcctatcctaccggtttccgtattgctgtttacaacgcaatcatgcagttggttaattcaatcgaattattaaaagcgggcttcgacaaaaaaggtattgagttcgacgatatcctgaaaatgggtcgtactcaattgcaagatgcggtaccaatgactctgggtcaggaattccgtgctttttccatgttattaaaagaagaaattaaaaatatcactcgtaccgcagaactgctgctggaagtgaaccttggggcaaccgctatcggtactggtttgaacacagcacctggctatcagaaactggctgttgaaaagctggcagaagtgaccggcttgccttgtatacctgcagaagatttgattgaagcgacttctgactgtggtgcttatgttatggttcatagtgccctgaaacgtctggctgttaagatgtctaaaatctgtaacgacctgcgtctgctgtcttccggcccacgtgctggtctgaacgaaatcaacctgccagaattgcaggcaggttcttccatcatgccagccaaagtaaacccagttgttccagaagttgttaatcaagtctgctttaaagttatcggtaacgatacctgtatcactatggcagcagaagctggtcagttgcaactgaacgtcatggaaccagctattggtcaggctatgtttgaatctatcactatcctgagcaacgcttgccgtaatctggttgagaagtgcgttaacggtattactgccaacaaagaagtctgtgaaagctttgtctttaactctattggtatcgtgacctatctgaacccattcatcggtcaccataatggcgatatcgtaggtaaaatctgtgcagaaacaggtaaaagcgtccgagaagttgttttggagcgtggtctgctgacagaagcggaattagatgatattttctctgttgagaacctaaaaaatccgacttacaaagcaaaacgttttgatgac

SEQ ID NO: 23936 - DNA, 852 bp, Xenorhabdus nematophilus
atgtttttaatctctaacagtaaaatgttgaaaaaagcccagcgggaaggttatgccgttcctgcattcaacgtccataatctggaaacagtgcaggttgtggtggaaacagcggcaaaaatggagtctccggtcattctggccggaactccgggtaccttcacttatgcaggtcttgaatacatggtttctatctgcaaagaagccgcgatgatcaataaactcccgctggcactgcatcttgatcaccatgaagatatcaatgacatccgtcacaaagtcgaaacagggatccgttcagttatgatagatggttctcatttccctttcgaaaaaaatatatctacagtggctgaagttgtacgtttatgtcagcgttttgataccagtgtagaagccgagctgggaaggctgggagggcaggaagatgatttgacagttgacagtaaagacagtttttataccgacccactagccgcgaaagaatttgttgaacgaaccggaatagattcactggcagtggccattggttctgctcacgggctttatcacggcgaacctcatctggatttctcacgtctggcagaaattcatcgtcacgtagaggttccattggttttacatggtgcatcgggcataccggaagagatgatccataaatcaatagcactgggcatttgtaaagttaatgtcgcaaccgatttaaaaattgcttttgctgatgcggtaaaagcctatttcgctcagtatccagatgctaatgatccgagaaaatatattacaccgggtaaaattgcgatgcagaaagtggtagagaagaaaattactatttgtggtagtgctgggagggta

SEQ ID NO: 23937 - DNA, 1362 bp, Xenorhabdus nematophilus
atgactgcaagacttgggcgctggctggctacattagatggtatggaaaaacgtctggaaaaaacgccgaaagtacgtcgttacggacgtctgacccgcgccacgggtctggtacttgaagctacaggtttacatctgccactgggagcaacctgccttattgaacggcaaaatggcaacacccttgaagaagtcgaaagtgaagtcgtcggcttcaatggtgaaaaattgctgttaatgcctttggaggaacttgaaggtattgtgccgggtgcccgtgtctatgcacgtgcttatggtgaagaagcgggtagcggacggcgtttacctctggggccggaattacttggcagggtgctggatggtgcaggtcgccctctcgatggtttacctgccccggataccggatatcgcgcccccttgaccacaccccccatcaaccccctgcaacgtactcccatcagtgatgtactggatgtgggtgtacgtgccattaatgctctgctaactgtcgggcgcggacagcgaatggggttatttgccggttctggtgtcggtaaaagtgtgctccttggcatgatggcccgttatacgcaggcagacgttattgtggtcggcctgattggtgaacgtggccgggaagttaaagatttcatcgaaaatattttaggtgaagaaggacgcgcgcgttccgtggttgttgcggcacctgctgacgtttcgccactactgcgaatgcagggagcttcctatgcaacccgtatagcagaagattttcgtgatcgcgggaagcatgtgttgctgattatggattctcttacccgttacagcatggcgcagcgtgagattgcgctggcaattggtgagccaccggcaaccaagggttatcccccttctgtgttcgctaaattaccggcgttggtagaacgggcgggtaatggtgtcagtgatggcggttcaatcactgcattttataccgtcctgactgaaggtgatgaccagcaggacccgattgctgattcagcacgggctattctggacggtcatattgtcctgtcccgtgccttggctgaatccgggcattatccggctatcgatattgaagcatcaatcagccgggccatgacatccctgattgataatacccattatcgacgggtgcaacattttaaacagctgctttccagctaccagcgcaaccgggatctgattaatgtcggtgcttacgctgccggtagtgatcctttgctggacagggcaattgagttgtatccgcatatggctcagttcctgcatcaaaacattgaggaacgcagtgaatacgatgcagcatgtgcccagctgcaacagttattaccaagt

SEQ ID NO: 23938 - DNA, 534 bp, Xenorhabdus nematophilus
ttgaaacatattgtagaagtgatgatttccgagcaagaggttaaacaacgtattgctgaattagggcaacagattacagaacattatcgcaatagcgatcgtgaactggtattggttggcctgctgagaggatcgtttattttcatggcagatttgtgccgtgaaattcaggtttctcatgaagtggattttatgactgcatccagctacggcaatggaatggattctacccgcgatgtgaagatccttaaggatctggatgaagatattcgtggtaaagatgtgttaatcgttgaagatattatcgattccgggaatacactgaataaaatccgtgagattctgtctcttcgtgaaccaaattctctggcaatttgtacgttactgaacaaaccatcccgccgcgaagttgatgttccggttgagtggatcggttactcgattgaagacaaattcgtggtgggttatggcattgattatgctcagcgctatcgccatctgccttatatcggccatgttactctgctggaagag

SEQ ID NO: 23939 - DNA, 924 bp, Xenorhabdus nematophilus
atggcttatgcattggaattgacgcagcttacgaagacctataacggtggagtaaaagcgctgcgtgggattgatctgcgagtggaaaccggcgatttttacgcgctgttgggaccaaatggtgccgggaaatcaacgactatcggcattattagttctctggtcaataaaagcagcggtaaggttaatgtattcggttacgatattgatacggatttagtcaatgctaaacggcaactggggttagttccgcaggaatttaattttaacccatttgaaactgtgattcagattgtgctgaatcaggcgggatactacggcgtaccacgcaatgtggcacaaagcagggcggaaacctacctgtcacaactcgatctctggggcaaacgtaatgaacgggcaaatcgtctgtcagggggaatgaaacgccgcctgatgatcgcccgcgctttgatgcatcagccaaagttattaattctggatgaaccgactgcgggtgttgatatcgaactgcgccgctctatgtgggactttctgaagtctcttaatgagcaaggaaccacgattattctgacaactcactatctggaagaagcagaaatgctttgccgtaatattggcattattcaacatggtgaactggtggaaaataccagcatgaaagatctactcagccaacttgaggtagaaacatttttactcgatgtagcgcctgaaggaaatatgcctacgcttgaaggctatagctaccgcttggttgacacagctacgctagaagtagatgtgaaacgagggcagggactaaatgatgttttctcccaattaagtacgcagggtattcagattcacagtatgcgcaacaaggcgaatcgtttggaagagctatttgttgggttgacaaataatagccaaggagctcgctca

SEQ ID NO: 23940 - DNA, 759 bp, Xenorhabdus nematophilus
cggatgagtcggcagattgctgttgtcaccggagctggtgggggattcggcaccgcgattgccagaactttgctggatataggttatcaggtggctgcaacagatatcagcatacaaaaactgacgctccttaaggagcgtctcgggcagccggaatctctggcgatatttgaaatggatgtcactgatcccgcttctgttgagcaggcggcacaacagatcactgaaacatggggtaaaacgatcacggtactggtgaataatgccggcattattcaccggactttctgcctgtcaggtcagggactaccggaagtcgccaaaatgatagatgtcaacctgacaggcgcctttaactgcacatcgatttttgtccgttacatggcagcgcagaaatatggacgcattattaacatcgcctcgattgccggtatttggggcgcggcgggtggtgcggcctatggcgcatcaaaagcgggtctgatttctgccaccgaatcctgggggcgtgaactggggcctcttaatatcagcgtaaccgcgattgctccgggagtctgcaaaactgacatgctggagcagtttgtcaattcaagcccaatggaatcagcagcggaagataagatcgtacgttccattgtacctgtcggacgttggggaacatccgatgatgtggcggaagttgtcggatttctggcgagttgtaaaaccaattatctcaatactgcggtgatccctctggatggcggaatgcgcgtc

SEQ ID NO: 23941 - DNA, 948 bp, Xenorhabdus nematophilus
atcccgtttaatcgcggggaaaaatcccgtgtatgggatctggatggtaatgaacatctggatatgttttgtaaattcggtgcattactggtcgggcatcacaatgaggcttacaacagctcattgatcgaatatatgaataaagtcacttccgttgatacctgtgatttggaagttgctgtctgtgaaacgatggtcagacatattccttgtgctgaaatggtgcgtttctgcctgagcggaaccgaagctgtacaaaatgcgctgcgtctcgcccgtgcttttagtggtaaaaaccgttttatccgcttccacggtcactatcatggtaatgcagacaatatcatgggctggcgtaagaaacaggatctgacctatccggtgccggagcagttcaggggagatctgctggatacactggggcgtgatcctaacgtgatgacagatcagtcttttatgttgccgtggaatgatattgatattctgacggcgacaatagagcgctaccacgatgaaattggtgcggttctgatggagccgatctgcattaatggcgggggtattttcccggtcgaaggctatctggagaaaaccaaagcactgtgtgaaaaatacaatatcgtgctgattttcgatgaaatcattaccggcgttcgtatcgggctgggtggagcacagaaaatactgggtgtgacacctcatctggcgacgtttggtaaggcgctgggaggcggggccatgccaatctcagccattgccgggcgtcgggatattatgaatctctatacccgcggcaaagttattcacgccggaactttcaacggttatccactcggtctggctgccattaaaaccactttcagcctgattgaacaggatcccggatgttatgaccggatgggcgacattatgcgccaaatttcgaatatctttgtgaaagccgcagaa

SEQ ID NO: 23942 - DNA, 918 bp, Xenorhabdus nematophilus
gtgattgagtttaatcaggtcaggaaacattacaaagattatcaggcgttgaaaggcatttctctggacgtttatcgtggtgagttcattggtctgcttggcccgaatggtgcgggaaaaacgacactggttgaaatactggaagggctaaaaaaagcagattcaggctctgtcagggtattgggaaaaacatggcagcatgatgcaccttatctgcgccggcgtctcagcggagtcttacaggaaacgttatttatcaacaaactcagagtaaaagaagtgcttactctgttcggtagtttctatggctgttcacgtcaccgggtgcaggaagtgatggaactggttgaattaagcgaaaaacaccggacttatgtggaagggttatcaggaggccagcgccagcggctggctctgggtgttgccattatgaatgaaccggaaatcctgatactggatgagccgacaacagggcttgatccgcgtttcccgcatgatacatgggacattctgcgcaaactcaaccgggaaaagaaatccactatgctgctgacaacgcattatatggaggaagctgagtatttatgtgatcggatttgtatcatgaataaaggggaaattattgcacagggtggcatggatgaattactgaaaaaatactgtaacggcgatctgattgagctgacgacccggttccctgaacgtttgcaagaactgagcctacataatcgggtatcaagttatgaatacgatgaatcaaaaaacaggatccgtatgataattgacgattcagccagctttgtgactgagctttttgaatgtgccaaaaaagccggtaccgatatcaatgaactggtgatcagaaagaaaacgctggatgatttgttcatggtactggcagggagacgcttccatgaa

SEQ ID NO: 23943 - DNA, 597 bp, Xenorhabdus nematophilus
gttttagtaacccgccaagcccctgattttacagcttctgcggttctcggtaacggcgaaatcgttaataacttcaacctgaaaaaacacctgaatggtcgtccagctgttatcttcttctggccaatggacttcactttcgtttgtccttctgagctgattgctttcgaccatcgttatgaagaattccaaaaacgtggttttgaagttattggcgtttctttcgactctgagttcgttcacaacgcatggcgtaaaactccaatcagcgaaggcggcattggcgaagttaaatacccaatggttgctgacatcaaacgtgacatcatgaaagcatacggcattgagcattcagaagcgggtgttgctctgcgtggttctttcctgatcgataaaaacggcgttgttcgtcatcaggttgttaacgacttgccactgggccgtaacattgacgaaatgctgcgtatggttgacgcgctgcaattccacgaagaacacggcgaagtttgccctgcacagtgggcaaaaggccaggaaggtatgggcgcttctcctgaaggcgtagcaaaatacctgactaaaaatgctgacaaactg

SEQ ID NO: 23944 - DNA, 1473 bp, Xenorhabdus nematophilus
atggcggtgacgtctacagctcaggcttgtgatttggtgatttttggggcaaaaggagacttagcacgccggaaattaatgccttccctttatcagctggagaaagcgggttatatccatccggatacccgtattatcggggttggtcgtgctgactgggataaaaaagcctatataaagttggttgaagaagcattaacaacatttatgtccgaaaaactggacccggaattatggaagaaactcagttcgcgtctggaattttgtaatctggatgtcaacgagacggaacatttctcccgactggcgaaaattctcaatcaggataaattacctgccattcattactttgctatgcctccaaacacctttggctctgtctgccatgggttgggtgttgcgggattgaataaagaacccaatcgtgtcgtgatggagaaaccattgggtacagatcttgcctcttctcgtgctatcaatgatgaagtagcaaaatattttagtgaaaatcagatttaccgcatcgaccattatctgggtaaagaaaccgtactgaacctgctggcgttacgttttgctaactctttgtttgttaataactgggatcatcgcacgatagaccatgtgcaaattacagttgctgaagaggttggtatcgaagggcgctggggatatttcgatcaggccggtcagatgcgggatatgatccagaatcatttgctgcaaatcctgaccatgattgctatgtcacctccgtctgatttgtcggcagatcgtattcgtgatgaaaaagttaaagtgcttcgttcattacgccggattgaccatactaatgtacgggaaaaaacagttcgcgggcaatataccgccggatttgtgcatggtaaaaaggttccgggttatctggaagaagaaggggcaaacaaggccagcaaaacggaatcttttgtttcggttcgtgtcgatattgatgactggcgttggtcgggtgtgcctttctatctgagaacgggtaaacgcttaccggcgaaatgctctgaggttgtagtttattttaaagagcctgcattaaatctgtttgctggttcctaccagcagttaccccaaaataagctgactatccgtttacaaccggatgaaggtattgatattgaagtgctgaataaagctccggggctggagcacaagcaccgtttacagacaacaaaacttgatttgagcttctctgaaacattcaatcaaacccaccttgctgatgcttatgagcgattattgctggaagcaatgcgcggtattcaggcactgttcgtccgtcgggatgaagtggaagaagcctggaaatgggttgattccattatggaagcatgggcggcggataacgaacctccaaaaccttatcaggcaggaacctggggaccggttgcctctattgcgatgatcacccgagatgggcgctcatggaatgaatttgaa

SEQ ID NO: 23945 - DNA, 1440 bp, Xenorhabdus nematophilus
atgtccagacggctcagaagaactaaaatcgtcactacacttggcccagctacagatcgtgacaacaatttagagaaagtgatcaatgcgggagccaatgttgtccgccttaatttttctcatggtaccgcagaagatcatatcctgcgcgcaaacaaagtacgggaaatcgcagctcggctgggttgccatgtcgctatccttggtgatctacaaggccctaaaatacgtatatcgacgtttaaagaagggaaaatattcctcaatatcggggataaattcctgcttgatgccaatttaggcaaaggagaaggcgataaagaaaaagtcgggattgattacaaaggactgccatcagatgttacaaccggcaatattctgttgctggatgatggacgagttcaattaaaagtacttgatgtgcagggcatgaaagtatttacagaagtgactgtaggcggcccgctttccaataacaaaggcattaataaacagggtggcggcttatctgccgaagcactgacagaaaaagacaaagaagacatcatcactgctgcgaaaatcggcgttgattatctcgcggtctctttcccccgctctggtgaagatctgaattatgcccgccggttggctcgggacgctggctgcgaaacacaaattgtagccaaagtagaacgagctgaagcggtcagcagtgatgagattatcgatgaaattattctggcatctgatgtagtcatggtagcccgtggcgatttgggtgttgaaatcggcgaccctgaattagttggagttcagaaaaaacttattcgtcgtgcccgtcaactgaatcgtgtcgtaatcacagcgactcagatgatggaatcgatgattaccaacccaatgccaacacgggcggaagtgatggatgttgccaatgccgtccttgatggtactgatgcggttatgctatctgcggaaacagcagcgggtcaatatccagcggaaactgttgcggcaatggctcaagtctgcctgggcgcagaaaaaatgccggggatcaatgcatccaagcatcggatggatatcacatttgacagtattgaagaagctatctcaatgtctgccatgtatgcagccaatcatctgaaaggggtcaaggccattatcgccatgaccgaatcaggtcgtacagcacgtatgatgtcacgtatcagctccggtctgcctattttctctatgtcacgccatgaatcaacgctgaaccgtgccggattataccgtggtgtgacaccggtttattgtagcagccacattgatggtattgccgcggcgagtgaagcaatcagccgtctgcgtgacagaggttacttagcctctggcgatttggtgctggtcactcagggggatcagatgggaactatcggcagtaccaatacttgccgagtgcttgaagtcgaa

SEQ ID NO: 23946 - DNA, 492 bp, Xenorhabdus nematophilus
atgaaacagactctatttatcgtgggtgcacgaggtacagggaagacgacaataggtaatgtgttggctgaagtattatcgtatcaatttgttgacactgatgaagatgtccagatttcttgtggaatgacaattgcagagcttgttgaacagcgtggctgggattatttcagaaagctggaaagtgaaacactgaaagcggttagtcagcgaaacagagttgtgtctaccggtggtggaatggtgttagcagcggaaaatcggcagtatatgcggcaaaacggtattgtggtttatttgcaggcacccgcttccgttttggtagagcggctctctcttaatccggagaattcacagcgtcccagcctgaccggaaaatccataacagaagaaataaccggagtattggcagagagggaaccactctattgtgaatgtgcgcacctcattgtggatgcggccttatcgatagaaaatatcgttcttgaaatt

SEQ ID NO: 23947 - DNA, 1252 bp, Xenorhabdus nematophilus
atgctagagcagatgggaaaagcagccaaggcagcatcatggcaactggctcaattaagtactagtcagaaaaatcaggctctgagtcacattgctgatttacttgaaaaagaagcacaagtgatcctcacagccaatcagcaggatatggaacaagcccgtaaacagggtatgaatgaagcattacttgatcgcttattactgactccggagcgtttgagtgcgattgctaatgacgtccgtcaggtttgccgtctggctgatcctgtcggtcaagtgatggacggacaattattggatagcgggttgcaactgagtcgtcgccgtgttcctcttggggtaattggggtaatttatgaagcccgccctaacgttacgattgatgtcgcatcactgtgtctgaaaacagggaatgcagtgatattacgtggtggtaaggaaactcatcataccaatcaggcaatggttaaagtcattcagcagtcgctggaacaaagtggcttgccagcctcagcagtacaggcaattaataaaccagatcgtgagctggttgccgaaatgctgaaaatggatcgctatatcgatatgttgatcccgcgtggtggtgccgggttgcataaactttgccgtgagcagtccactattccggtaatcaccggaggaattggcgtttgtcatacgtttgtggatgagcatgtgaattttgaaaaagcactggaagttatcactaatgctaaaattcagcgcccaagcgcatgtaatgcattggaaactttgctcgtacatgaaaaaatagccgctgatttcctgccggaactgagtgccagaatgaaagcgcagggcgtaacactgcatgcaggtgcgtcagcaatggcactgttgcaggatggcccggcaaaagtggttgccgtgacagaagaagactattgtgatgaatggctttctttggacatgaatgtggaaattgtcagcaatattgataaagcgattgagcatatacgtcattatggtacagcccattcggatgctattctgacggagtgtttacaacatgctgattattttgttcatcgtgttgactcttcggcggtatatgtaaatgcaagcacacgctttactgatggtggccagtttggtttaggagcggaagttgctgtcagtactcagaaactacactccagaggcccaatgggtctggatgctctgacgacttacaaatggatgtggttacggagattacctttcccgtcga

SEQ ID NO: 23948 - DNA, 1191 bp, Xenorhabdus nematophilus
agctatccaattgaataaattacataaatgataataaacaggggaaatattatgatggaagagccgattcgggaagcctctcttgctgcggttaaaacagccagtgatatcgcatatcaatatgtcagtgaaattcgaaaccagcgtgtctatcccgattctgatgccttactgggtctgcaaaattttgacaggccactacctcagaatggcactgattgtcaggaagtgttggcacagcttcacaaatacggctcaccggccacagttgccagcacgggcgggcgctatttcgggctggttgtcggcggctcaactcccgcagcaatgggggccaatattgtcaccagtgcctgggatcaaatagcgctgatggagtcctcctctcccgttgctcatcaattagaaaaaattgccggacgctgggtattggagcttttgaatttaccctcagatgcattcgttggtttcgtctccggcaccacgatggcacatgtcagtgcattaggtgctgcgcgccagtatctgttccaaaagcagggctatgatctggcagaacagggtttgcataatgcaccaccgttgaaagttgttctgtccgaagaaacccatgtttctgttttaaaggcactgaagttactcggtttcggtcgctcacagttcatttttgtaccctgtgataatcagggacgcatcattgccagcgctgttcctgaactttcagataacatgattctggtattacaggctggtaatgtgaactctggcagttctgatcctttccagtccctgattccacaggctaaaaaagcaggctgttgggtgcatgtcgatggtgcctttggtctctgggcacgggcatcaaaagaaaaatctgagttagccggaggtgttgaaggcgcagactcatgggcggtagatgcccataaatggctgaacaccccctatgactgtggcatgtgtattgtacgcaacaaacaggcactgagagatgtcatgacaacctctgccgcctatgttgagactcaggaagtatggcaggcaaaagacatgctgccggaattttcccgcaaagccagagccgtcgaagtgtgggcggctatttctgaactgggtgttcaagggattgaagcattaattgatcgctgctgcctatatgctgaaatgctggctgatggtcttaaatcactg

SEQ ID NO: 23949 - DNA, 1251 bp, Xenorhabdus nematophilus
atggaaagcaaagtagttgttccggcggaaggtaaaaaaattactattgataccaaaggtaaattaaacgttccgaataacccggtaatcccttatatcgaaggggatggtattggtgttgatgtaacgccggtcatgctgaaagttgttgatgctgcggttcagaaagcatatagcggtgagcgcaaaatttcctggatggagatttatacgggtgaaaaatctacacaggtttacggtaaagatgtctggctgccggaagaaacacttgatttgatccgtgaatatcgggttgctattaaaggtcctctgacaacgcctgttggtggcggcatccgttctttgaatgtggcactgcgccaacagctggatttatatgtctgcctgcgtccggttcgctattatcaaggaactccaagccctgtaaaacaccctgaattaactgatatggtgattttccgtgaaaacgcggaagatatttatgcaggtattgagtggaaagccgggtctgcggaagctgataaagtgattaaattcctgcaggatgaaatgggcgtttctaaaatccgtttccctcagcagtgtggtattggtgtaaaaccatgctcggaagaaggtactaagcgtctggtacgttctgcgattgaatatgcaattgataacgaccgtgaatcagtgactctggttcataaaggcaacatcatgaagtttactgaaggtgcctttaaagactggggttatgaattagcgcgtacagaatttggtggtgaactgctggatggcggtccatgggtgaaaattaagaatcctaaaaccggcaaagatatcatcatcaaagatgtaattgccgatgcattcctgcaacaaattctgctgcgtccggctgaatatgatgttattgcttgtatgaacctgaatggtgattacatttctgatgcgctggcagcacaagtgggtggtattggtattgccccgggtgcaaacattggtgatgagtgtgccctgtttgaagcaacacacggtacagcacctaagtatgccggtcaggataaagtaaacccaggttcagtcatcctctccgctgaaatgatgctgcgccacatgggatggttcgaagctgctgacctaatcgttaaaggtatggaaggttcgattgctgccaagactgtcacatacgattttgagcgcctgatggaagacgctaagctgctgaaatgtagcgaatttggtgatgctattatttctcatatg

SEQ ID NO: 23950 - DNA, 2550 bp, Xenorhabdus nematophilus
tctccagcaaaggatgtaagcacccacactcccatgatgcagcagtatctgcgcctgaaagcgcaacaccctgatattttgctgctttatcgcatgggagatttttatgaattgttctatgacgatgcgaaaaaggcagcaaagttactggatatttctctgaccaaacgtgggcagtccgctggccagccaattccaatggctggagttccttatcatgcaattgaaaactatctggcaaaactggttcaactgggtgaatctgcggcaatctgtgaacaggttggcgatcctgccaccagcaaaggccctgttgagcgtaaagttgtacgtattgtgactccggggacagtcactgatgaagccttgctgcaagaacgtcaggataaccttctggcggctatctggcatgacagtcaggggtttggctacgctactctggatatcacttccggtcgtttccgtgtttctgaaatggctgatgaagatacaattgctgctgaactccagcgcacccgtccggctgaattactctatcctgaagcctttgagcacatggggttgatcgaacgctatcacggcctgcgccgtcgtcctatgtgggaatttgaactggatacagcaaagcagcagctgaatctgcaatttggtacccgtgatctgatcggctttggggtcgaaaaggctccacaggcactgcgcgcagcaggctgtctgctgcaatatgtcaaagacactcagcgcactgctctgcctcatatccgcaatatcacaatggaaagccagcaagagacggtcatcatggatgccgctacccgccgcaatcttgaattgactcagaacctgtcgggaagcactgaaaacacccttgcctctgtgctcgatcagtgtgtgacgcctatgggcagccgtatgttgaaacgctggctccataccccaatccgcaaccgggatatactggaaaatcgccagcaggctatttctgcgcttcaggagataggctttgagctacaaccgttcttgcgtcaggttggcgatttagagcgtgtgctggcccgtctcgctctccgctctgcccgcccccgtgatttgacaagaatgcgccatgctttccagcaattgccagatatccaccagatcatggattcttctgattccccatatattcaggcattacaacaacgtattggtcgttttgacgagttacagcaactgctggaaaatgcggtagtcgaaaccccgcctgttctggtgcgtgatggcggtgtcatagcgcccggttataatgctgagctggatgaatggcgagcattggctgatggtgccagtgattatctcgacaaactggaaatccgtgaacgtgaaaaactcggtattgataccctgaaagtcggcttcaatgcagtacatggttactatattcaggtcagtcgcgggcaaagtcaccttgtgccgattcattatgtacgccgccagaccctgaaaaatgcagaacgctatattattcctgaattaaaagagtatgaagataaggttctgacttccaaaggcaaggctctcgccatcgagaaagccctgtatgaagagctgttcgacttattacttcctcatctggcagccctgcaaaccagcgctgaagcactttcagaactggatgtactggcaaacctcgccgaacgagctgaaacactgaattatacctgtccgacattaacagacagaaccggcatccaaatcacgggaggccgtcatccggttgttgagcaggttctcagtgaaccctttatctctaacccgttaactctctcttcacagcgtcgcctgttaatcattaccgggccgaatatgggcgggaaaagtacttatatgcgtcaggccgctttgattacattgctggcgtatattggtagttttgtcccggcagaaaaagcggtgattgggcctgtagaccgtatttttacccgtgtaggagcatccgatgatttggcatccgggcgctcgactttcatggtggaaatgactgaaacggctaatattttgcacaatgcgacagaacacagtctggtgttgatggacgaaatcggtcgtggtacgtcaacttacgatggcctttctctcgcgtgggcctgtgctgagaatctggctaatcgcattaaggcgatgacgttgttcgccactcactattttgaattgacgacattgcctgaaaaattggaaggagtggtgaatatccatctggatgcggttgaacacggcgataccattgcctttatgcacaatgtgcaggatggtgccgccagcaagagctacgggctggccgttgcttcactggccggtgttccccgtgatgttatcaaacgggcacgccagaaactaaaagagctggaatcactctccaacaatgccacagccggtcatgtcgacacaccacaactgacactattggcggaagaaacctccccggcagtagaagcactggaaaacctgaatccggactccctaacgccacgtcaggcactggaatggatttatcgtttaaaagacatggtg

SEQ ID NO: 23951 - DNA, 2264 bp, Xenorhabdus nematophilus
atgacagttttaaatcatacattaggttttccacgtatcggcttgaaaagagagctaaaaaaagcacaagaaagctattgggcaggtaaaatttctcaacaagaattgctagaaacaggccgtgaattacgagcacgtcactggcaacagcaaaaagaagcaggagtagatttaattcctgtcggtgatttcgcttggtatgaccaagtattgacgaccactctgctgttggggaacgttcctccccgtcatcaaaatgaagatggaagtattgatttagatacactattccgcattgcccgtggtcgggcaccgacaggtactccggctgctgcgtcagaaatgaccaagtggtttaacactaactaccattacattgttcctgagtttcaggaagggcaagaatttaaattaggatggactcaactgctggatgaagtcgatgaagcgctagcactgggacataacgtaaaacctgtgttactggggccggtgacttatttatggcttggaaaggtaaaaggcaaagcctttgaacgcctctctttattggcggatatcctgcccgtatatcaacaggtgctgggtgaactggcaaaacgtggcatcgaatgggtacagatagatgagccggcattggtgctggaactgccagaagagtggttggcagcatttcagcctgcttatcaggcacttcagggtcagcctacttattgctgacaacctactttgatagtatcagtcataatctggcgaccattaagtcactgccggtacagggtttacatgttgatttagttgcagggcaggactcactggatgaactgcataaatctttacctgaaacattattgttatcgttaggggttgttaacggacgtaatgtctggcgggcagatttgagtgcaaaatatgaacttgtcgtgcctttactgggtaaacgagatatttgggtcggtagttcttgctcattattacacagcccgattgatctgaatgatgaaacagggctggatgaagaagttaagagctggtttgcctttgcactacagaaatgtgcggaactttctctgttatctcaggcattgaatgctccacaaggtagcaggcagtccgagctggatgattacagcgcgccaattcgtgcccgccgcagttccgcacgggtgaataatccggctgtagccgagcgccttaataagatccgtccgcaggacagcgaacgtaatcaagtttatgaggagcgcgccagactccaacgccaacgttataaactccctttgtggccgacaacaacgataggttctttccctcagacaacagagatccgcggtttacgactggatttcaagaaaggtcgcgttgatggcaatcattaccgcaccaatatcagtgaacatattaaacaggcgatcactgagcaggaacggctgggattagatgtgctggtacatggtgaagctgaacgcaatgacatggtggaatatttcggtgaacattttgacggttacgtctttacacaaaacggctgggtacaaagttatggttcccgctgtgttaaaccaccggtcattatcggagatatcagccgtccagaagcgattaccgttgattgggcaacctatgctcaatccctgacagataagccagtaaaaggcatgttaaccgggccggtaacgattctttgctggtcatttccaagggaagatatcagccgggaaacgattgccaagcagattgcactggctctgcatgatgaagtggatgatttacagaaagcgggtattggcattatccagattgatgaacccgcactgcgcgaaggcttaccgctgcgccgcgaagagtggcaggcatatctggattgggcggtggatgcctttaaactaagtgccgccattgcggaagacgagactcagatccatacccatatgtgttattgcgagttcaatgacatcatgccttccattgcagcactggatgcggatgttatcaccattgaaacatcccgctcagatatggaactgctggattcgttcgaagacttctcatatccgaatgaaatcgggcctggtgtgtatgacattcactcaccgaatgtgccgagtgttgagtggattgaagccctgttgcgtaaagcggctgaacgcattccggttgaacgtttatgggttaaccctgattgtggcctgaaaacccggggctgggcagaaacccgccagtcattggcgaatatggttgaagccgcaaaacgtctgcgtgat

SEQ ID NO: 23952 - DNA, 648 bp, Xenorhabdus nematophilus
gcggtatcccagttaaatgcagagctgttcggaggatctgtgactgggcttgtcggcccggatggcgcgggaaaaaccacactgatacgaatgttggccgggttactgaaaccaaatcgcggcactattgaaatcatggggcttgatcccatcaaagacagcgtagaagttcgttctaaactgggctatatgccccaaaaatttggcctgtatgaagacttaaccgtacaggaaaacctcaatttatatgcagatctgcgtagtgtaactggagaagagcgacaatccactttccggaagctactgacttttactgatttaacccgctttactggccgactggcaggtaagctctccggcgggatgaaacagaagctaggtctggcctgtacattggtcggcagccctaaagtgctattgcttgatgaacccggtgtaggtgtagatcccattgcccgacgggaattatggcaaatggtgcatgagcttgcttctgatggcatgctgattttatggagcacctcctatttagatgaagccgaactgtgccctgatgttttattgctgaatcagggggaattactttatcgcggtcagccgcaaaaactgactcagggtattgccggacgctcttttctgcttgatatc

SEQ ID NO: 23953 - DNA, 1476 bp, Xenorhabdus nematophilus
atgacccattttggtttacagaaactttatatccacggtgcttatgttgatagcacccaccctgataaaaatatttttgatgctgtcaatccggctaatggtgaaatcattgcacagctacaatctgcaactgaacaggatgtccagctagcagtggaaagtgcgcaaaaagggcagaaaatctgggcagcaatgacggcaacagaacgttcccggatcctgcttaaagccgtagatattctgcgtgaacgcaataatgaactggctgaactggaaacgctggacaccggtaaacccctctctgaaacccagcaagttgacatcgttaccggtgccgatgttctggaatattatgcaggcctgatcccggcactcgaaggccagcaaatgccattgcgcgaatcctcttttgtctatacacggcgagaaccgctgggtatcgtcgcaggcattggggcatggaactacccaatccagattgctctgtggaaatcagctcccgcactggcagcgggtaatgccatgatttttaaacccagtgaagtgacatccctcaccgctctgaaacttgctgaaatttataccgaggcaggtctgcctgatggtgtatttaacgtactgacaggcatgggacatgaagcaggccattatctggctgtccatccgaaaattgccaaaatgtcttttaccggcgggatcaccaccggtaaaaaagtgatggctaatgcatccggttcaacactgaaagaagtcacgatggaactgggtggaaaatctcctctgattatttttgacgatgccaatctggatcgggctgccgatattgccatgatggcaaactacttcagctctggtcaggtctgtaccaacggcacacgtgtttttgtcccgaaaacactgcttcccgattttgaaaataaaataatggaacgcgttaaacggatccgcgttggttcacctctcgatctgaataccaatttcggccctctggtgagtttcccccatatggaatcagttctgcgctatatagaaagcggtaaaaatgcgggcgcacgattgctgtatggcggtcaacgccttatggacggtgaactggcgaaaggggcatttgttgcaccaaccgtcttcacagactgcacagatgacatgcttattgcacgggaagaaattttcggcccggtgatgtctattctggcctatgaaacagaagatgaaatcatcgtccgtgcgaacaatacggattacggcctcgccgccggagtggtgacaaacgatctctcccgcgcgcatcgcgtaatccaccagctggaagcagggatctgctggatcaacacttggggagaatcaccggctgttatgcctgtcggcggctataaacattccggggtcggtcgtgaaaacggattggtcacactgcaacattacacacagactaaatctgtacaggttgaactgggtaattttgaatcactattt

SEQ ID NO: 23954 - DNA, 1575 bp, Xenorhabdus nematophilus
gtcctactgctggaagctggcgggcctgattatcgatttgactttcgcactcaaatgccagcaacgctggcatatcccttgcagggaacccgttataactgggcgtatgaaaccgatcctgaaccctatatgaataaccgccgtatggaatgcggacgaggcaaagggttaggaggatcatcactgatcaacggcatgtgttatatccgtggtaatgcgctggattttgaccactgggcaaaacagccgggtctggaagactggtcataccttgattgcctgccttatttccgcaaggcggaatcacgggatatcggccagaacgattatcatggcggagatggccccgtcagcgtgacaacgccaaaagccgacaataatgaacttttccatgcaatggtggaagcgggtattcaggcgggttatccggctacggatgatctgaatggttaccagcaggaaggctttggcccaatggatcgcacagttacgcccaaaggccgtcgttccagcactgcccgtggttatctggatcaggccagacagagggctaacctgaccatcattacccatgccttaacggatacaatcacatttgaaggtaaaaccgcggttggcgttactttttatcagggtaataactccacactaacgcaggccactgcacaaaaagaagtgttactttgtgccggagcaatagcttccccccagattttacagcgttcaggggttggccctgaggaagttctgcaagaatcatcgattcctgctgtgcatatcctgccgggagtcgggcaaaatcttcaggatcatcttgagatgtatctgcaatacgaatgcctcaaacctgtttcgctctatccttccctcaaatggtacaaccaacccatgattggcgcagaatggttatttaaggggacgggagtgggtgccagcaatcagtttgaagccggtggctttatccgtaccagtgaaaaatttgactggcccaatattcagtttcatttcctgccggtagccattaactacaacggcagcaacgcagtcaacgagcatggttttcaggctcatgttggttcgatgcgttccccgagccgcggtcacgtgaaaatcaaatcacgtgacccacgccagcacccgagtattctgtttaactacatgtctaccgaacaggactggcaagaattccgcgatgctatccgtatcacgagagaaattatggcacaacctgctctcgcgccctattgtggccgggagataagccccggagcgaatatccagacagatgatcaactggatgcttttattcgtgaacgtgctgaaaccgcttttcacccatcctgtagctgcaaaatggggcttgatgagatggcggtggttgatggtcaggggcgtgtacatggcgttgagaatttacgggtcattgacgcctctattatgccggaaatcattaccggtaatctgaacgccacaacgattatgatggcagagaaaattgcggataaaattcgggggaatgcacctctgccccgcagtcaggcaaaatactatgtcgccaatggcgctcccgcccga

SEQ ID NO: 23955 - DNA, 1194 bp, Xenorhabdus nematophilus
atgctcaatcaagaattggagctgagtctcaacattgcttttgccaaagcaagggataacagacatgaatttatgactgtcgagcacctgctactggcgttgttaagtaacacatcagcgcgagaagcactggaggcttgtaaggtcgagctggcagttttacgccaggaactggaaaattttattactcaaacaacccctttattaccagagaatgatgatcgggatacccagccaacattgagctttcagcgtgtgttgcaacgagcggtgtttcatgttcaatcttcaggccgctcagaagtttccggggcgaatgtactggttgcaatttttagtgaacaagaatctcaggcggcttacttactgcgcaagcatgacgtcagtcggctggatgttgtgaattttatatctcacggaacacgtaaagatgagctcgataatgagagtcatcataatgttaatccagttcaggaagaacaagcgataggtgaggatagattggaaaatttcactacaaatctgaatcaatctgcacaaaaagggcaaattgatccgctggttggtcgtcagcatgaattggaaagaacaattcaggtgctgtgccgccggcgtaaaaataacccattgcttgttggggaatccggagtcggtaaaactgcgattgctgaagggcttgcatggcgcatcgtgcaaaaagatgttccggcagtgatgaaggattgcacaatttactcgctggatattggttcattgttggcagggacaaaatatcgaggtgattttgagaagcgcttcaaaaccttgttaaaaaccctggaacaggacagcaaaagtattctctttattgacgaaatccataccattatcggtgctggggccgcttcgggggggcaggtggatgcagctaatctgattaagcctcttttatccagcggtcgtattcgcgtgattggttcgacaacctatcaggaattcagcaatatttttgaaaaagatcgcgctctggcccgtcggtttcagaaaattgatattctggagccgtcttccgaagaaacggtacagatcattaatgggttacgtgctaagtatgaggcgcatcacgatgtgcgctacacagcaaaagctattcgggcggctgtcgaactgtcggtgaaatatatcaccgatcgccatttgccggatagagccatt

SEQ ID NO: 23956 - DNA, 804 bp, Xenorhabdus nematophilus
atgaaatttatatcattcaatattaatggattgcgggcgcgtcctcaccaacttgctgcgattgttgaacaacatcaacctgatgttatcggattacaggaaacaaaagttcatgatgagatgtttcctttagaagaagtcagtcaacttggctatcatatcttctatcacggtcaaaaatctcattatggagttgccctactgactcgccaacagccaacagctgtcagaaaaggttttccaactgacgatgatgatgctcaacgccgcattatcatggcagatatcgaaactccttccggcttactgactgtgattaacggttattttccacaaggtgaaagtcgtaatcatgagataaaattccctgcaaaagaaaaattttatcaggatctgcaaacctatctggaaacaaatcaatctccgggatccaatattctcattatgggtgatatgaatatcagcccgactgacctagatattggaataggagagaataatcagaaacgttggttaaaaaccggaaaatgttctttcctgcctgaagaaagagaatggatggaacgtctaaaaaactgggggctggttgatacattccgggctcatcatccggaaatcagtgaccaattttcgtggttcgattaccgctctaaagggtttaacgataatcgtggacttcgcattgacttgttgcttgcaagccagccattagcagaaaaatgcctctctgctggtattgattatgatatccgcgccatggaaaaaccttccgatcacgcaccagtctgggctgagtttaagatt

SEQ ID NO: 23957 - DNA, 1920 bp, Xenorhabdus nematophilus
atgcgtctttttattgctgaaaaacctagcctcgcacgtgctattgccgatattttaccgaaacctcatcgtcggggagatgggtttattgagtgtggtgatagtcaggttgttacctggtgtgtaggtcatttgttagaacaagctgagccagatgtatacgatcgccgttatgcgcgctgggtcttggctgatttgccaattattcctgaaaaatggcaattaaaaccacgagaagcggttgctaaacagctcaatacgattaaatctcttttggcaagggctgatgaaattgttcatgccggagacccggatcgcgaagggcagttgctggtggatgaagtgctggattttttgcagttggaagacaataaaaagcagaatgtccaacgttgtctgatcaacgatttaaatcctcaggcagtacttaaagccgtcgagcgtctgaggagtaaccgggaatttatccccctgtgtgtttcagctttagccagagcaagagctgattggctttatgggatcaatatgacccgggcttataccttattgggtcggaatgctggttatcaaggggttctatcggttggccgagtgcagactcctgtactgggcttggttgttcgtcgtgatgaagaaatagaacattttataccaaaggatttctttgaggttaaagctcatattattaccccgaaagaagagcggttcaccgctgtatggcagcccagtgagtcctgtattgattttcaggatgaagaagggcgggttattcaccggcctttagcagaacatgtagtaatgcgcattatggggcagcctgcttatgttgctgcctatcaggacaaacgggaatcagaaacagcgcctttgccattttctctttcttcattacagatcgaagcagccaggcgttttggtctgagtgctcaggatgtgctggatatttgtcagcggttgtatgaaacccataaattgattacatacccgcgttcagactgtcgttacctaccagaagaacactttgcgggtcgtcaggctgttttaaacgctatttcggtacatgccagccatttgttgcctcaggatgcgcttgatacggaaaaaaagaatcgttgctgggatgataaaaaagttgatgcacatcatgcaattattcccacagcgcgaagcagtcaggttaagttgacagaaaatgagcagcatatttatggattggtagccagacagtatctgatgcagtttttcccggatgctatattccggaaatgcacaattgaactggatattgctggtggaaaattcattgccaaggctcgctttctggcagaggctggctggcgaactttattaggtaacaaagagcgtgatgaggagaatgagggtactcctctgccgattgttgctaaaggtgatgaactgttatgcgagaaaggagaagtcgtggaaaggcagactcagccaccacgtcatttcactgatgccactttattatctgctatgaccggtatcgctagatttgttcaggataaagcgctgaaaaaagttttacgggcaacagatggtttggggacggaagcaacaagagccggaattattgaattattgttcaagcgggaatttctgtataaaaagggacgatatattcatgcaacaccagcaggctgtgcgttaatccatgttttacctgatatggctgtcttgcctgatatgaccgcgcattgggaatccaaactgactcaaatcagtgagaagcaattccgttatcaggattttatgtcgcctcttcatgaaacattgcaacaattgatttggcaggcaaagcagtatagaaatttgaaagccttcagggacctgcctcccgctcctgtgaaagggaaaaaaagtaaaggtaagcaagctaaaaccaagcagacaaataaa

SEQ ID NO: 23958 - DNA, 1128 bp, Xenorhabdus nematophilus
atgtcctatactactttttcgcaagtaaaaaatgatcagttacaggagccgatgtttttcggccaacctgtgaatgtagcgcgttatgatcaacagaagtaccctatttttgaaaagctgattgaaaaacagctctcgtttttctggcgtcctgaggaagttgatgtttcccgtgatcgcatcgattacaacgcgctgccggatcatgaaaaacatatttttattagtaatctgaaatatcagacgttgctggattctattcagggccgcagcccgaacgtagcgttcctgccgctgatttcaatcccggaattagaaacgtgggttgaaacatggtcgttttcagaaacaattcattcgcgttcttatacacatattatccgtaatatcgtgaatgatcctgctgttatatttgacgatattgttacaaatgagcagatcctgaaacgagcacaagatatttcaaagtattacgacgatctgattgaaatgaccaattactatcaccagttgggtgagggtacatataatgttgcgggtcaggaaatcacagtgagtttgcgcgcactgaaaaaacagctttatttatgcttgatgagtgttaatgcgctggaagcgattcgtttctatgtcagctttgcttgttcatttgcgtttgctgaacgtgaattgatggaaggcaatgcaaaaatcattaaattgatcgctcgtgatgaagccctgcatttaacaggcactcaacacatgctgaacctgctgcgctctggtcaggatgatcctgaaatggcagaaattgcacaagagtgtgaacagcagtgttatgacctgtttgtacaggcagctgaacaggaaaaagaatgggcagagtatctgtttaaagatggctcgatgattggcctgaataaagacattctgagtcaatatgttgaatatattactaatattcgcatgcaggctgtaggcttgaagctgccatttgaaattcgctcaaacccgattccttggatcaattcgtggttggtttctgacaatgttcaggtggctccacaggaagtcgaagtcagctcttatttggttggtcagattgattcggaagtcaatactgaggatctcagcggtttcgaactc

SEQ ID NO: 23959 - DNA, 2289 bp, Xenorhabdus nematophilus
atgaaccagagtctgctagtaaccaagcgtgatgggcataaagaacaaattgatcttgataaaattcaccgggttgttgcctgggctgccgaagggctgaaaaatgtctcagtatcacaagtagagttgcgttcccagattcaattttatgacggtattaaaacatccgatatccatgaaaccatgattaaggcggctgctgacctgatttcaggtgatgccccggattaccagtatctggcagcgcgtttagccatttttaacctgcgcaaaaaggcctatggtcaatttgagccgccagcgttatatgaccacgttgtacgtatggtcgatttaggtaagtatgacaaacatttgctggaagactactccaaagaagaattcgagcaaatggacagttttattagccatctgcgtgatatggatttttcctacgcagctgttaaacagctcgaaggcaaatatctggtgcagaaccgtgttaccggtgaaatttatgaaagcgcccagttcttgtatgtactggtagctgcatgcttgttttccacctatccgaaggaaacacgtctggattatatccgccgtttttacgatgcggtttctacttttaaaatttcattgccaacgccgattatggcaggggttcgcactccaacccgtcagttcagctcctgtgttctgattgaatgtggtgacagccttgattctatcaatgcaacatccagtgcgattgtgaaatatgtatcccagcgtgcaggtattggggtgaatgcaggccgtatccgtgcattgggcagcccgatccgcggtggtgaggctttccatactggctgtattccattctacaagcacttccagacagcagtgaaatcctgctctcaggggggggttcgtggtggtgcggcgacattgttctacccaatgtggcatctggaagtagaaagcctgctggtgctgaaaaacaaccgtggtgttgaaggaaaccgtgttcgccatatggattatggtgtgcagatcaacaagctgatgtatgagcgtttgatcaaagggcaagacattactctgttcagcccgtccgatgtaccggggttatatgatgctttctttgctgatcaggatgaattcgaacgcctgtatacgcaatatgaaaatgacagcaatatccgtaaagagcgtatcaaggcagtagagctgttctctttgatgatgcaggaacgtgcttcaaccggccgtatttatattcagaacgttgaccactgtaatacacacagcccgtttgatccggctattgcgcctgttcgtcagtcgaatctgtgtctggaaattgctctgccgaccaaaccgctggataacattaccgatgaaaatggcgagatcgcattatgtacgctgtctgcgttcaaccttggagccattgagaacctgagtgagctggaagaactggcagatttggctgttcgcgcactggattccttactggattatcaggattatccgattgttgcggctaaacagggttcaatggggcgtcgtacactgggtattggtgtcattaactttgcttattatctggcgaaaaacggtgttcgttattctgatggcagtgcgaatggtttgacgcataaaacatttgaagccattcagtattatttgctgaaagcttccaataagctggctaaagagcagggagcatgtccgtggttcggtgaaacaacgtattcacggggcattctgccgattgatacctataaaaaatcactggatacattgaccagtgaaccattgcatatggactgggaagctctgcgtagcgatatcctgcaatatggtctgcgtaactcaactttatcagcgctgatgccatcggaaacttcttcacagatttccaatgcaacgaatggtattgaaccaccaagaggttacgtcagcattaaggcatcaaaagatggcattctgcgccaggttgtaccggaatatgatcgtctgaaaaggtcttatgaattgctgtggcaaatgccaagcattgacggttatctgcaattggtagggatcatgcagaaatttatcgatcagtctatttctgccaacactaactatgacccagcgcgtttccctaacggcaaagttccgatgaaccaattgctgaaagatttactgctcgcttacaaatatggcgtgaagactctgtattaccacaacacccgagatggtgcggaagatgctcaggatgatttggaagaagttgtcgaatctgctgattccgattgtgaaggcggcgcgtgtaaaatt

SEQ ID NO: 23960 - DNA, 1347 bp, Xenorhabdus nematophilus
gacaatgaaaatcagcttaaacagggtctgagtgtgaggcatatccgcttcatggctttaggctctgcaataggcacagggctgttttatggctcagcagctgcaatacaacaagcaggaccggcggtattgctggcatatctaattggcggtgctgccgtatttatggtgatgagagcactcggcgaaatggctgtccaccatcctgtttccggttctttttcgcagtatgccagccattatctgggcccattagccggcttcctgacaggttggctctatgttcttgaaatgctgtttgtttgcctcgctgatatcactgcattcggcttgtatatgaaattttggttccccgatgttgaccaatggatttgggttctgagtatcgtctgttttattggtgcgctgaatctatgccatgtgaagattttcggtgaaatggagttctggctttctatcgttaaggtcactgccattattgccatgatcattggcggtcttgcaattatgatctttggttttggtcagacaacagagcatgccacagggatcgctaatttatgggaacatggcggctttatgccgaatggcatcagcggagtggttgcttcaatggcgattgtgatgtttgctttcggtggaatagaagtcattggtatcactgccagtgaagcgaaagatccggcaaaaacaatacctaaagcgattaatgctgttcccttccgtattttaatcttctatgtcctgactttatgtatcctgatgtgtatctatccgtgggatcaaattggtcagaatggaagcccatttgtacagattttttctgatcttaaaatcagtgcagctgcgcatgttctgaatgttgttgttattactgctgccatttcagccatcaatagcgatatttttggtgccggacgaatgatgtatggcatggctcaggaaggacaagcacctgaggcgtttaaaaaactgacccgaaatggggttccatggatgactgttctggtcatgattgtggttctgctgctcggtgtcatgctcaattggctgcttcccggcaatatttttattcttattgcatctgtcgccacatttgccactgtctgggtgtggttgatgattctgctttctcatgtggctatgcgtcgtaaaatgagtgcagaagagatcagaaccttgaaatttccggtaccaatgtggcccattgctcccataattacgattgcttttatgggtgcaattatcctgctactcggatattttgagcaaacgagggatgctatatacattggcgctggctgggtgattatcctaaccattgcctattttttcagcataaagaaa

SEQ ID NO: 23961 - DNA, 363 bp, Xenorhabdus nematophilus
attatgagcactaccatctttaaagattttcaatttgaagcggcgcatcgcctgccacatgttcctgaaggacataaatgtggtcgcttgcatgggcattcatttatggttcgtctggaaatcaccggtgagattgatcctcatagcggatggctcatggactttgccgatgtgaaagctatcttcaagccaatttgggaacggctggaccaccattatctcaatgagatccccggtctggaaaacccaaccagcgaagtactggctcaatggatttggagagagttacaacctgctttgccacaactcagcgccgttatggttaaagaaacctgtagtgccggttgtatctatcgtggagag

SEQ ID NO: 23962 - DNA, 4221 bp, Xenorhabdus nematophilus
gtgaaagacttattgaagtttctgaaagcgcaaaccaagaccgaagagtttgatgcgatcaaaattgctctggcctctccagatatgatccgttcgtggtcattcggggaagtaaaaaagccggaaaccattaactaccgtacgttcaaacctgagcgtgacggtcttttctgtgctcgtattttcgggccggtaaaagattacgaatgcttgtgtggtaaatacaagcgcttaaaacaccgtggtgtgatttgtgagaagtgtggtgttgaagtcactcagactaaagttcgccgtgaacgtatgggtcacattgaactggcatctccgactgctcacatctggttcctgaaatcactgccatcccgcatcggcttgctgctggatatgcctctgcgcgacatcgaacgcgtactgtacttcgaatcctatgtggttgtagaaggcggcatgaccagtcttgagcgcagtcagatcctgactgaagagcagtatctggatgcactggaagagttcggtgatgagttcgacgcaaaaatgggcgcagaagcgatccagtctttgttgaaaaacctcgatctggaaaacgaatgtgaaactctgcgtgaagagctgaacgaaaccaactctgaaaccaagcgtaagaaactgaccaagcgcatcaagctgctggaagctttcattcagtctggtaacaaaccagagtggatggttctgactgttctgccagttctgccaccggatctgcgtccattggttcctctggatggcggccgtttcgcaacgtctgacctgaacgatctgtatcgtcgcgttatcaaccgtaacaaccgtctgaaacgcctgctggatctggctgcgccagacatcatcgtacgtaacgaaaaacgtatgttgcaggaagcggttgatgcattgctggacaacggtcgtcgtggtcgcgcaatcaccggttccaacaagcgtcctctgaaatccctggctgatatgatcaagggtaaacagggtcgtttccgtcagaacctgttgggtaaacgtgttgactactcaggccgttctgtaattaccgtaggtccatatctgcgcctgcatcagtgtggtcttcctaagaagatggcactggagctgttcaaaccatttatctacggcaagctggaactgcgtggtctggcgactaccatcaaagcagctaagaaaatggttgagcgcgaagaagcggttgtatgggatatccttgatgaggttatccgtgagcatccggttctgctgaaccgtgcaccaacccttcaccgtctgggtattcaggcgtttgaaccggttctgatcgaaggtaaagcgattcagctgcacccattggtgtgtgcggcttataacgccgacttcgatggtgaccagatggctgttcacgtaccgttgacactggaagcccagctggaagcgcgtgcgctgatgatgtctaccaacaacatcctgtctccggcgagcggtgaaccaatcatcgttccatctcaggacgttgtattgggtctgtactacatgactcgtgactgtgttaacgcgaaaggcgaaggcatggttctgaccggtcctaaagaagcagaacgcgtataccgcgcaggtctggcttctctgcatgcccgtgtcaaagttcgtatcactgaagaagtgagagatggcgaaggtaacgttacggttaatacaggtctggttgataccactatcggtcgtgccatcctgtggatgattgtaccgcgtggtctgccatactcactgattaaccagccactgggtaaaaaagcgatctctaagatgctgaatacctgttaccgggtgctgggcctgaaaccaaccgttatcttagctgaccagaccatgtacaccggttttgcttacgctgcccgttcaggggtatccgtaggtattgacgacatggttattcctgagaagaaagaaggcatcatcgcggaagcagaagctgaagttgctgaaattcaggaacagttccagtcaggtctggtaactgcgggcgaacgctataacaaagttatcgatatctgggcggcggcgaacgaacgtgttgctaaagcgatgatggaaaacctctcttctgagactgtgattaacagcaagggcgaagaagaacaacaggtttccttcaacaacatctttatgatggccgactccggtgctcgtggttctgctgctcagattcgtcagttggcgggtatgcgtggtctgatggcaacgccagatggctccatcatcgaaaccccaatcaccgcgaacttccgtgaaggtctgaacgtacttcagtacttcatctcaacccacggtgctcgtaaaggtcttgcggataccgcactgaagacagcgaactccggttatctgacccgtcgtctggttgacgttgctcaggatctggttgttactgaagatgactgtggtacgcataatggcatcatgatgactccggttatcgaaggtggtgacgttaaagaacctctgcgtgagcgtgtactgggtcgtgtgactgcggaagacgttctgaaaccaggttctgcggacattctggttccacgtaacactctgctgaacgaaaaatggtgtgatctgttagaagaaaactccgttgacagcgtgaaagtacgttctgtagttagttgtgaaactgacttcggtgtctgtgcgaactgttacggacgtgaccttgctcgtggtcatatcatcaacaaaggtgaagcagttggtgttatcgcggcacagtcaatcggtgagccgggtacacagttgacgatgcgtacgttccacatcggtggtgcggcatctcgtgcggcagcagaatccagcattcaggtacgtaacaaaggtcaattgaaactgaccaacgcgaaattcgttaccaactcagcgggcaaactggttattacttcccgtaataccgaattgcgcctgattgacgatttcggtcgtactaaagaaagctataaagtgccttacggttccgtattgtcaaaaggtgatggcgagaaagttgccggcggtgaaaccgttgctaactgggatccacacaccatgccagtcgtgagtgaagtgtccggtatcatccagttctctgacatggtagatggccagaccattacccgtcagacggacgaactgaccggcctttcatcactggtggttctggacagtgcagagcgtaccggtagcggtaaagacctgcgtccggcactgaaaatcgttgatgctcagggtaacgacgttctgatcccaggtacagatatgcctgctcagtacttcctgccgggtaaagcgattgttcagctggaagatggcattactatctctgcgggtgacacgctggcgcgtattcctcaggaatctggcggtactaaagatatcaccggtggtctgccacgcgttgcagacctgttcgaagcacgtcgtccgaaagagcctgctatcctggcagaaatcagcggtatcgtttccttcggtaaagaaaccaaaggtaaacgtcgtctggtaatcagcccactggatggtagtgatgcttacgaagagatgatccctaaatggcgtcagctcaacgtattcgaaggtgaggttgttgaacgtggtgacgtgatctccgatggtccagaatctccacacgacattctgcgtctgcgtggcgttcatgccgttgctcgttacatcactaacgaagttcaggaagtttaccgtctgcaaggcgttaagattaacgataagcacattgaagttatcgttcgtcagatgctgcgtaaagtgaccattgcaagcgcgggaagctctgaattccttgaaggcgagcaggttgaatacgcacgcgttaaagttgctaaccgtaaactggatcaagatggcaaagtccctgcgaccttccaccgtgatctgttgggtattaccaaagcatcactggcaacagaatccttcatctctgcggcgtcgttccaggaaacaacccgcgtactgactgaagcagctgttgcaggtaaacgtgatgaattgcgtggcctgaaagagaacgtcattgtgggtcgtctgatccctgcgggtacaggttatgcttaccatcaggatcgtatgcgccgtcgtcacgaaaacgaagtggttgaagcaccacaagtgactgtcgacgaagccactgcaaaccttgctgagttgttgaatgcaggtttcggtagcagctctaacgag

SEQ ID NO: 23963 - DNA, 951 bp, Xenorhabdus nematophilus
atgtatacaaagatcttaggcacaggcagttacttgccgtctcaggtgcgtactaacgcagatttagaaaaaatggtggatacgactgatgagtggattgtcactcgcactggtatccgtgaacgtcgtatcgccgatgaaggtgaaacggtggcaaccatgggattcagggctgctgaacaagccatagaaatggcaggcatcgataaaacgcaaattgatttaatagttgttgcaacaacaacgggaacgcatgcttttcccagcagtgcctgccagatccaaaaactgctaggcattaacggtattccggcttttgatgttgcggcggcttgtgccgggtttacatatgcattgagtgtagttgatcagtttataaaaacgggtgcagccaaatgtgcactgattattggttctgatacgctttccaaaactgttaatccagaagatcgtggtaccgttatcctttttggtgatgcggcaggagcaatggtggtaggtgcttcggaagaacccggtattctgtcgacccatctgcatgctgacggtcaatatggcgaattattatcagtacctcatcatgatcgccaaaaaatggatacaccagcataccttacgatggttggcaatgaagtatttaaggttgctgtgcgagaattagcgaatattgttgatgagacactggaagctaatggtttggctcattcccagcttgattggctggtaccccatcaggcgaacttacgtattatttcagcgacagctagaaaactgaatatgacgatggataaagttgttgtgacactggatcgtcatggtaatacctcagctgcatctgtcccgactgcatttgacgaagcgatccgtgatggaagaattcagcgtggccaacttgttttacttgaagcatttggcggtggctttacctggggctcagcgctagtacgtttt

SEQ ID NO: 23964 - DNA, 822 bp, Xenorhabdus nematophilus
atggcaattgttaaatgtaaacctacgtctccgggccgtcgccacgttgttaaagtggttaaccctgagctgcataagggcaagccttatgctccgctgttagaaaaaaacagcaaaactggtggtcgtaacaacaatggtcgtattaccactcgtcacattggtggtggccataaacagcactatcgtctgattgacttcaaacgtaacaaagacggtatccctgctgttgttgagcgtctggaatatgatccaaaccgttcagcaaacatcgcgctggttctgtataaagacggcgaacgtcgttacattctggctcctaaaggcctgaaagctggcgatcaaatccagtctggtgcagattctgcaatcaaagctggtaatgctctgccaatgcgcaacatcccggttggttctactgttcacaacatagaaatgaaaccaggtaaaggtggccagctggctcgttcagcaggtgcttatgctcagatcgttgcacgtgatggttcttatgtaaccctgcgtctgcgctctggtgaaatgcgtaaggtactggctgactgccgtgctactttaggtgaagttggtaacgcagaacacatgctacgcgttctgggtaaagctggtgcaagccgctggcgtggtatccgtcctaccgttcgtggtacggcgatgaacccagttgaccatccacacggtggtggtgaaggtcgtaactttggtaaacaccctgtaactccatggggcatccagaccaaaggtaagaagacccgtagtaacaaacgtactgatcaatacatcgtacgtcgccgttctaaaaaa

SEQ ID NO: 23965 - DNA, 1131 bp, Xenorhabdus nematophilus
ctggatgaaaaacggctattattgcgtgataaagccgaacgttttgctcatgagcaattgaagacagatatctcagcctctgatcgtaacgggacgttcttccagaaaggttggcaaaaatgcgcagatttcgggttacttaaaatgggcatacctgaagaatatggtggtgaaggggcctcattatctgatcttctgtctatcatggaaggcctgggatacggttgcgaagatatggggctattgttttcactcaacgctcatctgtggacagtgacgatgcaacttgctatccacggtacgccggcccaacgttctcgtttcttacccggtctattaaatggaacgttaatcggggctaatggctcgacagaagatgaagcgggttccgacgttttctctatgcgcactcacgcagtaagaagtggtgattgttatattcttaatggaatgaaaacttatatcacaaatgctcctattgctgacctttatgttatctatgccacaattgatcccacactcggccctttgggtatcaccgcttttcttgttgaatcatccacgccaggtatagaggtcagtcaaccgctggaaaaaatggggttacgtaccgcacaaatggggcgagttatattcaaggattgccgtatccccgcagatgccatattagggcgggaaggacgcggtattaagatctttgaaagtgcgatggagtatgagcgtggatgtattcttgctacagtcttgggagcaatgcgccgcagccttgacggatgtatcactcatgcacgcacacggaaacagtttggtcagcccatcgggaaaaatcaggctatatcacatcgtatcgcagacatgaaggttaatctggatgctgcacgtgaacttgtctatcgggtgggacgcttaaaagacgcagggaaagatgccacgatggaagcggcttgtgcaaaattgttcgtgtctgaaacgtacacacagttatcaatagatgcattacggatctacggagcaaagggttatcttgctgacagtcatgccgaaagagaattacgcaactccattgcatccgtcatttattcagggacatcggatattcagcgtaatatcatcgccaatggactaggttta

SEQ ID NO: 23966 - DNA, 915 bp, Xenorhabdus nematophilus
gatgccgcgatggaacgttatctggacgatccttttttcggtagtgtcgaacgccgaatcgcagcaactaacgaaggaagtgtggagctaggtgttaaagccgcacatcgtgtactgggggctgcgggtgtttctccggcagaggtagattgtctgatttcagtgtcaatgtttccggatcggattggctcaggtgatgccgggtatcttgctcagctaattggaactggcggcggtgcttttaacatagaagcaacctgtggtggttccatgacagcattattgacagcctgtgcctgggtgcaagcagggttaaaagaacgagttttagtcataacaacatccagactatcgcgggcgatcgaacctgacgatgtcaccctgcgtttatgtggagatgcttcggcagcatttttggtcgggccggtagaagccggttctggtttactgggcgctgaatctttgcatacaggaaaaacctgtggcacctggctgcttgatgcagtcgaagatacctcaggaacaacccccctcgggcaaaaaatccgcttgcgtgtagatccttctatctcccacgtattacgcgctacggctgaagagtatctcgtacagacaacaaagggtgctctggcaaaagccgggcttgaattgaacgatattgactttgttgttgtgaatactccgacagcctggcacgcagagttttcggccagtgtattaggagtagaacttaaccgtgtggtaaatactttcccacaggttgctaatatcgggccggtgttgatgccattcaatgcatatacagccgctgctgccggtgacattaaacccggtgatactgtacttctgtacgggtttggtggtcaggcagaagcttcagccgccatactccgctggcctgacgttattctggca

SEQ ID NO: 23967 - DNA, 1767 bp, Xenorhabdus nematophilus
gggattgatcttggtacaacacactccctggttgcgacagtccgcagtggtcaggctgagaccttagcagatagtgaaaaccgtcacttgcttccttcagttgtacaatactgcaaggatgaaattcagatcggctggcaggcccgtcaacaggcggctttcgatcctgttaatacgataagctctgtcaaacgtatgatggggcgctctctggctgatattcagcagcgttacccgaatcttccttatcaatttcaggccagtgaaaatgggttgccgttaattaatacagcggcaggtttggttgatcctattcaggtttcttctgacatattgaaatcgttggctcaacgggcagaagaaacactggatggtaaacttgatggtgttgttatcaccgttcctgcttattttgatgacgctcagcgtcagggcacgaaagatgcggctcgtttagcgggtttgcatgtccttcgcctcctgaatgaacctactgcggctgcgattgcctacgggcttgattctggtcaggaaggtgtgattgctgtttatgatctgggcggcggaacatttgacgtttctatcctccggttgagccgtggtgtttttgaagtattggcaacgggcggtgatactgcactgggtggtgatgactttgaccatctgctggcagactggatccgtgagcatgccgggattaccgataccaaccacgggttacagcgtcaattactggatgttgcgacacaaaccaaaattgcgttgagtgatgcagattcagtctcaattaattttgctgactggcagggcaatattacccgcaccgaattcaatgaattaattacaacactggttaaacggactttattggcttgtcgtcgggcattgaaagatgccggcgtgacagctgacgaagtcttgcaggtcgtgatggtgggaggctcaacaagagttccgctggtgcgcagcatggtaggcgaattttttgatcgtgaaccgctgacctctatcgatccggacaaagtagttgcggttggtgcggcaatacaggcggatattctggcaggtaacaagccagacagtgaaatgttgttgctggatgttattccgctgtcactgggccttgaaacgatgggcgggctggttgaaaaggttattccgcgcaacaccactattcctgtcgcaagagctcaggaatttacgaccttcaaagacgggcagagtgcaatgagcatccacgttgttcagggtgaacgcgaactggtggcagattgtcgttctctggctcgtttcactctgcggggaattcctccgttgccggcaggtggtgcgcatatccgcgtgactttccgggttgatgctgatggtttactgagtgtcagtgcactggagaaatcgacgggtgttgaagcctctattcaggtgaaaccttcttacggactgtctgatgaagaaatcgcccgaatgatcaaagattcaatgagtaatgcgcaggaagatattcaggcgcgtaaattggccgagcaaaaagtagaagcagcccgcgtgctggaaagcttaaccggtgcgctggaaaaagacgctgatttactcagtcaggaagaacatgctgcaattgatgctgccgtacaagtattaattgaaagtgctcagggaacgtctcctgaagcgattgaaagtgcaattaaacaattggacaagcaaacgcaggaatttgctgcgcgtcgcatggacacatcaatccgtcgggctttggcgggtcattct

SEQ ID NO: 23968 - DNA, 1728 bp, Xenorhabdus nematophilus
attaataaaaccacaaagaaaaataaaaccacaaaaaaagtcttaatcgcgaatcgtggggagattgccgttcgtattattcgtgcctgtcgtgattatggcatacagactattgctgtttatgctgatacagatgtcaacgcgttgcatgtgcaactggcggatgaagcctattcactggcaggaaatagcccggcagaaacctatcttaatattcctcgtttgttggatattgccaagcaagcgcaggctacgatggtacatcccggctatggttttttatctgaacgggctgaatttgcccgcgctgttattgaagccggtttaatttggattggcccggaatccgatacgattgatgaattggggaataaagttaaagcccgccaaattgctcagaaagttggagcaccgttagtcatgggaacggcagagccggttaaaaatgcgcaggaagttatcacttttgctgaaaagcatggtttaccgatagcgattaaagcggcatttggcggcgggggccgtgggttaaaagtagcatggcggcatgatgaagttgaggagttgtatcactctgcggtgcgtgaggcgacagctgcatttggccgtggcgaatgttttattgagcagtttctggataagccccgtcatattgaggcacagataattgcagataaacacggaaatgtggttgttttaggcacccgtgactgctccttacagcgtcggaatcagaaactggtagaagaagccccggccccttttttgactcagcaacaacgggagcgcattcatcagtcggcaaaagcgatttgtgcagaggctaattatgtcggagcaggaacggttgaatttttgctgagtgttgatggaacactctcctttctggaagtgaatacccgtttacaggttgagcatcctgtgacggaagaaacaaccggaattgatttagttattgagcagttgagaattgcagaaggctacccattaagcattcaggaaacccctatttctcgcgggcattcgtttgagttccgcatcaatgcggaagatgccggaaaaggctttttgcccgcatctggcgctcttaccgaatttatcccaccttctggccccggtattcgtttagattcaggcgtaatcaatggctctgtcattccgacaacctttgattcgttgatggcaaaactgattgtcacaggagcaacgcgtgaacaggctcttgtccgtgcgcgtcgggccttacgagaatttaaaatcagtggagtagcatcagttttaccttttcatcaggcggtgattgaacatcctgattttgtatcagaggatactttcaacgtccatacccgttggattgagacagaatttgccaatcaactggcagctttactccgtcaggatctggctgaaagcaaaggcatcatccgtacatttattgagattgatggtcgtcggcatgaaatgggattgccagcggatttattggcaggattaacgcctttagtgcctgctggtgagccacaatcttcttcgccggtagtccaacaaataccggaagatcctcatcaggtaaaaacacccatatccggtatcctgcattcgtggctagtacaggagggagagcaagtcaatgaaggagatgtgattgctatcatggaagccatgaaaatggaagtacagataaatgcacatcgctcagggaaaatcacattccgtgctcaggaaggt

SEQ ID NO: 23969 - DNA, 1365 bp, Xenorhabdus nematophilus
atgaatttactactcattatcaatgtgctggtttttacagcactactcgttatattagcaaaaacgagttcagatcaatggagtctatccaaaaaagttcttattgccttagttgttggtgtcttttttggattagtattaaatgttatttatggtgcacataacccgatagtgaaagaatcaattaaatggttcaacatcgtcggcaatggttatgtgcaattgttacaaatggtcattatgccattagtctttgcttctatactcagtgcagttgcacgtctgcataaggcatcctccttaggtaagatcagcttactgactattggtactttactgtttaccacagcgatttctgctttaatcagtgttgttatcgccaatatgtttggattgaccgctgctggattagttcaggggacacaagaaactgctcgtctgtcagcaattgagacaaactatattaatcgggtttcagacctgagtgtaccgcaactaatcctctcttttattcctaaaaatccatttgcagatcttaccggagcaaatccgacctcaattatcagcgtcgtcatttttgcaacatttttgggaattgcagctctgcaaatgctgaaagatgaccatgaacgcggtgaacgtgctcttatcgcaattgatactatgcaagcatgggcaatgaaactagtcaggctggttatgcgccttaccccatatggagtaatggcattaatgaccaaagtagttgccagttctaatattcatgatattgcccaattaggtaactttgttgttgcttcttacattgctataggtctaatgtttgttgtacacggtattcttttagctataacaggcatcaacccactaaaattcttgaaaaaggcaggccctgctctgacatttgcttttaccagccgctcaagtgctgcaagtattccgttaaatgtagaaacgcaaacacgtcgcattggtgttcctgagtctatagcgagcttttccgcctcattcggtgcgactatcggccaaaatggttgtgcaggaatttatcctgctatgttagcggctatgattgctccaacagttggtattgatccttttgaccctctatggattgcaactctagtggggattgtgactatcagctctgctggtgtggctggtgttggtggtggtgctacgtttgctgcacttattgttctgccagcaatggggttgcctgtcactttggtcgctttattaatctctgttgaaccactgattgacatggggcgtactgctctaaatgttaacggagctatgactgccggtacaattaccagtcagttaatgggtaaaactgataaaaagttatttgaccaggat

SEQ ID NO: 23970 - DNA, 822 bp, Xenorhabdus nematophilus
gtcgataacgctactgtcacttacaacaacggccatactgcaatttatgatgcgagctttgatatcacaggcggcaccatatgtgcattagtaggaatgaatggcagtgggaaatcgacattattcaaaactattatggggttagttactccatctcaaggaaaagttacccttaatgagcaatccataaaaacagcactgaaaaagaatatcattgcatacgttccacaaactgaagatgtagactggaactttccggttctggtttctgatgttgtgatgatggggcgctatggaaaaatgggcttccttcgcaggcccagtaagctagaccatcaaatcgtaaatcgctcactagagcgagtcgggctgattgaactgcgtgacagacaaatcggtgaactttctggtggacagaaaaaacgggcatttctggcacgcgcactggctcaggaaggaaaggttctacttttagatgaaccttttaccggggtagatgttaaaactgaaaatgccattattgatttgcttcgtgacctgcgtgatgaaggacacttaattttagtctccacacataacctcggcagtgttcccgaattttgtgaccatgttattttgattaatcgcaccgttctggccagtggcccaactgaaactacattcacgcagaagaatctggaaaccacatttggcggtgttttacgtcatatcaatctctccggccctgaactccatgacgatgacgatcctcgttccctgaccgtcattacagatgatgagcgcgctgccgtattttacggtcatgataatcatgttcctcca

SEQ ID NO: 23971 - DNA, 2775 bp, Xenorhabdus nematophilus
atgacagaggtaaccgtaaaattactggcagaagagatccagacatcggttgaacgcctgatccagcaattcactgatgctggcattcagaaaaccgcaactgactctgtttcccagaaagaaaaagaagctttgctggcccacctgaaccgcgaacaaggcggtactggtggccagccaggtaaattgacactacagcgtaaaacgcgcagtacactgaacgtccctagcaccggtggcaaaagtaaatcggtagcgattgaagtccgcaaaaaacgcacatatgtgaaccgtgacgcgattgaacaggctaaagcggaagaacaggcgcagcgtgaagcggaagagcaggctcggcgcgaggcagaagagaaagcgcggcttgaaactgaagcgaagaaactcgcggaagagcaagctcaacgtgaagcggaagaacaggcaaaacgcgaagcagaaaagcaagctaaacgtgaagcagaagaaaaagccaaacgtgaagaggctgaaaaggctcagcgtgaggcagcggaaaaagaaaaagtgactactaagcaacataccgaaaccaagtctaaatcagtgcaaactgaggcagcagcgcaaaatgaaaaagcgcgccgtgaagctgaagcagcaaatttaaaacgcaaagctgaagaagagatgcgccgtaaagttgaagcagaagcaaaacgtgtagcagaagaagcacgtcgcatggcagaagagaataaggataaatggtccaacgatgctgatgtaaatgacaacagcaacagtgactaccatgtaacaacttcccgtcatgcccgtgatgcggaagatgagaatgacgccaaagttgaaggcgatcgtcgtacccgcagccgcggtggtaaaaacacccgccagaagaaaaataacaaacattctgaatcgaaagctgatcgtgaagaagcacgtgcagttggccgtactaaaggcaaacagcgtaaaccgagtgctttgcaacagagctttaataaacctgtcgttgccgttaaccgtgatgttgtgattggtgaaaccatcacagttgctgaactggctaacaaaatggcagtaaaaggttctcaggttatcaaaaccatgatgaagatgggcgcgatggcgactatcaatcaggttattgatcaggaaaccgctcagctggttgctgaggaaatgggtcacaaagttatcctgcgtcgtgaaaacgagctggaagaagcgctgatgagtgatcgtgacactggtgaaacacaggctgaaccacgtgcgcctgtcgtaactatcatgggccacgttgaccacggtaaaacctctttgctggactatatccgttcaaccaaagtggcatctggcgaagcgggtggtattactcagcacatcggtgcataccatgtgaaaactgagaaaggtatgatcaccttcctggataccccgggccatgctgcatttacctccatgcgtgctcgtggtgctaaagcgaccgatatcgttgttctggttgttgcggcggatgatggcgtgatgcctcagaccatcgaagctatccagcacgctaaggctgctaatgtgccggttgttgttgcggttaacaaaatcgataagccagaagctgatccggatcgtgtgaaaaacgaattgtcacagtacggcatcattccggaagaatggggcggcgagactcagttcatgcatgtatcagccaaagctggtcttggtattgatgaattgctggaagctatcctgctacaggctgaagtactggaactgaatgcagttcactctggcatggcaaacggtgtagttatcgaatccttcctggataaaggccgtggcccggttgctaccattctggtgcagtccggtacgctgaataaaggtgatatcgttctgtgcggctttgaatatggccgtatccgtgcgatgcgtaacgaacttggtcaggaagtaatgactgcgggtccatccattcctgtggaaatcctgggtctgtccaacgtaccgtctgcgggtgatgaagcgactgttgtacgtgacgagaaaaaagcacgtgaagttgctctgtatcgtcagggtaaatttcgtgaagtgaaactggctcgtcagcagaaatctaaactggaaaacatgtttgcgaacatggaagaaggtaaagtatctgaactgaacatcgttctgaaaactgatgttcagggtacatgcgaagcaatttgtgattcactgctgaaactgtctactgacgaagttaaagtgaagatcattggttctggcgtaggtggtatcactgaaactgacgcaacactggccgcagcttctaatgctatcattctgggcttcaacgtacgtgctgatgcttctgcacgccgtatcattgaaaacgaaagcgttgacctgcgttactactctgttatctatagtttgattgatgaaatcaaacaggcgatgagtggtatgctggcaccagaatacaaacagcaaatcatgggactggcagaagtccgtgatgtcttcaaatctcctaaatttggtgcgattgctggctgtatggtgacagaaggtaacatcaagcgtaataacccaatccgtgtactgcgtgacaacgtggttatctacgaaggtgagctggaatctttgcgtcgctttaaggatgatgtcaacgaagttcgtaatggtatggaatgtggtatcggtgtgaagaactacaatgatgttcgcgttggcgatatgattgaagtcttcgaagtggttgaagtgaaacgctccatc

SEQ ID NO: 23972 - DNA, 1596 bp, Xenorhabdus nematophilus
attgtgattggcacagcattgctggcagggtgtgcaaccaagccagctaatgaatcatcaaatatcgtggatgtacgagttctgggtctgaatgattttcatggcgcgttgaaggcacctaaaaatcagtccggcggtattgaacatatggcaacgctgattaaagagctgaaacaggataacccaaataatatcgtggttgccgccggtgatttgattggtgccagcccgctgctttcctcaatgttccacgatgagcccagtattgaagctctgacccttgccggtctggaagccacttcggtggggaatcacgaatttgataaaggtaaaactgagctgttgcgtaaacagaatggtggctgccatccggtaacaggttgtcaggggccagcaccatttaaaggcgctgggtttcagtatctgtcggctaacgtcacagtcaatgaaacaggtaaaaccttattcccggaatatgtcattaaagaatttgaagggattcctgtggcctttattggcctgacactggaaggcacaccggcaattgtaacgcctcagggaacggctggtctgagcttttccaatgaagttaaaactatcaatgcactggtgccagaattgcagaaaaagggtgtaaaagccattggggtactgatccacgaaggtgcaatgcaaagacgtgacgctggtggtgttgatgttaatgcctgcaatggtataaccggaaaaatcatcgatatcgtcaatcagttggatcaagaagtggatttcgtgatcagcggccatacacatcaggcttataactgcgtgattaatggtaagtcggtcacttctgctcaggctaatggcgctttgctcactaagctggatctgaaactggataaaaccaccagagacgttgtcgatttcaaagcgaaaaatatttgggttgataactataaatatggcaaagacccgaaagtgacagagttattatcttcttacgaaaaaatagcgacgcctctggcaaatcgcgtgatcgggaaactggaaagtgatctgaataagaaaccgacatccggtggtgaatctgcgttgggtaaagtgatcgcagatgcacacctgtatgccacaacggcaaaagagagtggcggtgccgtgattgcttttgtaaataatggcggtatccgtgcgccaatggatgcaggggatgtcacttataacgcgatttacaccgtgcagccgttctctaatgtgatggtgactaagacactgaccggtgaacagatcaagcgtgcgttggaacaacagtgggatcgcacgcgcccaagtgtgatggcggtatcccatactcttgaatactcgtgggatagttcaaaaccggcaggccagcgagtgatcgccagctctatgaagattaatggcaagccagttgatatgaaagccaaataccgtgtagcggctaacgaatatctggcaaccggaggcagtaatttctccgtatttaaagaaggcaccgatccggtatacagtgttcctgatgtggatgcggtggtgaaatattttgccgagaaatcaccgattgcttacccgaaaaaagacaggatcacggatata

SEQ ID NO: 23973 - DNA, 630 bp, Xenorhabdus nematophilus
atgaacagcaaatttattgttattgaagggcttgaaggagcaggaaaaaccacggctatccagacagtgtctgatacactgaaacaatccgggatttctgatcttgtttttacccgtgagccgggtggaacaccattagcggaaaaattacgccagatgatcaagcaagggatcgaaggtgaaatattgacggataaagcagaagttctgatgctttatgctgcccgggttcagttggtggagaatgtcatcaagcctgcactggcaaaaggttgctgggttgttggggatcgccatgatatgtcatctcaggcatatcagggaggcggacgtaacattgaccaacatttattggcttcactacgtgaagcagcgctcggtgatttttcacccgatctgactatttatcttgatttaccgccagaggttggcctacaacgtgcccgcgaacgcggtgaactggatcgtattgaaaaagaatcattagattttttccatcgtacccgcacaagatatcttgaattggtcgcacaggataaatccattataaaaatagatgcaacgcagccattggaaaaagtacaggatgacattcgtcaggctctgcaatattggctggaaaaacaggaa

SEQ ID NO: 23974 - DNA, 1188 bp, Xenorhabdus nematophilus
gtgttccagaatgttgatgcttacgcaggtgatcctattctttcgttgtcggaagagtttaaaaaagatccccgtccagaaaaggttaacttgagcattgggctttattacgatgagcagggtataactccccaattgcaggctgttgcaaccgcagaagaacaaataagtactctgccacagtctgcttctctttatcttccaatggaaggtttaatggcttaccggcaggtagttcaggaattattattcggtaaagatcatttaatgttgcagcaaaatcgcattgcaactatccagacagtcggcggatcaggagcactgaaagtcggtgctgactttttacatcgttatttccctgattctgaagtgtggtgcagtgatcctacatgggaaaaccatgcttcaatattctctggggcagggataaaagtaaattattacccttactttgatgataaaaccaaaggggtaaaatttgatgaaatgctggcaacgttccggcaattaccagcaaaaagtattatcctgatgcacccttgttgccataatccaacgggttctgatctgactaatgaccaatgggatcaggtcattcaggtagttaaagagcaaaagttaattccatttcttgatatcgcttatcaggggtttgctgaaggcattgaagaagatgtttatgcaattagggcgatggcgagtgctgaactaccttgctttgtcagtaattcattctcaaaaatattttccttatatggcgagcgcgttggtggcttatcggttatttgcgacgataaagaaacgaaagaatgtgtcttggggcagctaaaagcctgcgtacgtcgtatttattccagtccgcctaattttggcggtcaggttgtggcgagagtattagctgatccattactgagggaacagtggctgagagaagttgaacagatgcgtttgcgtattcgggaaatgcgcactgtgctggtatctgcattgaaagaagcattaccggagaaaaactttgatcatttgcttaaacagcgtggcatgttcagttataccggatttagcactgaacaggttgttcgtctgcgtgaagaatttgctgtttatctgattgaatccggccgggtttgtatggcaggtgtgaatcatcataatgtacaacgtgttgttgaagcatttgtggctgtg

SEQ ID NO: 23975 - DNA, 237 bp, Xenorhabdus nematophilus
atgccacagaaaaaaaactctgacgaattacgtgctgaattacagtcccttgcggatactctggaagaagttctcaacagctctggtgaacaatccaaagcagaactggagaaaattcgcaataaagcagagaaaatgttgaaagatgcccgcactgttatcagtgatgccggtgataaactcacaggccagaccaaagaaatagccggtcgtgcagataattatgtccgcgataat

SEQ ID NO: 23976 - DNA, 1140 bp, Xenorhabdus nematophilus
atttatatttctgccgtaggcatgcttaatgccttgggtaataatgtagatgacattgcacagaatctggtttccgggcacgctcccggcatgtatgcgcgctcaggctggttacagcctgataaaacctgctgtctgggaggcgttgatgctgaattgcctgctattcccccgcatttgcaccagcataatagccgcaacaaccaactgttactggctgccttaatgcagataaaaccccaagtggataaagccatagcacaatatggacgggagcgggttgcagtcattatgggaaccagtacttccggccttaacgaaggtgatactcatgtcaaccggacagttaaccaacaacccgatgaatcctatcactattatcagcaagaactaggcgatccttcccgatttattgccaattaccttgaattgacaggaccggctttcaccatttccaccgcctgctcatccagttcacgggcgattatcagtggtcagcgtctgatcgagatgggaatggttgatgtggcgattgtgggaggagcggatacccttagccgtatgccgatcaacggtttcaatagccttgaggctctctcggaaacattgtgtgaaccattttgccaggatcgtcagggcatcactatcggcgaagcgtctaccctgttgttgctaacacgagaaccccactccgtagcactgcttggtacaggggagtctagtgatgcatggcacatgtcagccccccatcctgaaggaaagggtgccactgaagctattaatatggcattgagtaatgcaggactctccacacaagagattggctatatcaacctgcacggaacgggaacaaaactcaatgaccagatggaatcactgatcatcaatcagctctttggcgagagtaccccatgcagttcaaccaagcatttgacaggccatactctcggtgccgctggagcctgtgaagctggtttgtgctggctgttgctgagccggaaattacccttaccagcacaggatttctcccgttcgggaatagatacttcgttggcaagctgtggccttctggcacaatctgtgctgttagaaaaaccggttatcatgtccaactcctttgcttttggcggaaataacacc

SEQ ID NO: 23977 - DNA, 717 bp, Xenorhabdus nematophilus
tcagttttagtcactggtgccagcaaagggatcggcagggcaatcgcctgccaattagcagcagatgggttcaccactattgttcactatcaccgcgatgcgaaaggtgcagaagcaacgctggaacagatccaggctaacggtggcaacggacggatattaagttttgatatctcagatcgcgatgcctgccgtacaacattagaaaaagatatcgaagtacacggtgcttactacggcattgtttgtaatgctggtatcgctaaagatggagcatttccagcacttgacggaagtgactgggatagtgtcattcatactaatctggatggtttttacaatgtgatacatccctgcatgatgccaatgattggactacgtcagggtggtcgcattatcacgttgtcatctgtctccggtttgatggggaaccgtggacaagtcaactatagtgcggctaaggccggcattatcggcgcaactaaagcgcttgcaatcgaactggcaaaacgaaaaatcaccgtgaattgtattgcaccaggattaatcgataccgatatgatccaaattgaagaaatcgctttaaaagaagctatgaatatgatccctatgaagcgcatggggcaggcaaatgaagttgccgggcttgccagctatttaatgtctgatattgcaggctacgtcacccgtcaggtaatttccgtcaatggaggaatg

SEQ ID NO: 23978 - DNA, 1221 bp, Xenorhabdus nematophilus
cgcagagtcgtcatcacaggaatgggtgggatcaccgctttggggcacgactggcaatcggtctcctctggattaaaatccggcgtgaatgcagtgcagcaaatgcctgaatgggcagaatatgatgggcttaatactcatcttggggctcccgttactgattttactttgcctgatcactatacccgcaagcgtatccgctctatgggacgtgtttcactgatgtccactcgggcaactgaactggcgcttgaaatggcggggctgattggctatcccatcctgacaaatggtgaaaccggtattgcttatggttcctcaacaggcagcactaaacccgtcagtgaattcgccaccatgctaaccgaaaaacataccaataatattaccggcacaacttatgtgcagatgatgcctcataccactgcggtcaacacaggtctgtttttcgggctgcgtggcagagtcattccaacctcaagcgcttgtacctctggcagtcaggccatcggttatgcatgggaagccattcgtaatggttatcagactgtgatggttgctggtggtgctgaagaattgtgcccatcggaagccgctgtatttgataccctattcgccaccagccagaaaaacagcgaaccaaaaacaacgccttccccatttgatgctaatcgtgacggcttagtgattggcgaaggcgcaggcacccttattctcgaagagctggaacatgccagagcacgtggtgcaaaaatttacggtgaaattatcgggtttgccactaactgtgatgcctctcatatcacccagccaaaatcagaaacgatgcaaatctgtatggaaatggcgctgaaatcagccgggcttcaacctgcggatattggttatatcagcgctcacggtacagcaactgagcgtggagatgtcgcggaaagtcaggcgactttcaacatctttggtaacagaacgccgatctcctcactgaaaagctatttcggtcacacactgggtgcctgcggtgctctggaagcatggcttagtattgaaatgatgaatgaaggctggttcgcaccgaccatcaacttgaatgaagttgatccggcttgcggtgaactggattacattatgcatcaaccacgtacaatccagactgagtttatccagagcaataactttgcttttggcgggattaatacttcattggtgatcaagcgttggcaa

SEQ ID NO: 23979 - DNA, 810 bp, Xenorhabdus nematophilus
  unsure (1)..(810): unsure at all n locations
atggataaattcgcggtttttggtaatccgatcgcacatagtaaatctccttatattcatcaattatttgccaaacaaacgggtattgaacaccaatatgggagaatacttgctccgttagaacattttgaacaaacattgaagcaattttttgagcaaggtggtttaggtgcgaatataaccgttccctttaaggaacgagcttatgagtatgcacatcaactgagtgagcgagctaaacactgtggtgcagtcaacacattcaagctaattgaaaataaccagcttctgggtgataacactgatggggttgggttattagcagatntgcagcggcttaacttcattagcaaagggcagcatatcctgattattggggctggtggagcagcaaaaggagttatatctcctttactagactttggatgtacggtgactattactaaccgtacttttgctcgtgcacagggtatagtgaatatattctcctcatttggtcatattcaggcagttgaaatgaagtctcttctgaccccatattttgatcttattattaatgcgaccgcttctggccttgatggaagtgtacctgaaatatctccatcaattttccgtaatggtggtgcttgttatgatatgtattatcaaaaaggattaacgcctttccttagttttgccaaggaaagcggagcctcatttttggctgatggattagggatgctagtgggacaagcggcgcatgcttttgaactttggcatggtgtcttaccaaaagtagaacctgttttagctgctttaagagaagaatta

SEQ ID NO: 23980 - DNA, 801 bp, Xenorhabdus nematophilus
atgtctgttcctgcatttggattaggtacttttcgtctgaaagatgatgttgtcatagcatcggtaaaaaacgctcttgagctggggtatcgcgcgattgatactgcgcagatttacgaaaatgaagcagcggtaggccaagcgatagaagaaagtggtattgcccgtgaagacatttatattacaacaaagatctggacagaaaatctgagcaaagaaaaagtgatatcaagccttaaagagagtcttgtgaaactgcgcacgaattatgtggatttggcactcattcattggccgtcaccaaataacgtggtgagtgttgcagaaacaatgaatgcgttgctggaagctaaagaaatggggttaacacgtgaaatcggtgtttcaaatttcaccattgatttgatgcaacaggctattgatgcggtaggcgctgaacatattgccacgaaccagattgagctttccccttatctgcaaaatcgtgatgtcactgcttgggcacaagagcatggtattcatatcacttcttacatgaccttagcgtatggcaaagcgattcatgatgaggttatcggtcgcatagccgaaaaacaccagtcgactcctgcacaggtcattttgtcttgggcaatgtcattggggtatagcgtgatcccttcttcaactaagaaagagaatttagcgagcaacttaaaatctaccgcattgaaacttgatgcagatgacatggccgctattgctactcttgaatgtaacgaacgtatcgttaatccggaaggccttgctcctcagtgggat

SEQ ID NO: 23981 - DNA, 1814 bp, Xenorhabdus nematophilus
ttgttgaatatagaccaattatcggtgcacttcggagatgaagatgcaccattccgcgccgttgaccgtatcagctacagcgttgagcaggggcaggttgtcggtattgtcggggagtcaggttcgggtaagtctgtcagttcactggcgattatggggctgatagattatccgggcaaagtaatggccggaaaactggagtttgatggttgtgatctgacaaaaatttctgaaaaagaacgtcgtcagttgattggtgcggaagtttcgatgatttttcaggatccgatgaccagcctgaatccctgctataccgtgggttatcagatcatggaagcgttgaaagtccatcagggcggcagccgcaaaacccgttatcagcgggcgattgatttgctgactctggtgggcattccggatcccgcttcccgtttagaagtgtatccacatcagttatcaggcggaatgagccagcgtgtgatgattgcgatggcaattgcctgtcggccaaaactacttattgcggatgaaccgacaacagcactggacgtcactattcaggctcaaattattgaactattgcttgaattacagcagcaggagaatatggcgctgatcctgatcactcatgatttggcgctggttgccgaagccgcacagcatattattgtgatgtatgcaggtcaggtagtggaagccggaagggcgactgaaatattcaaagcgccccgccatccttatactcaggcattattgcgggcattaccggaatttgcggtagacaaggcccgtctggcctcgttgccgggtgttgttccgggtaaatatgatcgtcctgtcgggtgtttgcttaatccgcgctgcccttatgccacggaacgttgctatcaggtagagcctgcattgcaattggttggagaacgtcaggttaaatgccatatgccgctggatgataaggggaggccgacgatatgagtattcaagaaacggttatgcacaaacaggctgttcacaacacgagtgggcaggaaaaagcttccgtccctttgctgaaagcgacagagttaaaaaaatattatccggttaaaacgggggtattttcacctgagcgtatggtgaaagcattagatggcgtctcatttgaactggaaaaaggcaaaacgctagctgtcgtaggggaatctggctgtgggaaatccacgttagggcgcctgctgactatgatagaaaagccgacagaaggggaactgtattatctggggcaggatttattgctgccagataaagaagccgaaaaactgcgacgtcagaaaatccagattgtattccagaacccttatgcatcattgaatccacgaaaaaaagtggggcagattctggaagagcctttacttatcaatacaacactgacatcagaagagcgcagagaaaaagttctgcaaatgatggagaaagtcgggctaaaatctgaacattaccagcgttaccctcatatgttttctgggggacagcgccagcgtattgccattgcccgtggattaatgctgaatcctgatgtggttattgcagacgaacctgtttccgcgctggatgtttcggtacgggcgcaagttctgaatctgatgatggatttgcaacaagaactgggtctgtcatacgtatttatttctcatgacctctctgtcgttgagcatattgcggatgaagtgatggtcatgtatttggggcgctgtgttgaaaagggcgacaaacatacgattttcaataatcccagtcacccttacacgcaggccttgttgtctgcaacaccgtgt

SEQ ID NO: 23982 - DNA, 1341 bp, Xenorhabdus nematophilus
atgaatgtaccatcatctttagtctcatttcttgaatctgttcagtatcacaatccacatcaaccagaatatttacaggcagtaagagaagtattgacctctctctggccttttcttgagcgcaatccgcaatatcgtgaacaggggttattagagcgtttggttgaaccagaaagagttattcaattccgcgtcagctgggttgatgatcagggaaaggttcaggtaaaccgcgcatggcgggtacagttcaattcggccatcgggccatttaaaggcgggatgcgttttcacccttccgttaatctctctattctgaagtttctgggttttgagcaaacattaaaaaatgcgctgacaacattaccaatgggcggtggaaaaggtggttctgatttcgatcctaaagggaaaagtcagggtgagattatgcggttctgtcaggcattaatgaccgagttgtatcgccatctggggcctgatactgatgttcctgccggagatatcggagttggtggccgggaagtggcgtttatggccgggatgatgaaaaagttatccaacaacacggcctgtgttttcacaggtaaagagctttcttttggtggcagtctgatccgcccggaagcgacgggttatggtctggtttatttcattcatgcgatgctgaaacgtcatggtatggcgctggatggtatgcgggtatcggtttcgggagcaggaaatgtcgctcaatataccatcgaaaaatgtctggaactgggggctaaagtggtgacggtatccgattccggcggtactgttctggatgaagaaggattcactccagagaaactggctcatctggaagagattaaaaataaacgttatgggcgtgttgaggattatgccaaagaacgtgggctgactttccttgaggggcaaaacccgtggtcagtgcctgtagatatcgctctgccttgcgcgacacagaatgagctgcatttggaagatgcgaaaatactgattcagaatggtgtgaaattggtagcagaaggagccaacatgccggcaactatcgcagctactgatgctttccttgaagcaggtgttctgtttgcgccgggtaaggccgccaatgcgggaggtgtagccacttccggcctggaaatgtcgcagaatgcgatacgccagaactggaaagcagaaaaagtggatatccgcttacatcacatcatgctcgatattcaccaatcctgtgtggaatatggtggagaaggcaaacagatcaactatgtacagggtgcgaacatagcgggctttgtgaaagtggctgatgccatgctggcgcaagggattttg

SEQ ID NO: 23983 - DNA, 762 bp, Xenorhabdus nematophilus
tcgcggcttaaagcccagagtctttcactggcatacggtaaaaaaacgattattgaagatattaaccttgcaatccacgataacgaattcagcgttattattggccctaatgggtgtgggaaatcgacgttgttgcgggcaattagccgaagtatgcagccacaacacggtgaaattcaacttgatggaataaatatccatcgttataagccaaaagcggttgcacgtgagttgtcattgttaacccaaggggcaatagtgacggaagcgttgacgatttatgaccttgtttcccgcggtcgctatgcttatcagactttcctgcggcaatggtcagaagctgatgaacgcattgtcagagaagccttacaggctgtcgatttatgggatatgtcggaaaaatttgtcagcgaactttcaggaggccagcatcagcgggcatggtttgctatgacactggcacagcaaacgccgattattctgttggatgagccgacgacttatctggatatttcccatcagatcgaaatgcttgatttatgccaacgcttacatcagcagggaaaaacattggtattggttttacacgatattaatttatcactgcgctatgccacccgattaattatgatgaagagtggccatatttatgcggaaggaaagcctgaagaaattatcacggagcagagcattgccgatgtatttggtctggcatgtcgtattatccgtgatcctgaatcggataagccattaattattccg

SEQ ID NO: 23984 - DNA, 1062 bp, Xenorhabdus nematophilus
atgcaaaaagatgcgcttaataacattcacattctcgatgaacaagttctgattacaccggaagagctgaaactaaaatatccattgagtagcagtgacttgaatgctattacaaacgcgcgtaatactattgcagatatcatccatcatgatgatccccgtttgttggtggtatgtggcccatgttctattcatgatgtggatgccgctcttgattatgcccaacgcctgaaatcactttctgccgaactgagcgattgtctgtatattgttatgcgtgtctatttcgaaaaacctcgtactactgttggctggaaaggcttgatcagtgatccttacatggatgggtcgtttgatatggatggcggattacatattgcccgtcgtttattactgaatctggtagaaatggggttgccactggcaaatgaagcacttgatcctaacaatcctcaatatttgggcgatctttttagttggtcagcgattggagcaagaacgactgaatctcagactcaccgtgagatagcttcaggcttatcagtatcagttggttttaaaaatggtacagatggtaatttaaatacagcaattaatgcgatgaaagctgcctcaatgccacatcgctttatgggaataaatcagtctggtcaggtgtgcctgctgcaaacccggggtaatccaaacggccatataatattacgtggtggggcagagcctaattatagtgctgagcatgtgcgtgactgtgaaaatcagatggttaaggcaggtttagttccatcactgatgattgattgtagtcacggtaactctaataaagattttcgtcgtcaaagtgttgttgtggattctgtcgctgagcaaattatgcaagggaatcaatccatcattggtatcatgttagaaagtcatattaatgaaggaaaccagtcttccgagctaacccgttctgaaatgcaatatggtgtttctgtcactgatgcttgtattagctgggaaacgacggagcaggtattaaaaaaattacatcagcaaatcaagccacatttatcaaaacga

SEQ ID NO: 23985 - DNA, 1752 bp, Xenorhabdus nematophilus
atgcgtctggatcgtcttactaataaattccagcttgctctcgctgacgcccaatccctcgcattagggcgtgataatcaattcatcgaacctatccacttgatgagcgcatttctcagtcaagagggtggctctgttcgtcctttattaatgtctgccgggattgatacaggaaacttgcatgatcgactgaatctagctttggacagattaccaaaagtagaagggagtggcggtgatgtacaggtatccaatgaattagggcgttatttaaacctgtgcgacaaacttgctcagaaagcaggtgataactttatttcttctgaactctttgttctggcagcactggaagagcgtggaacgttaagtgacatattaaaagctgcaggagcaacaaaagacaaaatcactaaggcaatagaaatgatgcgcggtggtgaaaaagtaaatgatcagagtgccgaagaccaacgtcaggcactaaaaaagtacacaatagatctcactgaacgagccgaacaaggcaaacttgaccctgtaattgggcgtgatgaggaaattcgacggacaattcaggtattgcagcgccgaaccaagaacaatcccgttttgataggtgagccgggcgttggtaaaacagctattgtcgaagggctggcacagcggattgttaatggtgaagttcctgaagggctgaaaaacaaaagagtcctgtcccttgatatgggcgcattattggcgggagctaaataccggggagaatttgaagaacgtttgaaaggcgttttgaacgatctctccaaacaggaaggttcggtcattctgtttatcgatgaattacatacgatggtaggtgccggtaaggcagatggcgcgatggatgccggtaacatgctgaaaccagcactagcccgtggtgagctgcattgtgtcggtgcgacgaccttagacgagtatcgccagtatattgagaaagatgcggctctggagcgtcgtttccagaaggtttatgttgctgagcctaccgttgaggatactattgctattctacgcggacttaaagagcgctatgaacttcaccaccatgttcagataactgatccggcaattgtggcagcggcgacattatctcatcgttatatttcagatcgcatgttacctgataaagcgattgacttgattgacgaagccggagccagcctgcgtatgcagatggattcaaaaccagaagcgttggatcgtctggaacgcaggattattcagttaaaactcgaacagcaggcgctaaaaaaagaatcggatgaagcgagtaaaaagcgccttgatatgctgaatgaagagctggtggaaaaagagcgcgaatattctgaactggaagaagagtggaaagcggaaaaagctgagcttactggtactcagaatatcaaagctgaattagaaaatgcccgtatagaattggaaaaagcccgtcgcagtggtgatttggctagaatgtctgaaatccagtacgggaaaattccagaattggaaaaacagttagcagcagcaacaacagcagaaaatcaccccatgaaactgctgcgtaacaaagtgactgatgctgaaattgctgaaatccttgctcgctggacagggattccagtatccagaatgctggaaagtgaaaaagataaactattgcgtatggagcatgaattacataaacgtgtaattgggcaaaatgaggctgttgatgcagtagcaaacgcaatt

SEQ ID NO: 23986 - DNA, 519 bp, Xenorhabdus nematophilus
atgagcgatacccagcgaccaaaccacgtttttatattgatgggggtatccggcagcggtaaatctgccgttgccaatggtgttgcccgtgaactgagtgccgcttttttagatggtgattttcttcatccccgcgccaatattcagaaaatggctgagggtcatgccctaaatgatgatgatcgtcaaccgtggctgaaagccctcaacgatgccatttttgccatgcagcgtactaatagtgtttctttgctggtgtgttcagccctgaaaaaacactatcgggatatcctgcgtagtggcaataaaaatctgtcatttttgtatatgcaggggaatcttgaattaattgaaagccgcctgaaagcccgtaaagggcactttttcaaaccgcagatgcttatctcacaatttgagaccctggaagagccgacaattgatgaaaaagatgttcatttcattgatatcaaaccaagtcttgacgaagtaattaaaaatacaatgacaacaattgaacgt

SEQ ID NO: 23987 - DNA, 1029 bp, Xenorhabdus nematophilus
atgaaagcacttgtttatcacggagccggaaaaaaactttgggaagagaaagcgccaccccaactcattgagcccacggatgctattgttcgcattgtcaaaaccaccatttgtgggacagacctgcacatcctcaaaggagacgttcctactgttgagcagggccggacactgggccatgaaggtattggtattgttgagttaatcggcgattctgtccgtaacctcaaagtcggtgataaagttatcatctcctgtattaccgtctgtggtagctgtccctattgtaagcgccagctttatgcgcactgcaaagatgggggctggattctggggcataaaatcgacggtacgcaggcagaaaaagtacgtattccccatgctgataatagccttcatcgcctgccggaagatgttgatgaagaagccgccttaatgctcagtgatattctgccgaccgggcttgaaattggtgttatcaatggcagggttcagccgggccataccatcgccttaattggtgcagggcctgtcggactctctgcgctactggcatcccagttttactctccggcacatatcatcatgatagataccgatgataatcgtctcagcgttgctcagcagtttggtgccaacacaattatcaacccgacacggcaaaacgtggttgaaaccatccacaaattgactgatggcattggtgttgacgttgctattgagtgtgtggggatccctgcgactttccagatatgtcaggatatcatcgccgcaggcgggtttattgctaatgttggtgttcatggcaaatccgtcgatttacatctggaaaatctctggatcaaaaatatcaccatcaccactgggctggtcaatacaagcagcacgcccatgctgttgaaaagcgttcaatccggtaagatttcaccggaaaaattggtcactcaccattattcattgagtgaaatagagactgcttatgacatatttggcaatgccgccaaagagaaagcactgaaaatcgtcctg

SEQ ID NO: 23988 - DNA, 1296 bp, Xenorhabdus nematophilus
atgggtaagaacgttgtcgtattgggcacccaatggggtgacgagggcaagggtaaaatcgtcgacttgctgactgaacgggctaaatatgttgtccgttatcaggggggccataatgcgggccatacattagtcattaacggtgaaaaaaccgttctccacttaatcccatctgggatcctgcgtgaaaatgtcattagcattatcgctaatggggtcgttttagcaccagatgctttgatgaaagaaatgaaacagcttgaatcacgtgggattcctgtacgtgagcgcttgcttatttctgaagcttgtccattgatcctgccttatcatgttgcattggacaatgctcgtgaaaaagcgcgtggtgcgaaggcaatcggtacaaccggtcgtggtatcggtcctgcatacgaagacaaagtggctcgccgtggtctgcgtgtgggtgatttgttcgataaagaaactttcgcagctaaactgaaagaaatcatcgattatcataacttccagctggttaactattacaacgaacctgccgttgatttccagaaaactctggatgatattctggcgattgcggatatcctgactggcatggtagttgacgtttctgacctgctttacaaagcaactcagaaaggtgagctggtaatgtttgaaggtgctcagggtacattactggacatcgaccacggtacttatccttatgtaacctcctctaataccaccgctggtggtgttgcaacgggttcaggtctgggtccgcgttacgttgattatgtactgggtattgtcaaagcttactctacccgtgttggtgcaggtccattcccaacagaactgtttgatgaaaccggtgaatatctgcgccagaaaggtcaggaattcggtgctaccacaggccgtagccgtcgtactggctggctggatatcgttgctatccgccgcgctattcaaatcaactccctgtccggcttctgtatgaccaaactggacgtactggatggcctgaaagaagttaagatctgtgtaggttatcgtcaggctgatggtactgtcatcgacactacaccactggcagcagagaactgggaaggtctggaagcggtatatgaaaccctgccgggctgggatgaaagcactttcggtgtgaaagagcacagtcagttgccagaagctgctctgaactacattaagcgtgtagaagaactgtctggtgttcctgttgatattatttctacaggccctgatcgctctgaaacgatgatcctgcgcgatccatttgatgct

SEQ ID NO: 23989 - DNA, 1050 bp, Xenorhabdus nematophilus
atgaattaccagaatgacgatgtaaagataagaaaaataacagaattattgccaccagttgcattgcttgaaaaattccctgcaacaaaagacactgctactaccgttcgtgaagctcgcgaagccattcataacattttaactggtgcagatgatcgtctattggtaataattggcccatgttcaattcatgacccaaaggctgcactggaatatgcagagcgtctgaataaattgcgccgcgaattgaaagcagatctggaaatcgtgatgcgggtttattttgaaaaaccgcgtactacaatcggttggaaagggttaatcaatgacccgaaaatggattgtagctttgatattaatgatggattacgcacagcacgcaaacttctgctcgatattaatgatattgggttgccggcagcaggtgaattccttgatatgattactcctcagtatctagccgaccttatgagctggggagcaataggagcacgtacaactgagtctcaggttcaccgtgagctggcatcagggttgtcctgtccggtgggttttaaaaacggtactgacggtacaataaaagtagcgattgatgccatcaatgctgccggttcatcacactgcttcctgtcagtaactaaatggggtcattccgccatcgttaatacgacgggaaatcaggattgccatattattctgcgtggcggaaaagagccaaactacagtgctgaacatgtcagcgcggtgaaagaaggcttattaaaagcagggctgaaaccgcaggtaatgattgatttcagccatgcaaatagtgcgaaacagttcaaaaggcagatggatgtaggggctgatgtttgtggtcagatctccgccggagagaatgcgattattggtgtgatggttgaaagccatctggttgaaggcaaccaaagtttggatgatgatgagccgctggtttatgggaaaagtgtaacagatgcctgtattggctgggatgatacagaaacgctattacagcagttgtctcaggctgtcagaactcgccgagga

SEQ ID NO: 23990 - DNA, 750 bp, Xenorhabdus nematophilus
atggctgtaactaagctggttcttgtaagacatggtgagagcgagtggaacaaagagaaccgttttacgggctggactgatgttgaactgtctgataaaggtcgcaatgaagcacaacaggctggtcaattgctgaaacaggaaggttttgcttttgatttcgcctacacatctgttttaaaacgcgccattcatactttgtggaatattctggatcaggtcgatcaacaatggctaccggttgaaaaaagctggaaactgaatgaacgccattatggtgccctgcaaggtctggataaagcagaaactgcggctaagtatggtgatgatcaggttaaattgtggcgtcgtggctttgccatcattcctcctgatctgaccaaagatgatgaacgttatcccggccatgaccctcgctatgcaaacctgaaaccagaagaacttcctgtcacagaaagcctggcaacgactatcgaacgtgttgttccttactgggaagaagtcattaaacctcgcgttgcaaacggtgaaaaagttatcatcgctgctcacggcaattctctgcgcgcactggtaaagtatctggataatatggacgaagacgaaattcttgagttaaatattccaactgctgtaccgctggtttatgagttcgacgagaatatgaagccaattaaacactattatctgggtaatgcggatgaaattgctgcaaaagcagctgctgtcgcaaaccagggtaaagcgaag

SEQ ID NO: 23991 - DNA, 1194 bp, Xenorhabdus nematophilus
caaaaagacatcaccaaaaaacggcttctgacaatagctggcctgggctggatgtttgatgctctggatgtcggtctcttatccttcttactggccgccctgaaacaggattggggactgagctcagaacagttaggctggataggtagtattaattcgataggcatggctgtcggtgcttttgtctttggcgtgatggctgataaaaccggacgaaaatcagcctttattgtcacattactgctgtttagtgtaggcagtggcttaacggcattggtgaccacattagcagcattattggttctgcgttttattatcggtatgggtttaggcggagaacttcctgtcgcgtcaacactggtgtctgaaagcgtggagccccatgaacgcgggcgtctggttgtgatactggaaagcttctgggccttcggctggcttgccgcggcattgattgcttactttgttattccaagttatgggtggcgagttgccatgctgctgagtgctctacccgctttttacgctatctaccttcgtttgcatttacccgattcgccacgctatacacaaatgcgctcccggaaacccctcaattcaattatgcataatatacgggaagtatggtcggccgattatcgtcgggcaacagtcatgttgtggattttgtggttctgcgtagtcttttcctattatggtatgtttttgtggctaccaagcgtcatgatgctgaaggggtttagtctgataaaaagtttccaatatgtactaatcatgacgctggctcagcttcccggttactttactgccgcatggatgattgaacgttacggacgtaaattcgttctggcgagctatctaatcggaacggctgtcagtgcttatttcttcggtacggctgatagtattacccagctgcttatctttggtattttgctgtcgtttttcaatcttggtgcctggggagcaatctacgcctacacgccagaacaatatccgacagcaattcgcgcaaccggtgctggcatggcagcatcagtcgggcggataggtggcatcattggccctttaatggtcggttatctggtagcgatgaattcttcgatctccctgattttttccctgttcggcttttcaattctggtggctgtaggtgctgtgatttggctggggaaagagactcgtcagatagaactt

SEQ ID NO: 23992 - DNA, 924 bp, Xenorhabdus nematophilus
atgattcatatcattcttgcaccaaccaaccttgggttaagccccctatgggaaggacacatacccgggacatggcgggctccgcaagtactgatggaacatggattagcgcaaaagctgcgagctaataccatcagtaaattaatgtctccaatatattcacttgaagctcaaattgggacacgtatacgcaatggttatggtattcgtgcctttaatttacagttggcggaggaagtggctaaggtacaagagagtggcaattttccactagttattggtggtgactgctcaatcctattaggcgcattagctggttctcgtcgtacagggcctatttcactcatccacattgatggacacagtgattatcgccatccagacaactacgatacaaatcaaatgctaggtgcagtagcagggatggatttggctttggcaacaggtcgcggtgaggctctattaacagactggccagatatagaaagcccattagtgccagagcagcaggtactccagttaggcgaacgcgagaaccgagatgctgattttgcttggcctgatattaaccaaacggctatttcacagattgatgtatttacagcaaattcaataggcgaaaaagggatcctcaacaaaattgagcaaatgttaggtgctcaaccgacatggcgtttttgggtacatttagatgttgatgttcttgaccaaagtatcatgccagcggttgattcacccgggagtccgggcattgaattgaattggttgaaaaatatcggcgcacaattaattaataacccattatgttgtggcatgactgtttcagttttcgatcctgatttagatcccgatggttattatgccgagctgattattgaaatcctggaagaaatgtttctgcgctgtacatccccttctctctga

SEQ ID NO: 23993 - DNA, 1392 bp, Xenorhabdus nematophilus
atggcagccactcgcattgaaaaagactcaatgggacctatcgaagtacctgctgaccaattatggggagcgcaaactcagcgctcactggagcatttccgcatttctcaggaaaaaatgcctgttgcattgattcatgctcttgcgttaaccaagcaggccgcggccagtgttaatatggatctgggccttttacctaaggaacgcggtgatgcaattatcgctgcggcgaaagaggtgttgaaagataaacacccgacagaattccctctcgctatctggcaaacgggttctggcactcaaagtaacatgaacatgaatgaagtgctggcgaaccgtggtagcgagatccttggtggtcaaagaggtaatgaacgcctgatccaccctaatgatgatgttaataagagccaaagctctaatgacgtcttcccgacagcaatgcatgttgcggcagttatcgcattacgtgagcacctgttacctgagttggaagttctgcaaaaaacactggcagataaagcagaagcgtttagagatatcgtaaaaattggccgtactcacctgcaggatgcaacaccactgactttaggtcaggaaatttcaggttgggcagcaatgctggctcataacctgaaacacatcgaaaacagcatccctcatgtttgtgagctggcgctgggcgggacagcggttggtacaggtctgaatactcatcctgaatatgccgttcgtgttgcgaaaaaaatcgctaaattatccggtcagccttttatcatttcaccaaacaaatttgaagcattaggcacttgtgatgcactggttcattcccatggtgcactgaaaggtctggtttcatcattgatgaaaattgccaatgatgttcgctggttggcttccggccctcgctgtggtatcggtgaaatttctatccctgaaaatgaaccgggtagctccattatgccgggtaaagtaaacccgactcagtgtgaagctatgactatgttgtgtgcgcaggttatgggtaacgatgtggctgtcaatattggtggtgcgtccggtaactttgagctgaacgtattccgtccaatggtaattcataatttcttgcagtccgtccgtctgttggctgatggcatgcgtagcttcaatgagcattgtgctattggaattgagcctaatcgtgatcgcattactcaattgctgaatgaatcgctgatgctggtaactgctctgaatacccatattggttatgacaaagcagcagaaattgctaaaaaagcacataaagaaggtctgactctgaagcaatcagcaatgcagttgggttacctgactgaagctgaatttgacgcttgggtacgtccggaagatatggttggcagtatgaag

SEQ ID NO: 23994 - DNA, 1251 bp, Xenorhabdus nematophilus
atatctgtggttgggcttcaatttggagatgaaggaaagggtaaatttgttgattacttatctggtggtgtaaacaacattgccagatttaatgggggagccaatgcaggccattgtgtacaatatggaaatgtgagagggtctttttctcaattaccggcatcacttaataaaaagaatctctatatttgtcagggtgcattaattagtcttccggtacttgtgaaagaaattgattttataaaaagagaaaatattaactccagcatctcaattgatccccgatgccatattgtattgccattacatgcagaactaaataaagcatctgaaaaatataaaggtaagaataaaataggatctgtaggagtgggtgttggtgcctgtgttgaagataaatcgaaccggcatggcattcggcttattgatactctggataaagaaaaactcagaagcaaattagaatttctttgggacatcagggaaaaacaaatcaaccacgtttttaatgataattcgactttagattttgaggagatgttagaaataacgcatcaatatggaaaaaagatcgagccttatttcacatttactaatgaagccatccgtgacttattgagtgccggagaagatatcttacttgaaacatcacaagccacttttttggataacagttttggtacgtacccttatactgtagcgtatcagactctggttcaaacctgttttgccatgattggtataccagcacagaaaatgcatattgtcggtgtgatgaaggcctatatgatccgggtcggtaatggcccgttcccgacagaattacaggctgagcaggctgattatatccgggaacgtggaaacgagtatggtactgtttccaaaagaccaaggcgttgtggctggctggatctatgcttgatcaagcatgcggtaaaacttaacggggtaacagaactggcaataactaatactgatgttttagcagggttggaagaaataaaggtagctattgcatatgaaattgataatgaacaggtttgctgtgataaagccttattgcagcttgagaaagttaaacctgtttataaagtttttaaaggctggggagagctaaacgcatcgtatgctcactttacagaattgcctgctgaactaattgattttctcaattttattcaggattatgctggagtcccaattaaatatatttcacatgggcctgatagagaacaaacattaatagtgcag

SEQ ID NO: 23995 - DNA, 2040 bp, Xenorhabdus nematophilus
atgactaatccattattagatttttctggactaccaaaattcgcttctattaaagcagaacatgttgtgcccgcggtgaaagaaatactggctaaatatcgtcaggtcattgagaaagtggtgaacgaaaatagtcaatttacctgggataatttatgtcagccaatctctgaggcaaggaatcagtttgagcgcgtctggtctcctgtatctcacctcaattccgtcaaaaatacaccggaattccgggtggcttatgaacaatgcctgccaatgaattctgagttctcgacctggatgggtcaacacaaagggctatatcaggcttataagtcactgaaagaaagtcctgagtttgaaaaactgtctcaaccgcagcgtaaagctgtagaagataagctgcttgatttcactctatccggcattgcattaccggaagagaaacaaaaacgctacggtgaaatcacagctcgcttgtctgagctgagcgcccgcttcggcaacaatgtgctggatgccacaatgggttggacaaagctcgtcaccgatgtctgcgatctgtctggtttacctgaaaacataaaaagttcagccaaagctgccgctaaagcgaaagatttaaaaggctggttactgacgctggatccgccagtctacagtgcagtgatgagctatgcagatgactgtgagctgcgtgaagaagtctataccgcttatatgacccgtgcttctgatcagggtatgaatgcctgtaagtgggacaataacccgattatggaagaaattctcgcgctacgtcatgaacttgctctgctgttaggttttaaaaactacgctgaaaattctctcgcaaccaaaatggcgaagacaactaaggaagtgctcgatttcttaaacggtctggttgaccgcgcccatggacagggggaaagggagatggaagaactttgcgagtttgcccaatcccactactgtgttgatgagctggaaagctgggatgtaaggtattacagcgaaaaacaaaaacagcacgatttctcttttgatgaagagcagctgcgtgcttacttcccggaaaaacgcgccattgaagggctgttcgaagttgttcgccgcatttatggcatcaccgccaaagagcgtaacgatgtagatacctggaattctgatgtccgtttctttgagctttataatgataaagaggaactgcttggtagtttctatatggatctctatgcccgcgcaggtaaaaatggcggagcatggcaaagcagttatgttgacagaatgcgccttgcttccggcgagttgcagaaacccgttgctttcattaactgcaacttcagtgggcctgcaggcggtaaacccgcgctgtttacacattctgaggtttcaacgctgttccacgaatttggacacggtctgcaaacactgctgactacgattgaaactctggatgttgccggtactaacggcgtaccgtgggataccgtagaatgtccgagccagattatggagaactggtgttgggaagcggaagcactggaatttatctcaggtcattacgagacaaatgcacctctgccaaaagaaatgctggataatatgctggaagcgaaaaattatcaggcggccatgaagatgctgcgtcagttggagtttggcctgtttgatttccgtctgcatgttgaatatgacccggaagaaggcgctcagatcctgccgatactggagtcagtgaaagaacatgtttccgtcgttccgtcatcagactgggaacgcttcccgaactctttcagccatatctttaacggtggctatgcagcgggctattacagctatatgtgggctgatgtgctggcagcagatgcttattcacgcttctctgaagaaggtattttcaaccgcacaaccggtcagtcattccttgatgattatctgggacgcggtggttcagaagaccctctgacactgtttatccgcttccgtggtcgcgaaccaaaactggatgcattactgaaaaggctaggcattaccgga

SEQ ID NO: 23996 - DNA, 2040 bp, Xenorhabdus nematophilus
atgactaacccgttactgacatcttcagtattgcctaagttcgctgacattaaacctgaacatgtcgtacctgccgtaaaagaaacgctggcaaactaccgtcaggtcattgagaaaattttaactgagaactccgcttttacctgggatagtctgtgccagccgctttctgaagagcaagataaactttcccgtatgtggtcgccagtcgggcacctgaattctgtcaaaaatagcccagagcttcgtgaagcctatgaacaaagcctgcctctgctctccgaattcagcacctggcttgggcagcataaagggctatatcaggcttataagtcactaaaagagagtgaggtttttaattctctgtcccagccacaacgtaagtctatcgaagatactctgcgcgattttgagttatccggcattggcttaccggaagaaaaacagaaacgctacggtgaaattgcagcccgtatgtcagagctaggctcccagttcggcaataacgtactggatgccacgatgggctggtctaagctcatcaccgacgaaaacgatctggctggcttacctgaaagtgccaaagctgctgctaaagccgccgccgaagccaaagagcaagaaggctggttgctgacgctgaatatgccaagctatcttcctgtcatggcgtatgctgataaccgtgaactgcgtcaggaaatgtatcacgcctacacaactcgtgcatccgatcaaggacctgatgccgggaaatgggacaataacgcgattatggcggaaatgctggctttacgtcatgaactcgctcaattactgggtttcgcaagctatgctgaaaaatcccttgccaccaaaatggcgaaaaatcctcagcaggtactcgatttcctgaatgatctggctaaccgtgcgcatggtcagggcaagaaagagctggaagagctgacagactttgcccgttcacattacggtgttgataagctggaagcctgggatgtgacctactacagcgaaaaacagaaacagcatcatttctccattgatgatgagcaactgcgcccttatttccctgaacaacgtgccgttgaagggttgtttgaagttgttcgccgcatttatggcatcaccgccaaagagcgtaacgatgtagaaacctggcattctgatgttcgtttcttcgaactgtatgatgaaaaaggggaactgcgcggtagcttctatctggatctctatgcccgtgagcataagcgtggcggggcatggatggatgactgtgctggcagaatgcgttttgcttccggcgaattgcaaaaacctgttgcttacctgacctgtaatttcaataaaccagtgggtgataaacctgctctgtttactcacgatgaagtgataacgctgttccatgaatttggtcacggcctgcaccatatgctgaccgaaatcgaaacactggatgttgccggcattaacggtgttccgtgggatgcggtagaacagccaagtcagtttatggaaaactggtgctgggagccggaagcactggcgtttatctccggtcattacgaaacgaatgaacctctgccacaggaaatgctggataacatgctggcagcgaagaattatcagtccgcgatgtttatcctgcgtcagctggagtttggtctgttcgatttccgcctgcatgctgaatatgatccggcaaaaggcgctcaaatcctgccaacgctgtactccgtgaaagaacaggtttctgttgtgccatcaccagagtggaaccgtttccctaactctttcagccatatttttaatggtggctatgccgcaggctattatagctatttgtgggctgatgtactggcagcagattcctactcccgcttctccgaggagggtattttcaaccgtacaaccggtcagtcattcctcgacaatatcctgtcccgtggcggttctgaagatccaatgacgctgttcatccgcttccgtggccgcgaaccaaaattggatgccatgctgaaaagtgctgggatcacggga

SEQ ID NO: 23997 - DNA, 426 bp, Xenorhabdus nematophilus
atgacgattgaacgtactttttccattattaaacctaatgctgtgaagaaagatgttatcggttccatctatgctcgttttgaaagtgccggttttaaaatcatcgctgctaaaatgctgcatttaactcgtgaacaggctgaaggtttttatgccgagcacaaaggccgccctttctttgatggtctggtagagttcatgacatctggcccaatcatggtacaggttctggaaggtgaaaatgcagttcagcgtcaccgtgatctgatgggtgcaactaacccggacaacgcgctggctggtactctgcgtgctgattatgccgacagttttactgaaaatgcggtacacggctcagattccattgaatctgcaaaccgtgaaattgcttacttcttcagtgatgacgaagttttctctcgcagc

SEQ ID NO: 23998 - DNA, 1755 bp, Xenorhabdus nematophilus
ttacaacagcaagtcagcaaataccctgaaaagattgcatttcgccaatggtcagcatcagaacagcttgaaatgagctggcaggatgttgatagtaaaacgaaatccattgcaagatccctgctgtcacttgaggtgggaattcaggagaaaatcggtatttttgccgataactcaatggcatggtcattatcggatttggctattttgcagttacgtgctgtcacagtaccgctttatgcgacaagtagccgtgatcaggctgcatttattctcaatgatgcaggagtacggatattatttgtgggagggcaggagcagtacgatatcgcgttgatattgttagccctttgcccgcagcttaatcatctggttgttctggatgaatctgtcgatttgaaagaatgtccacaagcattgtatttatcggcatttattgctgatgacagaccactgtatcaggctgaacttgatagccgcattgccgggttggatttgcatgatctttttacgctgatttatacctccggtacaacaggcgaaccaaaaggtgtcatgctggattaccagaatatcgccgcccagctttatctgcatgatcagcgcttaacgctgactgaacaggatatttccctcagttttctgccgttatcccatatttttgagcgtgcatggagttattacgtcatgcatacaggtgccttaaatgtctatctgaccgacaccaattttgttcgggaggcgatgcttgatgtgcgtccgaccgtgatgtgttctgttcctcgtctgtatgaaaaaatacatagtgcaattcttgagaaagtgtcccgcgctccattctggcgcagaataattttccagtgggcgatcaaacggggtgaacgccgttggtcacgtcaattaaacgataaaaagagctgtccgttttctctatgcggagaaaaactggctgatcgtttggtactgaacaaacttcgccagctattaggtgggcggatccgttttctgccggtagccggagcacgacttgaagactccattatgcgtttcttcctgtcagttggtctcaatatcaaatacggttatggaatgacggaaacctgtgccacggtttcctgttgggaagagaaaaattatctgttgggttcaattggtacaccattgcccggagtggatgttcgtatcagcacagcgggtgaaattcaggtacgtggcccaatcgtaatgaaagggtattacaatcggccggaagatacggttcatgcctttactgaagatggctggctgcgaacaggggatgccggagggctggatgaaaccgggaatttgttcattacagaacgcctgaaagatttaatgaaaacgtcaacgggaaaatatattgctccgcaattaattgaaggaacactggggcaagatcgttttattgaacatattgctgtgattgctgatgcccgccagtttgtttcagcgttaattgttcccagctatgaagcgctggaggattacgcaaaatcgataaatcttcattaccagaatcgtctggaattgctgcgtaatcatcaggttatcgggttatttgaacaacgcctgaaagaattgcagaaaaatatcgccaaattccatcaggtaaaacgctttacgctgctgccggagtccttttcgatggaaaaaggcgaattgactccgacactgaaattacggcgtaaggtgatttctcaacgttatcagagtgaaattgagtccatgtatcgg

SEQ ID NO: 23999 - DNA, 2457 bp, Xenorhabdus nematophilus
atgcgtgtacttaaatttggaggcacttcagtcgcaaactaccagcgcgtactgagtgtggcagatatcgctgaaagtgagctaccccttgggcaggttgctctagtcctttctgcccccgcaaaaatcacgaaccacttagtggcaatggtcgctaagacggttgcagggcaggatattgtttccaacatcagcgatactatccaaatatttactgatttactgtctgggttaaaagagcatcagccaaatttcgattatgaaaacctcaaaacgctcatggaacgtgagtttgctcacctgaaacaaacactgcacggtatttctctgttgaaacagtgcccggatagcattaatgcctccctgatttgctgcggtgaaaaattatccattgcgattatggctgccgtactacaagcccgcgggcataaagtttctgtgatcgatccggttcaaaacttgcttgctcatgggcattacctcgaatccacagttgatattcacgaatcctccaaacgtattgcagccctgaatattccttctgaccatattattctgatggccggttttacggcaggtaatgataatagtgagctcgtcgttctcggacgtaatggttctgattactcagccgcagtgctggccgcctgtttgcgagccgattgctgtgaaatctggactgacgtagatggcgtttatacctgtgatccacgatctgttgccgatgcccgtctgctgaaaagcctgtcatatcaggaagcaatggaactttcctatttcggagcgaaggtgcttcatccccggactattgcccctatcgcccagttccagatcccctgcctgattaaaaatactgtcaatcctgatgcgccgggcacatttatcgggaacgggcaaaaagatgacagcatgcttattaaagggatcactaacctgaatcatatggcgatgattaacgtttcaggtcccggcatgaaaggcatggtaggtatggcagcaagagtctttgctgtgatgtcccgttcaggcatttccgttgtcctgatcactcagtcttcatcagaatacagcatcagtttctgtgtaccgcaaaaagagctgaacagagcacagaaagcactgaccgaagagttttatctggagttaaaagatggtgcgcttgatcctattgatgttatcgataatctcgccattatttctgtcgtgggtgacggaatgcgtacacagcgtggcatctctgcccgtttcttctcggcactgacccgcgccaatatcaatatcattgctctcgcgcaaggctcatcagagcgttccatctccgcagtgattgacaatgataacgcaacaaccgcagtgcggctctgtcatcaaatgttgttcaataccgctcaggtggttgaagtctttgttgttggcgtaggcggtgtcggaaatgccttaatcgaacaaatccgccgccagcagtcatggcttaagcaaaaacacattgatctgcgcgtatgcggaattgccaactcacgggcgatgttaaccgatatgcagggcatcagtctggataactggcagcaggctttgtcagaagccagcgaacctttcagcctgagccgtttaatccggctcgaaaaagagtaccacctcctgaatccggttattgttgattgtacatctaatcagtctatcgctgagcagtattccagcttcctgagtgatggcttcaacgttgttacgccgaacaaaaaagccaacacgctttccatggcctactatcgtgagatccgtcgtgcggctgaaaactcaaaacgtaaattcctgtatgacaccaacgtaggcgcaggcttaccggttatcgaaaatctacagaatttgctgaatgccggtgatgaactggttcagttcaacgggatcctgtcaggctctctgtcttatatcttcggtatgctggatgaaggtatgacactttcgcaagcaaccctgctggcaaaagaaaaaggcttcactgaacctgatcctcgtgacgatctctctggcatggatgttgcgcgtaagctcttaattctggcccgtgaatccggttatgaactggaattggaggatattcacgttgagccggttttacctgcttcgtttgattccaatggtgatgtcactgactttctgcaacgtctgccacagttggatcaggaatttatccgccgggttgcagatgccgcagagcaaggaaaagtgctgcgctatgtcggtattattgaacagggccgctgtatggttaaaatcgctgctgttgatggtaatgatccgctgtataaagttaaaaatggtgaaaacgcactggctttctatacccgttattatcaacctatcccgctggtactgcgcggttacggcgccggaaatgatgtcacggcagcgggtgtttttgctgatatattacgcactttgtcatggaaattgggagtt

SEQ ID NO: 24000 - DNA, 951 bp, Xenorhabdus nematophilus
atgaccgataaactgacttccctgcgtaaactgacaacagttgtagcagataccggggatatcgcggcaatgaaactgtatcagccgcaagatgcaacaactaacccttctctgattttgaacgctgcccagatcccgaaatatcgccaactgattgatgacgccattgaatgggcacgtgctcagagcgattcccgtgaacaacagatcattgatgccggcgataaattggcggttaacatcggtctggaaattctgaaactgatccccggtcgtatttccactgaagttgatgcccgcctctcttatgacaccgaagccagtgtcgcaaaagcaaaacgcctgatcaaactgtacaacgaagcgggcatcagcaatgaccgtattctgatcaaactggcttccacatggcagggtatccgcgctgcggagcaactggaaaaagaaggtatcaactgtaacctgactctgctgttctcttttgctcaggctcgtgcttgtgcggaagcaggtgttttcctgatttctccattcgttggccgtattctggactggtacaaagcaaacagtgataagaaagaattcgcaccaaacgaagatccgggtgtgatttctgtttctgaaatttaccagtactacaaagaacacggctataacaccgttgttatgggtgcaagtttccgtaactccggtgaaattctggaactggctggttgtgaccgtctgactatctctcctgcattgctgaaagagctgtctgaaacagcaggcgaagttgagcataaactcagctatgaaggtgaaatcaagccacgtcctgcggcaatgactgaagctgaattctattgggaacatcatcaggatgcgatggcaaccgaaaaactggcggaaggtatccgtaagtttgctatcgatcagggtaaacttgagagcatgatcgctgacttgctg

SEQ ID NO: 24001 - DNA, 1389 bp, Xenorhabdus nematophilus
atgaaacagtttccgacacattttctgtggggaggggctattgctgccaatcaggttgaaggcgcttatttagctgacggaaagggcctttctacttcggatgtccagccacagggaattatggggccggtcattgagcgagagtctgagagtacacaataccttaaagatatcgctatcgatttttaccatcgttatcccggagatatcgctctgtttgcagaaatgggattcacttgtttgcggacttccatcgcatggagccggatttttcctcagggcgatgaaatgcaggccaatgaagcaggtctggcattttatgacaggttatttgatgaaatggcgaaatacgggattcagccagtcattacgttatcccattatgaaatgccgtgggcgttggttaaaaaacacggtggatggggaaatcgtaaattaattgatttctttgagcgttatgcgcgcacagtttttactcgttatcagaaaaaagtgaaattgtggctgacattcaatgaaatcaatatgtcactgcatgagccactaactggcgtcgggttaccgaaaaacagcacacagtcagaaatctatcaggccattcatcatcaattggttgccagtgcccgcgcggtaaaactttgccatgaaattatccctgatgcccgtatcggcaatatgttactgggtgggctgatgtacccactgacttgtaaaccggatgatgtgctggctactctccggcaaaatcagaaatggctgttttttggtgatgttcaggttcgtggggcatatccgggttatatgctgcgttatttccgggaacatggtattgaagtcacgataactgaacaggataagcttgagatgcaaaacacggtggattttatctcattcagttattacatgagtgggtgtacttccgggaatgaagcggactatcagaaaaagcagggcaatattctgaatatgatcccgaatccccatctggccagttcagaatggggatggcagatagatcctgtcggattgcgaacgttactgaatttattatgggatcgttaccagaagccgctgtttattgttgagaatggtctgggagccaaagataccgtagaagccgatggcacaattcaggatgattaccggattagctatcttaatgaccatcttgtgcaggttagggaagccattgaagatggagtggatgtcatgggttacaccagctggggagccattgatttggttagtgcctcaaaaggggagatttccaagcgttacgggtatatctatgttgatcaaaatgagcagggaaccggaacgctggaacgccgtcgtaagaaaagtttctattggtataaacaggttattgaaacgggcggtggcagcctg

SEQ ID NO: 24002 - DNA, 1011 bp, Xenorhabdus nematophilus
atgaaaaatgtaggttttatcggttggcgtggcatggttggttcagtattgatgcagaggatgatcgaggaaggggattttaatgagattaaccccgtcttctttaccacttcccaacacgggcaagcagcgccggaatttacaggtaaatcaggtgtattgcaggatgcttttgatattgaagcactcaaagcactggatattattatcagctgtcaggggggagattataccaataacatttaccctaaactgagagcaacgggctggcaagggtattggattgatgcagcttctgcactgcgtatgaatgatgatgcagtcattatccttgatcctgttaaccatcagcacattcaggacagtctgaataatggcattaaaacgtttgttggtggtaactgtaccgtcagcctgatgttgatgtcattgggtggtctgtttgctaataacttgattgagtgggcatcagtttcaacttatcaggctgcttccggcggtggtgctcgtcatatgcgcgaactattgacgcaaatgggcatgctgcacaatcaggttgcggatgaactgcaaaatccggcttctgctattttggatattgaaaagcgtgtcacagactttacccgcagtggcacgttgccgacagatcaatttggtgttccgctggcgggaagtttgatcccgtggattgataagcagctggaaaatggccagagccgcgaagaatggaaagggcaggcggaaaccaacaagatcctgaacacgggtaacaatattattacggttgatggtctgtgtgttcgcgttggcgcattgcgctgccatagtcagtcatttaccctgaaactgaaacgagatatcccgatccacgaaattgagacgctgctggcctcccataatgagtgggttcgcgttattccgaatgatcgtgaactaacaatgcgtgaattaacaccggctgcagtgacagggactttgaatactcctgtgggacgtctgcgtaagctgaac

SEQ ID NO: 24003 - DNA, 933 bp, Xenorhabdus nematophilus
atggctaacccgttatatcgcaagcatatcatttcaattaatgatttgagccgcacagatcttgaattggtattgcagacggcagcagccctgaaagccaatccacagactgatgtactgaaacacaaagtcatcgccagctgctttttcgaagcctctacacgcacccgccttttttttgaaacggctattcagcggcttggagcctctgttgttggctttgcagacagcagcaacacatcattgggcaaaaaaggtgaaacgctagctgacactatttctattatcagccagtatgctgatgcgattgtcatgcgtcatccacaggaaggtgccgcccgccttgcttctgaattttccggtcatatcccgatcattaatgccggtgatggtgcaaatcaacacccaacccagactctgttagatctgtttactattcaggaaactcagggcaagctggataacctaaaaatcgcgatggttggtgacctgaaatatggtcgtactgtccattcattaactcaggcactggcgaaatttgagggcaaccatttctgctttatcgcgccggacgcactttctatgcccaactatattctgcacatgctggatgaaaaacaggtgagctacagcattcacaacaattttgaagatgtgctgcctgagctggatattctgtatatgacccgcgttcagaaagaacgccttgacccttctgaatacgccaatatcaaagcccagtttgtgctgcgtgcggcagatttggtgagtgtcaaagagaacctgaaagtactccatcctctgccacgtattgatgaaattactgttgatgtggataaaacgccttacgcgtattatttccagcaagcgggtaatggaatttatgctcgtcaggcgttgttatcactggtattgaatgaaaatgttgttatc

SEQ ID NO: 24004 - DNA, 3978 bp, Xenorhabdus nematophilus
atgggtagtaccactatgggcgtgaagctcgatgaagcaacgcgtaaccgcatcaaagctgctgcacaacgaattgagcgcacaccacactggctgattaagcaagccatttttaattatctcgaacgtcttgaaaatgaggaaaagatcccggaaatatcagccgctcaggataacaaagaagaaaagatttccgaagaagaatcaccgattgaagcccgttatcagccgtttctggactttgccgagcacattttaccccaatcggtgaaacgttctgcaattactgcgtcatatcggctgcctgaaacacaggctgttccgatgttactgcaacaagctcagttacctgaagaacaatccaaagcggcacataaactcgcatattccatcgcagagaaattacgccagcaaaaacagggtattgggcgcgccggtctggttcaggggctactacaggaattttcactctcttcacaggaaggtgtcgcactgatgtgccttgccgaagccctgctgcgcattcctgataaagcaacccgtgatgcactcatccgcgacaaaatcagtaacggtaactggcactcccatctggggcaaagcccgtccatgttcgttaatgctgcaacatggggattgctgtttaccggtaaattagtctctacccataacgaagccaagttatccaaatcgctgacccgtatcatcggcaagagcggtgaaccgttggtgcgcaaaggtgtagatatggcaatgcgtctgatgggagagcaattcgtcacaggcgaaactattgctcaggcccttgccaacgcccgcaagctggaggagaaaggcttccgttactcctatgacatgcttggtgaagcagcactgactgaagaagatgcacaggcttatatggtctcttatcaacaagccattcatgcaattggtaaggcatcgaacggtcggggcatttatgaagggccgggtatttctatcaaactttccgccctgcatccccgctatagccgcgcccagtatgaacgcgtgatgaccgaactctaccctcgcctgcttagcctgactttacaggcgcgtcagtatgatatcggtatcaatattgatgcagaagaagcggataggctggaaatttccctcgatttgctggaaaagctctgctttgaaccacaactggaaggctggaatggaattggttttgttattcaggcctaccagaaacgttgtcctttcgtcattgacagtattatcgatttagcccagcgcagccgtcacagattaatgatccgtctggtaaaaggggcttattgggatagtgagatcaagcgtgcccagattgacggtctggaaggttatccggtttatacccgcaaagtgtataccgatgtttcttatattgcctgcgcccgtaagttgctatctgtgcctaatcttatttaccctcagtttgcaactcataacgcccatactctgtctgccatttaccatatcgcagggcagaattactatccgggacagtatgaattccagtgtctgcacggaatgggagaaccgctttatgaacaggtggtcggtaaaattgcagacggcaagctgaatcgcccgtgtcgaatctatgcaccagtcggaacccatgaaactttactggcctatctggttcgacgtctgttggaaaatggagcgaatacctcgttcgttaaccgtatcgctgataccaacctaccgatcgatgaactggttgccgatccggtaaaagtggttcatgaactggctaaatctgaagggcaaatcggcctgcctcacccaaaaattccattacccattgacttatacggtaaaaatcgcgccaattcatcaggattagacctttccagtgagcaccgtttggcttctctttccagcgcactgttgagttcttcaatggaaatatggaacagcgaaccattattaggtggtgattatacccataccggggaattaccggttgccagcccggtcaataacccggccaaatcttctgatatcgtcggttatgtgcgggaaactacagagcaggaagtcagacacgcgctggaagtcgccaccaatgccgaaaccatctggtttgccacgccaccatcagagcgtgcagctattttggtacgcgcagcggaattaatggaagataacctacaatccctgctcggcattctggtacgtgaagcaggtaaaacgttcaacaatgccatttcagaagttcgtgaagcggtggatttcctctactattatgccgatcaggtacgtcaggatttcgccaacgatacccatcgcccgcttgggcctgtggtctgtatcagcccgtggaacttccctctggccattttcactggtcagattgctgctgcattagcggccggtaacagcgttctggcgaaaccggcagaacagacaccactgattgcagcggtcgccgttaaaatgctgcatcaggcaggcattccacgtgaagtactgcaattattgccggggcaaggagaaactgtcggttcaatgctggtaggcgatgagcgtgtgcgtggcgtgatgttcaccggctccaccgaagttgccagcctgttacagcgtaatattgccggacgtcttgatgctcagggccgcccgacgccactgatcgcagaaaccggcgggatgaatgcgatgattgtcgattcttccgccctgactgagcaggttgtcactgatgtggttgcctctgcttttgacagtgcaggccagcgctgctctgccttgcgtattctgtgtatacaggatgatgtcgcagacagaacactcaccatgctgaaaggcgcaatggcagaatgccggatggggaatcctgagcacctgttcaccgatatcggcccggtgatcgatgccgaagcaaaagcgaatatcgagcgccatattcaggctatgcgcactaagggcagaacggtttatcaggcgactcatgaaaatgcggcagacagtcgggaatggccacagggaatgttcgtcaaacctacccttattgagctggaaagttttgatgagctgaaaaaagagattttcggcccggttctgcacgttgtccgtttcaaacgggacgagttggatcagctgcttgatcagattaacgcttccggctatggattaacattaggcgttcacacccgtattgatgaaaccatctctcaggtcacgggtaaggcaaaagtcggtaatttatatgttaaccgtaatatggtcggtgccgttgttggtgtacaaccattcggtggtgaaggattatccggcaccgggcctaaagccggtgggccgctctatctttatcgcctattgtcccagcgcccagttaatggtgcaactcaggcattaacgcgtcaggatgaggaatatccgctggatgctaccatccgcactgccctgcactctcctttcaacaaactggctgaatgggctacatcaaataatcactcggaactgaaccacatcattcaggaatacgctttactggctcagggcgggacaacacgcctattaccggggccaacaggtgaacgtaatacctataccctgttgccacgcggtcaggttctctgtcttgcagataatgagcaagatacgctgattcagttagccgcagtgctttcagtgggttgtcaggcggtctgggaaaaggatgagcttcaccagcagttactgaaacagttaccaaaagaagttcgtcacgccatttatttagtgaatgactggcagagtgaagacacggttatggaagcggttatttatcacggtgattgcgatcagttacggcaggtatgtgaaaccgttgcacaacgtaaagggccgattgtttcagtgcagggctttgcccggggcgaaactaatctgttgctggagcgcctgctgcatgaacgttcattgagtgttaacaccgcagcggcaggaggaaatgccagcttaatgaccattggt

SEQ ID NO: 24005 - DNA, 1287 bp, Xenorhabdus nematophilus
gtggcacaacaaaaggaacgagttgctattgtcagtggattacgccttccttttgctaaacaggcaacgaactatcacggtattccggctgttgatttggggaaagctgttgtcagtgagttggtcatcagaagtgggctgccaccagagaagatcgaccaattggtttttggtcaggttgttcaaatgcctgaagccccgaatattgcacgggaaatcgtgttgggtgcgggtttaagtgttagtacagatgcgtacagtgtttcccgggcctgcgcaaccagttttcaggcgatagctaatgtagcagaaagtattatggccggaaccgtgaatgtgggaattgctggtggtgctgattcttcatctgtcctgccaattggggtgaccaaatcactggctcgtactctggttgatatgaataaagccaaaagcctttcacaacgccttaagttgctgagtaaattgaaattaaaagatttactgcccgtatcgcctgcggttgctgaatattctaccgggttaagaatgggcgatactgctgaacaaatggcgaaaacctaccatatcagtcgtgaagctcaggatgagctggcgcaccgttctcatttgatggcggctaaagcctgggagaagggcctattacgtgatgaagtgatatcggctcattttccgccatatcgcgaatctttgcaggaagataataatatccgcaaaaattcagaacttacgtcttatgcgaaattacgtccggcttttgatcgcaaatatggcacagttactgcggccaatagtactccgctgactgatggtgccgcggcagtgattttgatgagtgaatctgctgctaaagaacttggcatggtgccattgggctatttgcgcagttatgcattttcagcgattgatgtctggcaggacatgttactggggccatcatatgcaactccactggcactggacagagcggggattacgttaaatgatctttcccttattgatatgcatgaagcgtttgccgctcagactctgacaaacctgaaaatgtttgccagtgataaatttgcccgcgagaaattggggcgttctcaggcgattggtgaggttgatatggataaattcaacgtactcggtggttcaattgcttatgggcatccatttgctgccaccggggccagaatggtgacccagaccctgaatgaactgcgtcgccgtggaggcgggcttgggctggcaacagcctgtgccgcgggtggcttgggtgcggcaatggtattggaggtggaa

SEQ ID NO: 24006 - DNA, 651 bp, Xenorhabdus nematophilus
cagttaagtgaagcccaaagtgcactgagtgatgctgtctatgcctgtcagagccagaaaatgcgtaccctcatttttggtggcggtcatgaaactgcctttgctcatggtatgggcatatatcgtgcgttcccgacacagcgggtagggatcattaattttgatgcgcatctggatctacggaatgcgccacaggcaacatcaggcacaccattccgccagcttgctgattattgtcaccagcaacagcgtccgtttaattacagctgtgtgggtgccagtctggcctcaaatactcaagccttattggatgaagcgaatcatcttgatgtcactattatttgggatactcaatgcattgattctatgctggataaagttcaacaacagatacaggatatgctgaatcaggctgaaatcatctacatgacgattgatttggacgtgttaccgatttggcaaatgccgtcagtttcagctccggctgcgctcggtgttccgttggagcgtttattgtcactgatccagccgatttgccagagtaaaaaattacaggctgttgatctggttgagctgaatccattgtacgatattcagggtatgggcggtaaagccgcggctcgccttgcatggcaaatagtgcattggtgg

SEQ ID NO: 24007 - DNA, 1172 bp, Xenorhabdus nematophilus
caacccgaacattacatcggtacccactacttatcagtgtacttttagcattaacaggccttacggtcgtaggccagatttacattccgattccgatccttacggagataacccagcattttaacaacaataaaaacatggctggatgggtgagcagcgctttcagtatcggttattcggcaggttttttattatcaggcccactttcagaccgctttggtcgtagattggtcatgctcaccgggtttatcttttttctgttattcaccgttttagtcggattttgctctaactttagcctgttattaacacttcgggtattacagggacttgccgcctcttgttatccgcccattatactggcatacctgaatgaaaaactgtcttctacgctgaaatcgagagcaatatcgtttatgtcgttgggttttttaacagcgagtattgttgcccagctttatgctataaaattcagtcattatggttttaatactatcgagcttgcgctggttcctgtttattttgtgtcaattattttgatttattttgttgttcacagggataaggaaagcaatcaagtagaagagcataataaaacaacattgtttgatatttataggaaaataccgggaatattgtttgagaaaaacttaaagtggttgtatctaagtacattatgtacgttatcagcgttagttgctttttatattatgatggacgaaagttacggtaaaaaatttgccataatgggtatagaacccttcactacgaggctgattgttttacccgtgatgtttctttccctgcttgcaccttggataatacaaaaaataggtgcgatatcgctcgtccgatggagctttttaattgccgcggcaggattaatagtggcctcagtcactgtttcttttggtagtgcatggggattacttttcgccagtattatttttattggcggacgtgcattcagtgtcccttctctggttggtgtaattgctgttctggcagaacaacaatatagaggaacagccatatcactctatacatttgtactatttgttggagcaagtatagggccacttattgcccacctactgctgatgatgaattattctatatctttactgattcttgcatttattgccgggttacctgttttattgacgctattt

SEQ ID NO: 24008 - DNA, 618 bp, Xenorhabdus nematophilus
atgctgacagtctggggccgtaaaaattcatcaaatgtcaaaaaagtgctttggtgtctggaggaattaaaagttccttaccagcaaattgatatcggagggaaattcggcaaacttgatgatccgaattatttacacatgaatcccaatggagtaattccatgcttacaggatggtgattttatactgtgggaatcaaatgtgatcgttcgctaccttgccgaaaaatttggcgaaaatactctatatccgaatgatattaaataaaaatataatatcgagaagtggatggactggactgggtgcaatctcttctcccccatcaaacaactcatgataagccttgtcaggacaccagaggcacagcgtgatcaaaaagtcatcgctcaggctttagctgaaatagaaagactgctgaaaattgccgatgaagcattaagccaacaaacatacctttccggtgataaatttggcatggctgatatagccctggctccgtttatctacccgtggatcaatgtggtaactgaacgcccatcactgccaaacttagaacgctggtatcaattaatgaccgaaaggccagcattccaaaaaatcgttatgatcgaaataaat

SEQ ID NO: 24009 - DNA, 1290 bp, Xenorhabdus nematophilus
gtcgattttagcaccattatccgttggcaggcatgtacaccgaagcagcaagaaatgctgctgacccgtcctgctgtcaccgcatctgaagatattacatatacggtgagacagattctggaagcagttaaagagcgcggtgatagcgtgttacgggaatacagccagcgttttgacaacacaacaattgatgctgtccgagtcccagaagaggagattaatgctgcaggtaggcacctgacaacggaaatccggcaggctatccagcaggcaatggataacatacgtctgtttcatgaagcacaaaaacctgtggtaattgaagtagaaactatgcccggcgtgtgttgccaacaaatcacacggccaattgattctgtagggctctatattcccggtggctcagcaccactgccttctacggtattgatgctggggatcccggccagcattgccgggtgtcgtaaagtaacactgtgttctccaccacctattgccaatgaaatactctacgctgcgcaactatgcggtatcagtgatatcttccagattggcggtgctcaggctattgcagcaatggcatttggcacagaatcggttccgagagtagataaaatttttggcccgggtaacgcatgggtcactgaagctaaaaaacaggtcagtcaacatattgacggtgcggccattgatatgcccgctggcccttctgaagtactggtgatcgctgatagtggtgccaatcccgtattcacagcagcagatctactttcacaggcagaacacgggccagactcgcaagtcatactcgttacacctgacgaaagctatgccggggaagttatccatgaaattgaaaaacagctcccaaccctgccacgccaacaaattgcaatacaggccttacagtccagccggattatcgtcgctgacgatatcgcccaatgtgtggcgatcagcaaccaatacggccctgaacacttaattattcagacacggcaaccagagcaaattgtagataaaattaccagtgccggttccatttttctcggcgactggtctccagaatctgcgggagactatgcctccggtaccaatcacgttttgcccacttacggctatacctctacccattcaagccttgggctggcggattttctgaaaagaatgaccgtacagaaactaacgccacaaggcctgaaaaagctggctccaaccatcgaaacactggcacaggcggagcaactcactgcacacaaaaatgcagttacattacgcatcgctgcctta

SEQ ID NO: 24010 - DNA, 1062 bp, Xenorhabdus nematophilus
atgagcactgtttttgatgtcacttcactggcaagagaaaatatccgtaaattagtcccttatatgtcagcccgtcgtttgggtggcaatggtgatatttggttaaatgccaatgaatatcacgccgcacctgattttcagttctctgaaaaaacactcaaccgttaccctgaatgccagccggcaacagttattcagcgttatgctgattatgctggcctgcaaccagaacaagtacttgtcagccgaggagcggatgaatctatcgaactgctgatacgtattttttgtgagccgggcaaagatgcggttatgttttgtccgccaacctatggcatgtacagtgtcagcgctgaaaccttcggtgtcgcacagaaaaagatcctcgctggcatagactggcagccaaatataacaaccatcaaaaataatctggatcgcgtcaaattaatctatatctgtagcccgaataacccaacaggtaatctgattgctccctctacgttacgccagatcctcgaactggcccgtaatcgtgccatcgttgctattgatgaagcctatatcgaattcagcctgcagaatactaccactcgctggctaaaagagtatccacatctggtaattttgcgaaccctctcgaaagcttttgctttagcagggctgcgttgtggatttacgctggcttctgccgatattatcgcgctaatgttgaaagtgatcgccccctatcccattgccacacctgttgctgatatcgcggcacaggctttaacagcatcaggcatacgggtaatgcaggagcgggtagaagaaactattgccaatcgcgcttacctacaagacgcacttgataagctgatattagtggagaaagtatttcccagtgaaaccaactatattctggtgagattcaccaatgctgaatttgtattcaaggcattatgggatcagggcattattcttcgtgaccaacaaaagcaaccgaagctggaaaattgcctgcgtattactgttggcagtcgcagtgaatgtgagcagctgatcaccgccattgacgct

SEQ ID NO: 24011 - DNA, 1065 bp, Xenorhabdus nematophilus
atgagccagaaaatactttttattgaccgcgatggcacgttaatcactgaaccaccaacagattatcaggttgatagccttgataagctggcatttgaatccggggtgatccctgctctgttagccttacagaaatccggttataaactggtcatggtcactaatcaggatggattaggcacagacagctttccgatgactgattttgaaccacctcacgcactgatgatgcaagttttttcttcacagggaattcagtttgaagaaatattaatctgccctcacaaacctgcagataactgtaactgtcgtaagccaaaactcggcttaatagaaaaatatctggctgatggaatgctggatacaaaaaatagttacgtcatcggtgatcgggaaactgacctgcaattagcccgaaatatgggaattcagggtcttctctatcaacctgaatcattcggctggtcagcaatttgtgagcagttaacccgcaaggatcgttattccagtgtaaaccgcacaaccaaagaaacagccatcaatattgaggtctggctggatcgtgaaggaaaaagccgcattaatacaggggtaggcttttttgaccatatgctggatcaaattgccactcatggtggttttcgcatgaatattcaagttgatggtgatctttatattgatgatcaccacactgttgaagatacaggccttgctctgggggaagcgctgaaacaggcgttgggtgacaaactcggtattgcccgtttcggttttactcttccaatggatgaatgccttgcccgatgcgcactggatatttccggcagaccgcaccttgaatataaagctgagttcaaacatcagcgtgtcggggatttgagcacagaaatgattgaacattttttccgctcactctcttataccatggggtgtactttacatctgaaaactaaaggtaaaaacgatcaccatcgtgccgaaagtctgttcaaagtttttggtcgcacactgcggcaggctatccgcgttgaaggcgatactctacccagctctaaaggtgtttta

SEQ ID NO: 24012 - DNA, 774 bp, Xenorhabdus nematophilus
atgctggcaagacgcataattccctgccttgatgttcgtgatgggcaggtagtcaaaggggtacaattccgcaatcacgaaattattggtgatattgtgcctcttgcacaacgctatgctcaggaaggggctgatgagctggtattttatgatattaccgcctcttcttatggccgtgttgtggataaaagctgggttgcaaaagtagctgaagtaatcaatatcccattctgtgtcgctggcgggatcaaaacagtcgaagatgccgggcaaattttatcctttggtgcagataagatttctattaactcccctgctctgtcagacccttctttaattaatcgtctggccgatcgctacggggtgcaatgtatcgtaatcggcatcgatacgtggtttgatgaaaaaagtaatagctatcaggtataccagttcaccggagatgaaaaacgcaccacagcaactacgtggcagactctggattgggtcagggaagtacaacaacgtggagccggtgaaattgtcctgaatatgatgaatcaggatggcgttcgcaatggctatgatcttgcccagcttaaacaagttcgggaaacctgttccgtgcctttggtcgcatcagggggagctggcgctccggttcattttctggatgcttttaaacaggctaacgttgatggagccttggctgcttccgttttccataagcagattattaacattggagaactgaaacaatatctggcggaacaagaagttgaggtaagaatatgt

SEQ ID NO: 24013 - DNA, 603 bp, Xenorhabdus nematophilus
ctgaccccgcaggaaatcgaaaaattagactgggaaaaagtcgataacctgatgcccgtgatcgtgcagcatgccgtatctggtaccgtactgatgatgggatacatgaatagagaagccctgaatgcaacgctaaattccggcaaagtcaccttcttttcacgcaccaaacaacggttatggacgaagggtgaaagttctggtcactttctggaattatccgagatttatcctgactgtgacaacgataccctgcttatccttgccaaccctatcggaccaacctgccataaagggactgaaagctgctttggttcagcacaaacacaatggggttttctttatcaattagagcaattactggcaagccggaaaaatgcttctcccgatagttcctataccgcccgcctgtatgccagcgggacaaaacgcattgcacaaaaagtgggagaagaaggtgtagaaaccgcattagcagcgactgtgaatgatcgggaagaactcaccaatgaagcggctgatttactctaccatctgctggtgttactccaagatcaaaatttagatctgagttgtattatccgtcaattacagaaaaggcat

SEQ ID NO: 24014 - DNA, 1137 bp, Xenorhabdus nematophilus
atggcaatatcaactttctttatcccaccagtgaataaaatcggtgaaggatgtctgaacgaggccattcagttagcaaaaacttatggttacaagcaggctctgattgttactgaccgagtactgaacgagattggtgttgtcgggaaagttcagaatttattgactaatgtagggataaaaagtgcgctgtatgatggaacgaatcctaatccaacgacgattaatgtcgaagaagggttggcgattttgcatcagcatagctgcgattttgtgatttcgttggggggcggttcgccgcatgactgcgctaaaggtattgcattggttgcggcaaatggcggagatatccgcgattatgaaggagttgatgtttctgcaaaacctcagttgccgttgatagcgatcaataccacagcaggtacagcttctgaaatgacgcgtttttgtattatcacggacgtagagcgccacatcaaaatggcgattgtggataaaaacgtgacgcctattttatccgtgaatgacccttctttgatgatcggtatgccgaaagggctaaccgcagcgacaggtatggatgcgctgactcatgcagtagaagcttatgtatctacggctgccaaccctattactgatgcctgtgcgctgaaagcggtggaaatgatcagtagttatttacgccgtgcggttgaaaatggcagtgatgtggaagcgcgggaaaatatggcttatgcccagtttttagcgggtatggcattcaataatgcttctctagggtatgttcatgcgatggctcaccagttgggcggtttctatgatttaccacatggtgtctgtaatgcagtgttgttgccccatgtacagcgctttaatgcaaaagtcgcagcaccccgcctgaaagatattgccgctgcgatgggagcaaatgtcgagaatgtttctgaccaggagggcgcggaagcctgtattcgggaaatccgccggttggcaaaagatgtcaatattccagcgggattaactgaattgaacgtcaaagtggaagatttgcctgtattgtcagctaatgcactaaaagatgcttgtgggttcactaacccaattcaggcatcacacgaagatattgtggctattttc

SEQ ID NO: 24015 - DNA, 1404 bp, Xenorhabdus nematophilus
atgtccaaacaacagatcggtgttgtcggtatggcggttatgggtcgcaatctggcgttgaatattgaaagccgtggctactctgtatctatcttcaaccgctccagtgataaaactgatgaagttatcgctgaaaatccagggaaaaaattagttccaagttattccattgaagagtttgtcgattcactggaaaaaccgcgtcgtatcctgttgatggttaaggccggtgaagctacggataaaactattgcatctctgacgccacatttggataagggtgacattctgattgatggcggcaatacctattttcagaatactatccgccgtaaccgtgaattatctgcgcaaggctttaatttcatcggtacaggggtttctggtggtgaagaaggtgcattaaaaggcccttcaattatgccgggtgggcagaaagaagcctatgaactggttgcgccgattctgaaagagattgctgctcaggtggatggtgaaccttgtgtgacttatattggtgcagatggtgccggtcactatgtgaaaatggttcacaatggcattgaatatggcgacatgcagttgattgcagaggcttactctttattgaaacattcactgaacctaggtaatcaggaactggcagatgtattcagtggctggaatgaaggcgaattgagtagttatctgatcgaaattactgctgatatcttccgtaagaaagatgaagaaggtaaatatctggttgatgtcattctggatgaagcagccaataaaggaaccggtaaatggaccagccaaagttctcttgatttgggtgttccggtaacgttgattactgaatcagttttcgcacgttacatttcttcactgaaagatcagcgtgttgccgcatctaaagttctgtcaggcccagaagcgcagccatttgcaggtgataaagcggaatttattgaaaaagtccgtcgtgcgttgtacttaggcaaaattgtttcttatgcgcagggcttccaacagctgaaagcctcttccgatgaatacaattgggatctgaactatggtgagatagctaagatcttccgtgcgggttgtattattcgtgctcagttcctgcaaaaaatcacggatgcttacaacgaaaatccggctattgctaacctgttgctggcaccttatttcaaacaaatcgctgatgaataccaacaagctctgcgcgatgtcgtttcttatggcgtacagaacggtattccaactccaacattctctgctgccatctcttattatgacagctaccgttccgcagtcctgcctgccaacctgattcaggcacagcgtgactattttggtgcgcatacttacaaacgcactgataaagaaggtgtattccataccgagtggttagaa

SEQ ID NO: 24016 - DNA, 1161 bp, Xenorhabdus nematophilus
atggaaaacgtagtcattattgatggtatccgtaccccaatggggcgctcaaaaggtggagtattccgtcagacccgtgccgaagatctctcagcacatttgatgaaatcactccttaaacgtaacccatcagtacaacctgagcagattgatgatatctcttggggatgtgtacaacaaacactggaacaaggatttaatattgcccgtaatgcagctttgctggcagggcttcctcattcagtacccgcggttaccgttaaccgtctgtgtggttcttcgatgcagtcattgcatgatgctacccgcatgatcatgacgggagatgccaatattgccatgattggtggtgttgagcacatgggccacgtgccgatgactcatggtgtcgatttccaccctaaattaagccgtaatgtagcaaaagctgcgggtgtaatgggtctgaccgctgaaatgctggcaaaaatgcatggtatcagccgtgaaatgcaggatgaatttgctatgcgttcacatcagcgcgctgcacaggcgacagaatcaaaagcctttgccagtgagattgcccctcttcacgggcacgatgctgacggaaacattcagcttgttaattttgatgaggttatccgcccggatactaacctgaaagatttagctggtctgcgccctgtctttgacccagtcacgggtagtgtaaccgctggtaactcttcagcactttcagacggtgcatcagcaatgctggtcatgagtgaaagtaaagcacgtgaactgggattgaagcctcgtgcccgtatccgctcaatggcggttgttggttgtgatccttccatcatgggctatggccctgttccggcaacacaaatggcattgaaaaaagccggtctggctctttcggatattgatctatttgaattaaacgaagcgtttgctgcccagtctctggcatgtatgaagggtctgaatctgctggatagtatggatgacaaaattaacctgaatggtggtgctattgcactcggtcatccattgggctgttctggtaccaggatcacaacaaccttgctgaatctgatggaacgtaaagatgtccagttcggattagcaaccatgtgtatcgggctgggtcagggcatcgccacgattattgaaagagtt

SEQ ID NO: 24017 - DNA, 1934 bp, Xenorhabdus nematophilus
atggaaaagttggcatctctgtatcaagaacatattaaaattttgcaaaagcgcgctaaagaaatattagcacgcagtcagcttgacgccctgcttattcactctggtgagttattacgagtatttctcgatgatagccattacccgtttaaggcaaatgcacatttcaaggcatgggttcctgtaaccaaagtaccgaattgctggttatggattgatggtgtcaataaacccaaattatggttttattccccagtggactattggcacagtgtggaaccacttcctcacggatactggacggaagaagtggaaatgttccatctggccagtgccgaagatatcaacacagcactgaatggcttttcaaaacaacatatggcctacatcggcgaacaagttgaacgtgctaaatcgctggggatctccgagcataatcttaaccccaaagccgttttagattatttaagcttccatcgttcctataagacagattacgaactggcctgtatgcgtgaagcgcagaagacagcagtgaatggccatatggcggcacatgatgcgtttttgtcaggtgtcagcgagttcgaaatcaatatgttctatctgatcgcaacaggccaccgcgatactgatgttccttatgacaatattatcgctctgaatgaaaatgctgctgttttgcactacacaaagttgcagcaaactgtacccgctgaaatccgcagttttttgattgatgcgggtgcagaatataatggctatgcggcggatatcaccagaacttatgcagcgaaatcaaatagcgagtttgcttctctgattaaagggctgaatgacgaacagcaggcaattataaccacgatcaaagcaggaactcggtacaccgattatcatatcaatatgcactaccgcatagccagattgctgaaaaagcactatatcattaatgggatcagtgaagaggctatggttgaaaaagggctgacagcgccgtttttccctcacgggcttggtcacccgcttggcttgcaggtacatgattccgccggatttatgcaggatgataccggaactcatttggctgcgccggaaatgtatccttatttgcgttgtacacgtgttctcgagccaagaatggttttgaccattgagccggggctttattttattgaaaccttactggcgccgtggcgtgtcagcgaatatagcaaacacttcgactggaaaaagatcgaggcgcttaagccatatggcggtattcgtattgaagataatatcgttatccatgatggaaaaattgaaaatatgaccagagatttacagttgccgtaatgaagccttatttaattccagcggcttcagtcagctttactgaagaaataaagaaaagccgttttattaccctgctggagcgtaccagcggggttgatgaagcaaaatcgtttattcaacgtatcaaacagcaatacccagatgctcggcatcactgctgggcttttgttgctggcgctcctgatgattctcagcagttagggttttcagatgatggagagcctaccggaaccgcgggtaaaccgatgattgcacaattgataggaagtggtttaggggagatcaccgcaatatccgtccgttattttggggggattaaactgggtactggcgggttagtgaaagcctacggtaatggcgttcagcaggcgcttaagctattggaaaaagagtataaagttccacagaaacagtaccagatacaatgtgaatatgcacaaatctcaatggtagaacagttattacagcaattttcagggcaagtacttgccagtgaatatacggaaaatgttacattgcaagtctcattacctgctactcttgcagatgaaataggtaataaattacgtgacttaagtcgcggttcactatttttaaca

SEQ ID NO: 24018 - DNA, 507 bp, Xenorhabdus nematophilus
  unsure (1)..(507): unsure at all n locations
atgaattacctattgctctattccacacaggatggacagactaagaaaataatcatgcgtattgcagaaaatattcgtcgagcaggtatcaattgtgacttgagagatcttgcgacagtcaatcatatgaatttgcttccttataataaggtgatgatcggggcttcaatacgttacgggaactttaattcggtattacataaatttgttgtacgtcatcaaaagcaattgaatcaactaacgacagctttcttcagtgtcaatttaacagcaagaaaaccagaaaaaagaacgcctgagacgaatgcttatgttcgcaagtttttggtaaaaagcccttggcagccagatttgtgcgatgtttttgccggagcactgctttatcctcgctaccgttggtttgatcgcataatgattcagctcattatgcgtatgaccggaggagaaactgatacaacaaaagagattgaatacaccgactgggctcaagtggatctttttntcaga

SEQ ID NO: 24019 - DNA, 1008 bp, Xenorhabdus nematophilus
atgtattatccgcttctaaagaaggcattgttccagcttgatccggaacaggcccatgagcttacttttcgccagctcaaacttgttaccggtactcctttcgaattcctcatccgccagtcagttgccactaaacccgttacctgcatggggttgtcatttaagaatcctcttggcttagccgccggtcttgataaaaatggtgattgtattgatgcctttggtgcaatgggctttggttttgttgaaattggtacagtaactccacgtccgcaggcagggaatgataaaccgagattattccgtgttgttgaagcagaaggtattattaatcggatgggctttaataatctcggcgttgataatttggttgagaatgttaagaaagcaaaatacgacgggattatcggaattaatattggcaaaaataaagatactccggtagagaatggtaaagatgattatttaatttgcatggataaagtgtatccccatgctggttatattacgattaatatctcttcacctaatacaccgggcctgagaacattacagtatggcgaagcactggatgatcttctatctgcgattaaaaataaacaaagtgaactacaacaaaaatatcaaaagtatgttcctgttgccgtaaaaatttcgccagaccttaccgaatctgaattagtagaaatcgcagatagtttaatgcgccatcaaattgatggagtcattgcaacgaataccactttggacagaaagattattgaaggattaaatcactgccagcaggctggtggtttaagtggtcgcccggtgcagctacgcagtacagaaattattcgccgtctttctcaggaattaaaaggtgaaatccccattattggcgtgggtggaattgattcattagtttcagccagagagaaaatggaagcaggtgcttcattgattcagatattctccggctttatctataaagggccgaaattaatcaaagatattgttaatcatatc

SEQ ID NO: 24020 - DNA, 1716 bp, Xenorhabdus nematophilus
acaatgagcaatgaaaaacaaggtcctttgattgttgaaggtaaactcgctgacagtgaacgtatgaagtcagaaagcaactacttacgcgggacgatcagcgaagatttaaagaatgggctgacaggcgggtttgaaggcgataattttctcctcatccgtttccacggtatgtatcaacaggatgatcgtgacatcagagctgagcgcgcggaacagaaacttgaaccccgccatgccatgatgttgcgttgccgcttaccgggaggaattattactccccgccaatggctgggcattgatcagtttgcgacagagagcacgttgtatggcagtatccgattgactaaccgccagacattccagtttcacggcatcctgaaaaacaacgtcaaaccggcgcatcaattactggctcaaatgggattggattcactggcaaccgccaacgatgttaaccgtaatgtactgtgtacctctaatccagtgcagtcggctttgcatcagcaggcttatgaatgggcgaagaaaatatctgaacacctcctgccacgtaccaacgcgtacgctgagatctggctggataaagaaaagatcgctacaaccgacgaagagccgatcctcggtaaaacgtatctaccgcgtaaattcaaaacatcagtcgttatcccaccacaaaatgatgttgatctgcatgccaatgatatgaacttcgttgctattgcagagaatgatcagttgatcggctttaacgtgctggtgggtggtggattagccatgactcacggcgataagaacacttttccacgtctggcaagtgaatttggctatatcccactggagcatacactggctattgctgagtccattgtgacaacacagcgtgactggggtaaccgaactgaacgtaaaaacgctaaaaccaaatatacccttgagcgtgtcggcgttgaaactttcaggcaggaagttgaaaaacgtgcaggtgtgaaatttgagccagtccgcccttatgaatttactgggcgtggagatcagattggctggttaaaaggcattgatgatcaatggcatttgaccctgtttattgaaaacggccgcttgctggattatccggataaaccactaaaaaccggcgtggcagaaattgcccgaattcacaaaggcgattttcgtcttaccgcaaatcagaacctgatagtagcgggagtggcggaaaatgaaaaagcgcgtattgaatccattgcccgtgcgcatggtcttattgatgacggcgtgacctcactgcgtcaccattctatggcgtgtgtttcatttccgacttgccctttagcgatggcagaagcggaacgtttcctgccaacctttgttgatcatgtcgatgcgttaatggcaaaacacggagtcagccatgaacatatcgttctgcgtgttacaggctgccccaatggatgtggccgggcgatgctggcagaagtcgggctggtgggcaaagcgccggatcgttataacctgcatcttggtggaaatcgcaatggtagccgcattcctcgtatgtatcaggaaaatatcacctccgctgaaatcctgactattctggatgaacttattggtcgttgggctacagagcgtaatgaaaatgaagactttggcgatttcctgatccgaactgacattatcaaacctgtattgaactcagctatcgacttttacgac

SEQ ID NO: 24021 - DNA, 732 bp, Xenorhabdus nematophilus
atgagccggccacatttagctgagttactggctttgcccccagagcagcgcacggaagtgctcgctgagacaaaccaacaactggagttgctggatgcccgccaacgtgtcctatgggcactggaacatctgcccggtgagttcgtcctttcatccagttttggtattcaggcggcagtctgcctgcatctggtcacgcaggaataccctgatatcccagttatcctgacagataccggttacctgtttccggaaacttatcagtttatcgataaactagcggataaactaaacctgaacctgaaaatattccgtgcagaacaaagcccgatttggcaggaagcgcgttttggcaaactgtgggaacagggagtagacgggattgaacgttataaccagattaataaagttgagccgatgaaccgtgcgctgaaaacattggatgcgcagacatggtttgcagggttacgtcgtcagcaatcggaaagccgagctaatttgccagtactggcagtgcagcgcagtgtttacaagatactgccaattatcgactgggacaatcgtaaggtacatcaatacctgaccgagcatggccttgaataccatcctctatgggaacaaggctacctttctgtgggggatactcataccacgaaaaaatgggaacctggaatgagtgaagaacaaacccgcttttttggcctgaagcgggaatgtggcttgcatgaaggc

SEQ ID NO: 24022 - DNA, 1707 bp, Xenorhabdus nematophilus
caaagagtaagcatcatggaactggaacacgaaagtaaacgtcctctttatattccctacgctggccccatcctgttggagtttcccctgctaaacaaaggcagcgcctttacggaagaagaacgcagcaatttcaatctgcatggcttattgcctcaagcggttgaaacaatcgaagagcaggcagaacgcgcctatcgccaataccgcgattttaaaaatgatgcggataaacatatttatttgaggaatattcaggataccaacgaaactcttttctaccggctccttgacgcacatctcagcgaaatgatgcctatcatttacacaccaacagtcggtgaagcgtgcgaacatttttctgatatttaccgccgtgcccgtggtttgttcatctcctacccgaaccgggcttatattgatgacatgctacaaaatgccaccaaacagaatgttaaagttatcgttgtaaccgacggtgagcgtattctggggcttggcgatcagggaattggtggcatgggtatccctatcggtaaattatcgctatatacctcctgtggcgggatcagtcctgcttataccctgcctgtcgtgttggatgtaggtacaaacaatccgcagcgcctgaacgacccactctatatgggctggcgccatccgcgcattaccggcaaagaatatgatgatttcgtcgatgaattcattcaggcagtaaaacgccgctggccgaatgttctgttgcagttcgaagactttgctcagaacaatgccatgccactgttgacccgctatcgtaatgatctttgctgcttcaatgatgatattcagggtactgctgctgttgctcttggcagtctgattgctgccagccgtgctgcaggccgtcaactgaaagaccagacagtcaccttccttggtgcgggttctgctggttgtggtattgcagagcagattatcgctcagatgaaatcagaaggtttgagtgatgaacaggcccgtgcccgtgtattcatggtcgaccgcttcgggttactcacagataaacaaccaaatctgttggatttccaaagcgtactggttcagaaaagcagcgccctggattcctgggatgtcgacaaagacagcctgtcattaatggatgttgtccgtaacgccaaaccgactgttctgattggtgtttctggtcagtcaggcctgttcactgaagaaattatccgtgaaatgcataagcactgtgagcgcccgattgtcatgccgctgtctaacccgacatcccgcgtagaagcccgtccagaagacattattaactggacggaaggtaaagcgctggttgcaacaggcagcccattctcaccagtacagtatgaaggtcaggaattcccgattgcccagtgtaataactcttatatcttcccgggtatcgggttaggtgttattgcttcaggagccagacgtgtaacagatgacatgttaatggcagcaagccgctcattggcagattgctctcctctggcgcaaaccggctctggcccactactgccattgattgatgatattcaggatgtttcccgcaaaatcgccaaagaagtggcgaaaaaagcccagattcagggtgtcgcaacggtcacgtcagaagacgctttggaagaagcgattgagcgtaatttctggaaaccggaatatcgcatctataaacgcacatca

SEQ ID NO: 24023 - DNA, 1026 bp, Xenorhabdus nematophilus
aaaatcgcagttcaggaattgcgtgagcttggtcaggctgcattgatccgggccaatacaccggcggaagtggcaactctggtgatggatgatctgctagaaaatgaattaacaagctacccttcccacggtgtattaaggctagcggactacattggcgatattcagtctggcgtacttaatcctgccgctattccggctgtatcgctgaccatgcctaatatcgccattgtagacggctgtcgagcctttggtgtcttggtacggcaagagttaatactcgtattgcaaaaactggctctgaagcatggaatcgctatcgcctgcctgcgtgacgcccatcacctgggcagactggcggctatcggccgctctctggcaggctttaatgaccagccccttgcagttataggattcagtaactatcagggaaatggagcacgggttgctccgactggaggtcatctggcgagattatgtactaaccccctgttgctcgccttcccaaccaacacagctgatccttttgtattagatatgagcacttcaactgtctctgaaggctttatccggcgtcacgtccaagagaataaaccagtgccacccggctgtctggtcgatgccaaaaagaatgacatactcgacccttccagtctctacgacgtaccaccacgggcaacgatacagccactgggaggcaaccttgccggacacaaaggatacgggctggccgtagcaatggaattattctgtggtgcacttgcgggtgccggacatgtagccagaccgggtgcacccggcaacggtggcctgtttttggttatcgatccatccagaatgccggggggcattgatacgatccggagcgaggcggaagctatcatgaactattgtcgtgactcaggccgcccggaagctccggcacgtatgcccggtgaaggttatttcacccgccataacgaggcaaaaaatacaataacgttatcactgccaacttctgtgttaaccgaaatccgtcatcttgcc

SEQ ID NO: 24024 - DNA, 876 bp, Xenorhabdus nematophilus
tttacaggcagtatggttgcgataatcacaccgatggattcaactggccgggttgataagagcagtttgaaaaaattgattgattaccatgttgccagtggtacggcatcaattgtttctgtcggaacaaccggggaatgtgccacgcttaaccatgatgaacatgtcgatgttgtactgacaacgctcgaattagctgatggtcgtattcctgttattgccggaacaggtgcgaatgctactgcggaagctatatcgctgacccgatgctttgaaaatacaggtgttgttggttgcctgtctgtgacaccttattataataagccttcgcaggaaggtttgtatcagcactataaagcaatagctgagaataccgacttaccacaaattctgtataatgtaccatcgcgtaccggatgtgatttgctgccaccaactgttgcacgtctggcgaaactgaaaaatattgtcgcaatcaaggaagcaacggggaacttaagtcgtgtcagccagatccaagaactggttaatgatgaaagttttattctgctaagtggtgatgatgcaagttttctcgactttatgtatcttggcggaaaaggaacgatttctgtaacagcgaatgtagcggcagcagaaatggcacaaatttgtcagttggcttctcgtggtgaatttgcgaaagcgcgtagcctgaacagtagtctacaggaattgcatcataaactatttgttgaacctagcccggcaccagctaaatgggcatgtcataaactgggactgattgccagcgacacattgcgtctgccaatggttccgctgacgcaagaagggcaaatttcagttgagaatgccttgaaaatggctgaattactg

SEQ ID NO: 24025 - DNA, 1515 bp, Xenorhabdus nematophilus
actgaacaacaaccgtggtggttagacagcgctatctaccagatttatccaaagagttttcaggatagtacaggaaatggtactggtgatattaacgggatcacccaacgtctggattatttacagcacctcggagtaggtgctatctggattactccgatttatccatctccacaggtggataatggttatgatgttgccgactactgcgcaattaatcctgaatatggcacgatggaagattttgataatttggtggagaatgcccatcgccgtggcattcgcatcattttagatatggttttcaaccatacttcaacggaacatccgtggtttaaagccgcgcaggacgcaaatagcccttaccgtcagttttacatctggaaagagggtggtgggcaggataatccccctaataactggaaatccaagtttggcggcaacgcgtggcaatggcatgcagcgagccaacagtattacctccacctttttgccgtcgaacaggctgatctgaactgggaacatgaacccgttcgctctgaactgaaaaaagtctgtgaattctgggctgaccgcggcgttgatggactgcggctggatgtcattaatcttgtctcaaaacagcaggactatcctgatgatgatcgtggtgatgggcggcgtttttataccgatggcccacgtatacacgagttcttgcaggaaatgagccgtgatgttttccagcctaaagcgttaatgactgtcggtgaaatgtcttctacaagccttgagcattgtgtccgttatagcgcgttaagtgggaatacactctccatgacattcaattttcatcacctgaaagttgattacccgaatggggaaaaatggacacatgcgaaaccagattacattgaactgaaaaagatcttctcagtctggcagcaagggatgcatcagaaagcatggaatgctcttttctggtgtaatcacgatcaaccccgcattgtgtcccgattcggggatgaaaaacaacaccataaaacatctgccaaaatgttagcaatggtgctgcacggaatgcagggaacaccttatatctatcaaggtgaagagcttgggatgaccaatcctcactttaagcgcattgaagaatatcgggatattgaaagcctgaatatgtatcaggaacgcatcgaacaaggtatgtcttcagaagaaatactgacaattctggcgcaaaaatcccgtgataatagccgaacgccaatgcagtgggataacactgacaatgctgggtttacctctggtactccgtggatagcgaccagcgataattatcgtgaaatcaatgcagaatccgtattacaggacaaagattctgtattctactgctatcaggatttaattcagttaagaaaaacacagcccatactgacttatggtgattatctggatcttttacctgagcacccttctctgtggtgttatctgcgacgctggcaggatcagactttattggttattgccaatctt

SEQ ID NO: 24026 - DNA, 1686 bp, Xenorhabdus nematophilus
cattcaaaaggtgaaatgacggatattatccgtgcacgcagcaaagtattctggacaatcggtttatttacagcatttattaacttactgatgctggttccctccatttatatgcttcagatatatgatcgagtcctaccgtccagtaacacaatgactttgctgatgttaacgctgattacgctgggtatgtacgccatcatcggtggactggaatatattcggagtcaggttgttatccgtatcggcagtcagtttgatatgtgcctgaatcagcgcgtatataccgcatcgtatgaatctaatctaaaaaatggctcgacagatgcgggacaaatgctgaatgacttatcgaccattcgccagttcctgacgggaagcgcactgtttgctttttttgatgcgccctggtttccggtttatctgggcgttattttcctgttcagcccctatttaggattactggcactggttggggcgcttatcctgattgcgctggctgttctgaatcagtggttatctcattctcctctggcacaggccagtcacctttccctgcgctcggccaaccttgccagcaccaatttacgtaacgcggaagttattgaagcattaggcatgttaccggcgttacgccggcgctggtttggcctgcatgagcgtttccttaactttcagcgtatcgccagtgaaagatctgcatcgattacagctatcactaaaacagtgcgtatggcactacagtccttgatccttggtttaggaggctggctggcaattgaaggcaatatcacgcccggaatgatgattgccggctcaatcctgatggggcgggcgctatccccgattgaacagttaatacaggcatggaaaagctggaatgctgcccgtctgtcatggcagaggctggataatttgctgaaagcacagcctgagcggaaaagcggaatgacgttacctgctcctaacggaacgctgttgttagaaaaagtgtttgcttctccgcccggaaaaattaaagccgctaaatctactgaaaagaataagcctgttttgcaggacatcaatttttcccttgaagccggggatatcctcggtgttattgggcccagcgcatcaggaaaatccactctggcacgtttgctggttggtgtctggcaagctcaggaaggtgtggtgcggcttgatggtgcggatatttaccagtggaacaaggatgagctgggttctcacatcggctatttaccacaggatattgaattatttgccggaaccattgcggagaatattgcccgttttaatgatattgatgcggaaaaagtcatcgaagcggcagagaaggctggtgtacatgacttggtgctcaatcttgaacagggttatgacacgccgattggtgcaggaggtatgggattatccggcgggcagaaacagcggatcgggttggctcgggcgctttatggtaatccatcgttgattgtgttggatgaacctaattccaatctggatgatatcggggaaaaagcactgagccgggcgattaaccaattacgtcaacagggaaaaacggtagtggtgattacccatcgtccggcgttgctctcccaaacaaataaagttttgttgttagtacagggaaaaacgaaactatttggcccatctcagcaggttatggcggcattggca

SEQ ID NO: 24027 - DNA, 1299 bp, Xenorhabdus nematophilus
atgtccaaaatcgttaaagtgctcggccgtgaaatcatcgattcccgtggtaacccaacggtagaagcggaagtacatctggaaggcggctttgtaggtctggctgcggcaccatcaggtgcatcaacaggctcccgtgaagcattggaactgcgtgatggtgataaatcacgtttcatgggtaaaggtgtactgaaggcaattgctgcggtaaatggcccgattgcgcaggctctggctggtcaggatgcgaaagatcaggcgaatatcgacaaaatcatgatcgagctggatggaactgaaaacaaatccaatttcggtgctaacgcgattttggctgtttctcttgcaaatgctaaagcggcagcagcgtcaaagggtatgcctctgtacgagcacattgctgaactgaacggtactccgggtcgattctctatgcctctgccaatgatgaacatcatcaacggtggtgagcacgctgataacaacgtagacattcaggaattcatgatccagccagtaggtgcgagcacgctgaaagaagcggtacgcatcggttctgaagttttccataatctggcaaaagttctgaaagcaaaaggcatgaacactgcggtgggtgatgaaggtggttatgcaccaaatctggaatccaacgcagctgctctggccgctatcaaagaagcggtagaacaagcgggttatgtactgggtaaagacatcactctggcgatggactgtgcagcttctgaattctataacgaagaaacgggtaactatgaactgaaaggcgaaggtaagactttcacttctcaggagttcactcactatctggaaggtctgaccaaagagtatccaatcgtttctatcgaagatggcctgaacgaatctgactgggacggcttcgcttaccagactaaagttctgggtgataaaatccagctggttggtgacgatctgttcgtaactaataccaagatcctgaaagaaggtatcgaaaaaggtatcgctaactccattctgattaaattcaaccagatcggttctctgaccgaaactctggctgcaatcaaaatggcaaaagaagcaggttacacagcggttatctctcaccgctcaggtgaaactgaagatgcaaccattgctgatctggcagtaggtactgcggcgggtcaaatcaaaacaggttcaatgagccgttctgaccgtgttgctaaatacaatcagttgatccgtatcgaagaagcgctgggcaaccgtgctcctttcaatggtctgcaagaagttaaaggtcaggca

SEQ ID NO: 24028 - DNA, 1431 bp, Xenorhabdus nematophilus
tatagaatgctgattggtggcgaatgggtagatagcacttcaaaagaaaccatgaagagctataatccggcaaccggagaactactgactgaatatgcagcaggaaatgctcaggatgttgaactggctgtccgggcggcaaaaaaagctttaccggcatggcgaaaaacttcagccgaaaaaaagcaatccctcctactgaaaattgccgatttactggaagctgaagcagaacgttttatcaccctggaaaccttagatgggggtaaaactcaatctttatgccgtaattttgatatcccattcgctatcgatcatttccgttattttgctggtgtgatccgtgctcactctgatgcatctgatgtcattgatgaaaatactctcagtctggttatcagagaaccaataggtgtcattggtcaaattattccctggaacttccctctgctgatggcagcctggaaaattgctcctgctctggcggcgggtaatactatcgttatcaacccggccagcctgacgcctatcacactgctagaactaggccgtatcattaatcaggttcttcctgcgggcgttgtcaatatcgtcacaggtcgtggctctgctgttggtcaggcgatcctcgatcatgaaggcattgacaaggtagcctttacaggctcaacagaagtcggctacaacgttgccgctgccgccgctaaaaggcttattcctgcgacgctcgagctgggaggcaaatctgccaatatcgttttccctgatgccaatataaaaaaagcggtcaaatgtgcagcccacgctattttgctgaatcagggacaggcttgtgagtctggtgctcgtctattcctgcataaagatatctatgattcattcctgcaatcattaaaaaccgtctttgaatctatccgcgtcggtgacccgatggatccggccactgagatgagctgtcaggtcagtgaagagcagatgaatacgattctgggctatattgacctcgctaaacaggaaggtgcgaccattcttaccggcgggaaacgcattactggtgcaggttatgacgatggcttctttgtccagccaacgatccttaccaatgtcactaataatatgcgggtagctcaggaggaaattttcgggccagtgctttgtgtcattcctttcagtaatgaagaggaagttgtggaaatggctaacgattcagaatatggtctggcgggagcagtctggacacaggatatcaaccgcgccctgcgtgtcgccaaagccattgaggcaggccgtatatggatcaatacctatcatgaacttccggctcacacaccatttggcggctataagaaatcaggacttgggcgggaaacacataaaatgattctggatgcctatactgaagttaaaaatatctacatcagtaccaaagaa

SEQ ID NO: 24029 - DNA, 1152 bp, Xenorhabdus nematophilus
atgactacacacctttttacttctgaatctgtttcagaaggtcatccagataaaattgccgaccaaatttccgacgctgttcttgatgcaattctagaacaagatcctaaggctcgtgtagcctgcgaaacttatgtgaaaaccggcatggttatggttggtggtgaaatcactaccagcgcctgggttgatatcgaagaaattacccgcagtacagtacgtgagattggctacaccagttcagaaatgggctttgatgctaattcctgtgcagtaatcagcgcgattggtaagcaatctcctgatatcaatcagggtgtagaccgagctgaccctctggaacaaggagcaggtgatcagggattgatgtttggttatgcaaccaatgaaaccgatgttcttatgccagcacctattacctatgctcaccgtctggttgagcgtcaggcgcatgtacgtaagaacaaaacactgccttggttgcgtccggatgccaaaagtcaggttacattccagtatgacaacggcaaaattgtcggcattgatgctattgtactttctactcagcattcagaagaaatcggtcagaaagagctgcaagaagcagttatggatgagatcatcaagcctgttttaccggcagaatggctcactccgatgactaaatacttcatcaacccaacaggccgtttcgtgattggtggcccaatgggtgactgtggtctgaccggccgtaagatcattgttgatacgtacggtggtatggcccgtcacgggggtggagcattctcaggaaaagatccatctaaagttgaccgttctgcggcttacgcggcacgttacgtggctaaaaatatcgttgccgcaggtctggctgaccgctgtgagattcaggtttcttatgctatcggtgttgctgaaccaacttctatcatggttgaaacgtttggaactgaaaaagtaccaacatcaacactggttcagctggtacgcgagttcttcgatctgcgtccttatggattgatcaaaatgctggatctactgcatccaatctatcgtgatactgcggcatacggtcatttcggtcgtgagcagttcccgtgggaagcaacagataaagctgaaatcctgcgtgatgcagccgggctgaaa

SEQ ID NO: 24030 - DNA, 1926 bp, Xenorhabdus nematophilus
ctctactccatgaaggagactgccatgaatgataatatcgctcgtaaaatgcgccagacttacaatattgcatactggggcggcaactattactacgtcaatgatctgggtaatgtcagtgtttgtccaaatcctgatttgccggaagctcaggttgagattgttgatctggtaaagaaagttcaacaagagaaaaaacaattacagctgccagcattgttctgttttcctcagatcctgcaacatcgtttgcgttccattaatgcagcctttaaacgtgcgcgtgaatcctatggttataaaggtgattactttctggtttatccgattaaggtgaaccagcagcgtcgcgtgattgaatcactggctaattctggcgaacctgtcggtctggaggctggctccaaggctgagctgatggctgtactggctcatgcaggtatgacacggactgtaattgtctgtaatggttataaagatcgtgagtatattcgtctggcactgatcggtgaaaaactgggacataaagtgtatctggtcatcgagaaaatgtctgagattgcaatggtgctggaagaagcggaacgtatcaatgtcgtacctcgtcttggtgtacgggcgcgtcttgcttcacagggagcgggtaaatggcagtccagtggcggggagaaatccaaatttggtctggcggcagcacaggttctacaactggttgaaactcttcgagcagccggaaaactggatagcctacaattgttgcatttccatctgggttcccagctggcaaatatccgtgatatagcaacaggtgtgcgcgaatcagcccgtttttatgtcgagctgcataaactgggtgtcaacattcagtgttttgatgtgggaggaggactgggtgttgattatgaaggtacacgttcccagtcagaatgttccgttaactatggcctgaatgaatacgcgaacaacgttatctggggaatcggggatgcctgcgaggaaaatggcctgccacacccaactgtcatcacagaatctggtcgtgcattgacggctcatcataccgttttagtctccaatgttattggagcggaatgtaatgaattcaccgagacgacaccaccggcagaagatgctgcacgtcctctgacaagtttgtgggatacatggctggaaatgcaggatgatggctacaagcgttctttgcgtgaatggctgcatgatagtcagtttgatctgtacgatgttcatacccagtatgcccacgggattttgagtctctccgagcgagcttgggcagaagaattatatttaaatatctgccgccgtattcagcaggatcttgatccaagtaaccgtgctcatcgtccgatcattgatgaattacaggagcgcatggctgataaactctatgtgaacttttccctgttccagtccatgccggatgcctgggggatcgatcagctgttcccggttctgccacttgaagggctggacaaaccgctggatcgccgtgctgttttgctggatatcacttgtgactctgacggcattatcgatcattatgttgaaggtgatggtgtggcgacaacaatgccaatgcctgcctatgatccggaaaatccgccactgatcggtttctttatggtcggagcctatcaggaaattctgggtaatatgcataacctctttggtgatactgcggctgttgatgtctacgttaccgaaaatggtgaagtgacttatcagcagagtgaagagggtgatacaattgccaatatgctgcaatatgtgaaactggagcctcaggtactgctgacccgcttccgtgatcaggtgaaatcgactgatttggctgaaaatctacaggaacagttcctgcaagagtttgaaagtggcctgtatggttatacttatttagaagatgag

SEQ ID NO: 24031 - DNA, 2007 bp, Xenorhabdus nematophilus
gaagcggccgaatgtggattagccagtttagcaatgatatttcattatcatgggctacaaattgatttatccagtctacgcagccaattcgggatttccacccgaggcgtaacgctgacgacactgatcaatattgccactgtccttaagttcaaaaccagagctgtagcactggatcttgatgagcttcaagcactaaaaacaccctgtattttgcattgggacatgaatcattttgtcgttctggttaatgtaaaaaaaaataaaatcactatccatgatcctgcattcgggcaacgtgtgatgacttttgcggaagtatccaaacactttactggcattgcattagaagtgtggccaggcagtgaatttgttccgataaaaaaacaaaataaattacgcattatctccctgctgaccaatattcagggaattaaatcgacactgagtaaaatatttttcttatctctggttatagaagcaattaatatactcttgccggtcggaactcaattaatcatggaccatgtcattatcgctcaggatcatagccttctgaagattatttgctgtggtttactctttttcatcttatttagagtcagtgtatccacattacgtagctggacatccattactatggaagcatttgtggatgtacaatggaaatccggtgtatttgatcatttaatgaaattacctttagcatactttgaaaaacgtaaattaggtgatattcagtcccgctttggctcactcagtgtaatacggacaactttcactcaaaatgttattaacagcattattgatactattatgctggttagtgttttcattatgatgctgctttatggtaactggctcgtttgggttgtattagggtttactatcatttatatcatcataagatttataacctaccaatatttcaggcagctctctgaggagcaaatagttaaagatgccagagccaattctcattttatggaaacattgtatagcattaatacattaaaggccctggggttatgtgatagccgggcaaaatcctggttaaacctgaatattgatacacttaattcaaataccagacttaacaagataggctccatttttaatattattaagacttttatttccacgagtgagcaaattatcattttgtggttaggagcatcattagttatagataatcatatgacacttgggatgtttgtagcgtttaattcatatcgtgggcaatttgctgacagagcaagtaatttaattgatatggcaatgaaattacgcatgttaaacttacataatgaaagaattgccgatatcgtacttactgatacagaaaaagaaacgccagatagggaacttggtttttcaggaaaagcggttaatttaaccatccatgatttacattatcaatatgataatttatcaaagccgattatttctggttttaatctccatattaatgcaggagaaagtatcgccattgttggaccgtccggggccggaaaaacgacattaatgaagctcatgagtggtttattagagccaaataagggtacaattctaatgaatgggcttgatattaatattattggtttaaataactaccgaaaatgtattgcctgtgttttacaggatgataaattactttccggttctatcgcagaaaatatatccgggtttacccactcaccagatgtacacttcattcaggaatgcgctaaacgtgcaaatattcatgatgatattttattgatgccaatgggatatgaaacactgattggtgagttaggtaatggattatcaggtggtcaaatacaacggctattgattgcaagagcgctgtatcgtcgcccaagcatcctatttatggatgaggcaaccagccatctggatttagataatgagtcatatattaatgagtcagtatcttcattaaaaattacccgaattatcattgcgcacaggccctcaactattcaatcagcagagcgtgttatt

SEQ ID NO: 24032 - DNA, 1065 bp, Xenorhabdus nematophilus
taccatattgcggtgttgcccggtgacggtattggcccggaagtcatgaagcaagcctataaagtactggatgctattcgtcgtcgtttttctattcgcatcacaaccagtgaatatgatgttggagggattgccattgataggcatggttgtcctttacctgaagccactgttgctggttgtgaaaaagcagatgcaattctgtttggctctgtcggtggccctaaatgggagcatttacccccggccagccagccagaacgcggagcattgttgccactgcgcaagcacttcaagctattcagtaacctacgtccggcacatttatataccagtctgacgtctttttgcccgctgcgtcatgatattgcggaaaaaggtttcgatattttatgtgtgcgtgaactgacaggcgggatctatttcggtcagcccaaaggacgggaaggtgaaggaagatacgaacgtgctttcgacacggaagtctaccatcggtttgaaatagaaagaattgcccgcattgctttcgaatcagcccgtaagcgtcggcataaagtgacttcgattgataaagccaatgttttgcaaagttctgttctgtggcgtgaaattgtcagtgaaattgcgaaagaatatcccgacgttgaaatcaatcacatgtatatcgacaacgccacgatgcagctcatcaaagcaccgtctcagtttgatgtattgctttgctccaatatctttggtgatattctgtctgatgaatgtgccatgataaccggttcaatgggtatgctgccttctgccagcctgaatgagaaaggatttggtttatatgaacctgccgggggttctgctccggatatcgcaggaaaaaatattgctaatccaatcgcccagatcctatccaccgctctcttgcttcgttacagcattaaacgtgatgatattgcagatgccattgaaacagcagtcaatgctgcactggaacagggttatagaaccgctgatttggcgggtaacggagaggctatcagcactgatgaaatgggtgacattattgctcaaaatatc

SEQ ID NO: 24033 - DNA, 2127 bp, Xenorhabdus nematophilus
atggcactttccagttcaataaaaaatcaaatcagtcaatggtataaggcgttatccacccacattgatggcttcataccaagagctccccaacgtcagatgattgcagaagtggcgaaaacactggcagatgatgaaggacggcatttggttatagaagcacccaccggagtaggaaaaacattatcctaccttattcctggtattgcagtcagtcgggctgagcagaaactattagtagtgagtactgctaatgtggctttacaggatcagatttacagtaaggatctaccgctattacgaaaaatcatcccagatttgaaattcaccggggcttttggtcgcgcgcgttatgtttgcccgcgtaatctggaagctatttgcgccgcagagggggagcaaattgatttaatgctgctggtggaagatcagactgctgtagcaaatagtgaagaacgagaactgtgtcgcaggttacgcaatgattactctacttttggctgggatggtttgcgggatcatcatcagctggcattgtcggattcgctatggtcaaaggtcagtactgataagatgaactgtctggcccgtaactgccagttttatcaccgttgtccattctttctggcccgaaggcagattgaagattctgatgttgtcgttgccaatcattctttggtgatggcggcattggaaagtgaatccgttctgcctgaagctaaaaatatgttgctggttctggatgaaggccaccatatcccggatgttgcaagggattcactggaggtggaaggagagattacgctatttcagctaaatgggcagcttgattcctttgttcgtcatgtcgagcaatatttgcttcagttccgtccgacaaaaccgcctgctttggctgagataacccgtttacaggctcattgtgaaaaaattcgtgagtgtttcagggagctggctgatatcacacaggcattattgcccgaacgaggggatgcggaagaatacctgtttgaactgggaaaattaccggataatttgctgctgtgctgtcagacactatttaagctgacagatggcctgcgtagcttatctgaagcgattctgaatgatcttaccgatcaaaccgcgaaacaggatattgtcaggttgcatcgggctatcttgctgactagcaggacactgggttatttcgaaaatatggcaaagctgtggcggttggcttcgcaggaagaatcctcccatgctcctatctcaaagtggctgacacgccgttatgagaagaatcagtcacatctttactttcactgcgcgggtattcgggtcagtgaacaattaactcagttattgtggcgaaacattcctcatattgtcgtaacatctgcgacattgcgctctcttaacagcttttcccgtattcaggagctgacgggattgcatgaaaattatgatgatcgctttgttaccttgacatcctcttttgaacatgtgcgccaagggcgtctgattattccgcgaatgacgctggagcctacaatccataatgaaatgcaacaccttgaggaaatggcgcgttatttccgttcgcaaatattgttgggtgctcatcagggaatgttagtactgtttagcagccaacgcgcgatggagggttttctccaatttgtaaaagatttacggctgatgttactggtgcagggggatcagccacgatatcggctggtggaaacccattgcaaacgtattgacgaagggcaacccagtgttctggttgggttgcagtcttttgctgaaggactggatttgaaaggtaattacctttcacaggtacacatccataaaattgcttttccgcctgtcacaaaccccgtcattatcactgaaagtgagtggcttaaatccctgaaacgctacccttttgaagtgcagagtttgccgagtgcttctttcagtcttattcaacaagtgggaagactcatacgcagtcatgagtgtcatggtgatgtggtaatttatgacaaaaggctgctgaccaagcgttatggatctcgtttgctggatgcattgcctgtttttccgattgaacaaccggatataccttcggaagaaatattactgaaaatgaaaaaa

SEQ ID NO: 24034 - DNA, 987 bp, Xenorhabdus nematophilus
cagcagaagagacacaacaagtacagcaagaaacggtacatcaggaaaacggacaatccgggcaacagtaatagccgatataccctcagatttattgcagtacccaatttagtagtataacgcacggaatatccaatgacggggaggcttatgaacagtcaatattttgttattccacaatggctaagcgaacatctcaatgatgagaatgttgttgttattgatgccagtgctcccatgccaactgaatccattgattatcagcagaaatggctggagaaacatataccgggctccggcttttttgatcttgataaaatagctgatcttcagagtccattaccacatatgctccctgctccggaaactttccaaaaagccgttagcgaaatgggaatcagtgaaaatcatctgattgtcatttacgatcagggaaatatgttttcggctccacgggcgtggtggacatttaaaacttttggcgcaaaaaacatccgtattcttgaaggtggcttacaaggctggcaacgggctggttacccaactgaatcgggagaagtcagccaccatgcacaggtattcaatatccatttttctcccgaacatgtcatttcccggcaacagatccttgatattctccataatgaagaggagaaaacacaagttgtcgatgccagatcagtagagcgttttcaggccagagcacctgagccacgcccgggtttaagaatgggccatgttcccggttcaaaaaatgtcccgtggacagcgctacttgaaaatggacattacaaatcgccagatgaaattaaacgtatctttaaacaacaaggtgtcgatttagggcaacccattatcactagttgtggctctggaatgacagcggccgttttagttctagggcttgatataattggtcataaaaaagcagcattatacgatgggtcatgggctgaatggggagctgatgataatctcccatcagaa

SEQ ID NO: 24035 - DNA, 1248 bp, Xenorhabdus nematophilus
acactgtccatccatgccggttactctcctgatcctacaactaaagcggttgccgtcccaatttatcaaacaacgtcctatgcctttgatgattcgcagcatggggctgatttatttgatttaaaagttgaaggcaacatttacacccgcattatgaacccgactaatgatgtgctggaaaaacgtattgctgctttagaggggggagtgggtgcacttgctgttgcttctggcatggcagcaatcacctatgctattcagacaattactggcctgggagataacattgtttctgtagcaaaattgtatggcggaacttataacttgatgacacataatttccaaaatattgggattgaagtccgttttattgatcatgacgatcttgctgctcttgaatcgatgattgatgaaagaaccaaagccgttttttgtgaaacgatcactaatccaagcgggaatattgctgatatccgcgcattcgctgatattgctcatcggcacggtattccacttatcgtcgataataccgttgcaacaccttatttgtgtcgtccgtttgaacatggtgccgatattatcgtacattccctgaccaagtatattggtggtcatggaaattccatgggcggaatggtgattgattcaggcaatttcccctgggcagatcataaggatcgttttgctgttttgaatacgccagatccttcctatcatggtataaattatctcgaacattttggtgtagcagcatttattgcccgctgtcgtgttgggcagctgcgtagtactggtgcatccctttctccttttaatgcctttttgattttacagggccttgaaacactcgctcttcgtatggaacgtcatactgaaaatgccttgaaagttgctcagtatctggaacaacatcctctggtatcctgggttaaatacgccggactaccaactcaccctgaatatgatttggctgtacgttatatgggagggaaaccttctgctattctatctttcggtattaaaggagaggaaaaagcagcaacacgttttattgatgctctgcaactgattacacgtttggttaatattggtgatgctaaatcattggcttgtcatcctgcatctacaactcatcgtcaattaaatgaaaaagagttgataaaagctggcgcatcacgagatctgatccgtttgtctattggcattgagcacagtgatgacattattgcagaccttgcacaggcattg

SEQ ID NO: 24036 - DNA, 1347 bp, Xenorhabdus nematophilus
atgaattttgagtcactcggcttgaaggctgatattttgcgtgccattgaagaacaaggatacgcagagcctacccctattcagcaacaggcgattcctgttgtgttgtccggtaaagatctactggcgagtgcccagaccggaacggggaaaacggcaggttttactttgcctatcttacagttattgagtgaatctcccattcaatctaaagggcgtcgcccagtcagggctttgatcctgacgccaacccgtgaactggcggcacaagtaggggaaaatgtccacaattacagcaaatatctccggctacgttcctttgtggtatttggaggggtaagtatcaacccgcaaatgatgaaattgcgtggtggagtcgatattttagtcgcaacaccagggcgtttgctggatctggaacaccaaaatgccgtagacctatcccacgtggaaatgctggtcctggatgaagcggatcgcatgttggatatgggttttattcatgacattcgtcgggtactgaataaactgccagccaaacgtcagaatctgctgttttcagcaacattctcggatgagatcaaaaatctggctaataaattgctgcgtgatccggccagtgtagaagttgcccgtcgtaattcagcttctgagcaaattgaacaggctgttcattttgtagataagaaacgcaaaggggaattgctttcttatatgattggcagccagaactggcagcaggtactggtatttacccgtacgaaacatggcgcaaaccgtttggcagaacagctcaataaagatggtgttactgcggcagcgattcatggcaataagagccagggggccagaacccgtgcattggctgattttaaaagtggtcagatacgggcattagttgcaacggatatcgcggcgcgtgggttggatatcgaccagctacctcatgttgttaactatgaattgccgaatgttgcagaagattatgtgcatcgtatcggtcgtaccggtcgtgccgaagcaacagggcaggcaatatctctggtatgtgttgatgaacataagttattgaaagatattgagcgcttgctgaagcgggaaattccgcgtattaccactcccggctatgaacctgatccttcgattaaagcagaacctattcagaatggtcgtaacgggcgcagcaatcagccccgagctcagcgcaccggtgataaacagggcgctacccggcaaaatcatggccattcacgcaacaagaatgtatggccaaagaatgcttcatcacagaaacctcgcaatcgcagatcagttaaagcggtagcaggagagtaataccatgcgcgt

SEQ ID NO: 24037 - DNA, 648 bp, Xenorhabdus nematophilus
ctgaaatgtagaggttttttatttgatttggatggtacgctgatcgattcactgcctgccgttgaacgggcatggattaagttcgcagataagctgggtattgatcgcgatgaagtactgaactatgtgcatggcacaccagcattattatcaatacgccattttatgcctgatgccacagaagaagagattatcagtacttttaagtggattgaaaaaatcgaaacagaagatatggaaggtattactgccttgcccggtgctattgctctgattgataaactgaatgcgctggagatcccgtgggccattgtcacatcaggaacaatcccgcttgcttctgcccgccataaagaagctgaattaccagagccagcccattgggtgacagccgaatcggtcaaaaatggtaaaccaaatcctgagccttatttgctgggagcacaaaaattagggctgctgccggaagagtgtgtggtttttgaagatgcagcagcgggtatccatgccggattagatgcgggctgtcaggttgtggttgttcatgatgaaccgggaatttcccgtcgtgacgaaattcatatgactgttaccaacctggaagatatcgaaattgttaaatccggcggttatgtaacgatttatcaa

SEQ ID NO: 24038 - DNA, 1965 bp, Xenorhabdus nematophilus
ctggataaattcaccttagatgtcactgcgaaagctaaagtcggcaatattgaccccgtttttggtcgtgatgatgaaatccgccagatgatcgacattctatcccgccgtcgtaaaaataacccgatactggtgggagagccgggagtcggtaaaacagcgctggtggaaggattagccttgcgcattaccgagggtaatgttcctgaaagcctgaaaacggtcagcctgcgtactctggatttaggattattacaagcaggagcgggagtaaaaggggaatttgaacaacggctgaaaaatatcattgatgctgttcaacaatccccgacgccaattctgctgtttatcgatgaagctcataccattatcggtgcaggtaatcaggccggtggggcggatgctgccaacctgctgaaaccagccttagctcgtggtgaactacgcactatcgcagcaaccacatggtcggaatataaacagtactttgagcgggatgccgcactggaacgtcgattccagattgttaaagtagatgaaccggatgatgaaaaagccagcctgatgctgcgaggcctgaaacctcgttatgccaaatatcatggagtgcatattaccgacgatgcattaaaagccgcagtgactttatcccgccgctacttgacgggtcgccagttaccggataaagcggttgatctgctggataccgctagtgcgagggtcagaatgagcctcgatacccagccagatgaactggtacggttacgttcatcgctggcagcactggatttagaagcggaagccttgcaggaagatcactttgtcggtaatgcggtggaagtcagtcgcctgattgatatcacccaacaacgagaagcacttgaaaaccaacttcaattgactgaagcacaataccagcaagaaaaagcgctgactgaacagttactggattgtcgtcagtcagggagtaacgccggagaaaatgcccggctgcaacaacaactggcagaaattcagaacggagcaccgttactggggctggatgtagatgtgcgcacggttgctactgttattgctgactggacgggcgttccactatccagtctgatgaaagatgaacaggccgatctattgtcactggaacagcatctggaaaaacgggttgttggccaatctgctgccttggaaagtatggcccaacgcttgcgggctgcgaaaaccgggctggcatcggaaaacgggccgttgggtgtatttttgctggtggggtcgagtggaattggcaaaaccgagacagccctggcgctggcagacagtctgttcggtggcgaaaaatcgctgataacgatcaacctatcggagtatcaggaaccgcatacagtcagccagctcaaaggttcaccaccgggttatgtgggttatggtcagggaggaattctgaccgaggcggtacgtaaacgaccttacagcgtagtgttgttggatgaagtagaaaaagcgcatcgtgatgtgatgaacctgttttatcaagtttttgatcgtggttttatgcgtgacggagaaggtcaggaaattgattttcgtaataccgttatcgtaatgacttctaatctcggtagtgatcatttgatgcagttactggacgaacaaccagaatcgacggatagcacactgcatgaattgttgcggccgatactacgtgatcacttccagccagcattattagcacgttttcaaactgtaatttaccgtccgctgggagcacaagcgctgcgtaccatcgtggagatgaaactggcacaggtagcaaaacgtctgaaactgcattaccgactggactgtgtagtagaagaatctctgtataacacgctggtggaagcctgcctgctaccggatacaggcgcacgtaatatcgatagcctgctgaaccagcaaatcctgccggtaatgagccaacaactgctg

SEQ ID NO: 24039 - DNA, 1323 bp, Xenorhabdus nematophilus
atgaaagaaagtagtgccgaattggtcgaaatcttccggcattcggttccgtatatcaatgcacatcgcaacaaaacttttgtcgttatgctgggtggtgaagctatcgcccatgaaaacttcccgaatatcgtcaatgacatcggtttgctgcacagtctcggcattcgtctggttgtcgtgtatggtgcccgcccgcaaatcgatcaaaatctcacagaacatcactgccagccggtttatcacaagtacacccgggtaaccgatgcccgaacactggatttggttaaacaggccgcaggcctactacaacttgatattaccgcccggctttctatgagcctcagtaatacaccactacaaggcgctcatattaatgtcgtgagcggcaattttattattgctcagcctttaggtattgatgacggtatcgactattaccacagcggaaggattcgccgaattgatgatgaggccataaatcagcagttagataataattccattgtactgattgggcctgttgctgtttccgttaccggtgaaagttttaatctgacaacggaagaaattgctgcacaactggcaattaaactgaaagccgaaaaattgatagggttctgttcatcacagggggtcaccgatgctgaaggacataccttatcagaaatgttccccaatgaaggagaaatacggctgaataatctggaaaacgccggtgattactcctccgaaacagtacgttttctgcgtggagccattaaagcctgccgccgtggcgttcggcgcagtcatctgctcagttatcaggaaaatggctctctcattcaggaattgttctcccgcgaaggcataggcactcagattgtcatggagcgatccggacagatccgccgggctaatatcaatgatattggtggtatccttgagttgatccgcccactggagcagaagggaattctggttcgtcgttcacgtgagcagctagaaatggaaatcgataaattcaccctgatagaactcgataatatcactatcgcctgtgcagcactctattcctatcctgaagagaaaatcggcgaaatggcctgtgttgctgtacatccggattatcagaactctgcacgtggcgaagttttattgggtgcaatcattaatcaggcccggcagagcgggctggaaaaattatttgtcctgaccacgcaaagtattcactggtttcaggaaaaaggctttgaacccgcagaaatcacgatgttacccgtggaaaaacaggcgctgtacaattaccagcgccgttccaagatcctgatgttagacctg

SEQ ID NO: 24040 - DNA, 1353 bp, Xenorhabdus nematophilus
cggtatctgagcgaaaatgtgctaaatcaggttatgcctgtttcctcacctgcctttgtgggccatatgacatccgctcttcccctgcacttaccggtgctggggaagatactgacagcgctgaatcaaaatgttgtcaaactggaaacttcccacgtcctgaccgcgctggagcgtcaggtcttgggaatgatgcataaacttgtctacaactgtgatgataatttctatcaaaaatggcttcacaatggtgatcatgcactggcgagcttctgctccggcggaaccgtggctaacctgactgcattatgggcatgccggaatcagcttatgcccgcagatggcgactttgccggacttactcgtgaaggtttagcccgtgggttaatccattatggctatagtggactggcgattctggtatcagaactgggacactattcactgaaaaaggccgttgatgtgctgggtcttgggcaggatgcactggttaaaatcgctactgacaaagacgggaaaatctgtcttgatgacctgctcattcagttacaggaacttcgccgacgtaatatcaaaccgatggcaattgtcggcatcgctggcagtaccgaaaccggctctatcgacccactggatgcgctggctgatattgctgaacgggaacagtgtcattttcacgtcgatgcagcatggggaggtgccagcctgttatcagaacgctaccggcacttattcaagggcatcgagcgtgcggatagcgtgactattgatgcacataaacagatgtacgtcccgatgggatcaggcatggtgctattccgtcagcccactatggccgatgctattgagcagcatgctaattacatcttgcgcaagggatcaaaagatctgggcagacatactctggaaggttcacgtagcgcgatgtcgctgatgctgcacagtaaccttcacctgcttgggcggcagggaatggcagctctgatagatgcaggcattgagaaagcacatcagtttgcggacttcattcaccaacaggaagatttcgaactaatcagcgaaccgcagctttgtctgttgacttaccgctacgccccacctgctgcaattaaactgatgcgtgagagttctgagccgatacgacaaaaagtgcaggatatgcttaatgccctcaatcagaatatccagaccatgcagcgctctgccggaaaaacatttgtttcacgtaccagtattaaacctgcgcaatgggataaacaaccaacgactgtttttcgcgttgtgctggcaaatccactaacaacgccggaaatactggaggacatgattgaagaacagcgccaactggcaaga

SEQ ID NO: 24041 - DNA, 1194 bp, Xenorhabdus nematophilus
atgtcagcttcgttttatcagaaaattaatgagcagttggaacaaacccgcgcggaagggttgttcaaaagtgaacgtattattacctctgcacaagatgcagatatcgccgttgctgatggtaacaatgtcattaatttctgtgccaataactacttagggttggcgaatcaccctgacctgatcgcggctgcaaaagcaggaatggatagccatggttttggcatggcatctgtccgtttcatttgtggtacgcaggattctcacaaagaattagaaaataaaatcgctgaatttttaggctttgaagatgccattctgtactcttcatgttttgatgcaaacggtggtttgttcgaaacgttattcgggccagaagacgcgattatctcagatgcactgaaccatgcttccatcattgatggtatccgtttgtgcaaagcaaaacgttatcgttatgccaataataatatgcaggaactcagggcacagctggagaaagcaaaagcagaaggtgcacagaatatcctgattgcaactgatggtgtgttctcaatggatggcgtgattgccgatctgaaatctatctgtgatttggcagatgaatttggcgcactggtcatggttgatgattctcacgcagtagggtttgttggcaagcatggccgtggtactcatgaatactgtgacgtcatgggacgtgttgacatcatcaccggtacacttggtaaagccttgggtggcgcatccggtggttacaccgctgcccgtaaagaggttgtggagtggttgcgtcagcgttcacgcccttacttgttctccaattcccttgctccttccattgttgccgcatctattaaagttctggatatgctgaaagacggagacgaactacgcgagcgcctctggagaaacgccaacttattccgtgaaaaaatgacagcggctggttttactctggctggagctgatcatgccatcattcctgtcatgttaggggatgcaaaactagcgcaggaatttgccgccgagctgttgaaagaaggtatctatgtgattggcttcttctacccggttgtgccgaaaggtcaggcgcgcatccgtactcagatctcagccgcccataccaaagaacaaattgaacttgtagtggatgcatttacacgtatcggtaagcaattgaatattattgca

SEQ ID NO: 24042 - DNA, 1023 bp, Xenorhabdus nematophilus
atgaaagcgttgtcaaaattaaagccagaagaagggatttggatgacggaagtgcccacaccggaattgggccacaatgatgtgatgattaaaatccgtaaaaccgcgatctgcgggacggatgtgcatatctataactgggatgagtggtctcagaaaactattccggtgccaatggtcgtcgggcacgaatatgtggggaaagtggtcgcaattggtcaggaagtcaaaggcttcaagattggcgaccgcgtatccggagaaggccatattacttgtggttattgccgtaactgccgcggcgggcgtactcacttgtgccgcaatacaacgggagtcggagtaaaccgtcccggttcatttgcggaatatctggttattccggcattcaatgccttcaaaattcccgacaatatctctgacgaactggctgcaatttttgatccctttggcaacgctgttcatactgctctttcctttaatttagtgggagaagatgtactggtatcaggtgctgggcctattggcatcatggcagcggctgtatgcaaacatgttggcgcacgtcatgttgttatcacggatgtgaatgagtatcgccttgaactggcaaggaaaatgggtgtcactcgtgccgtgaatgtcagtaaggaaaatctgaccgatattatgtcagaactgggtatgacagaaggttttgatatcggcttggaaatgtcaggagcaccaccggctttctgtaccttgctcaatgccatgaatcatggtgggcgtattgctttattggggatcccaccttctgatatggctattgactggaatcaggttattttcaaagggctgtttattaaaggtatctacggacgggaaatgttcgaaacatggtacaaaatggcggcattgattcagtctggtctggatctgactccgattatcacttaccagttctcaatagatgattatcagaaaggctttgacatcatgcgttcagggcaatctggcaaagttattctaaattgggat

SEQ ID NO: 24043 - DNA, 990 bp, Xenorhabdus nematophilus
gcttctatgatagttatcggtgccggctcatacggcaccgctttagccattacactggcccgtaacgggcataatgttgtgctctgggggcataatcctgagcatgtcctagctttgcaacaagccagatgtaatcaggcgttcttaccggatgtttctttccctgatagtttacagcttgaagctgaactgaagagtgctatttcagccagccgaaatatcctgatcgtggttcccaaccatgtcttcggcgatgttttacagcagataaagcctcacctacaaccagattcccgcattgtttgggccactaaaggccttgaagcagaaactggtcggttattacaggatgtggcacgtgagatattaggcaatgaaatcccgttagcggtggtgtccggcccaacatttgcgaaagaattagcggcaggtttaccgacagcaattgcggtatctgcgacaacatctgaatttggtgaagaactccagcagctttttcactgtggcaaaagcttccgagtatacaaaaatcctgattttatcggagtacagcttggtggtgcagtcaaaaacgtgattgctattggcgccgggatctctgatggtatgggtttcggggccaatgcccgcactgcattgataactcgtggtctggctgaaatgagtcggcttggtgttgcgttgggagcggacccttccacatttatgggcatggctgggttgggcgatttagtactgacctgtactgataatcagtcccgtaaccgtcgtttcggtatgatgctggggcagggcgttaatgttgacgctgcacagagtgacatcggacaggttgttgaaggttatcgtaataccaaagaggttcgggcactagccagacgagttggtgtggaaatgccgataacagagcaaatctaccagatactataccgtaacaaaaatgtactcgaagcggctcaggcattattgggaagagcgacaagggatgaa

SEQ ID NO: 24044 - DNA, 1257 bp, Xenorhabdus nematophilus
ttgatgaagcagatcgttatcgccattttgcttggcgtgataacgggatggggatttaatcattatcttgaagccagtcaggcaaaagaaattgcctcttatatcaacattattaccgatgtttttctgcgcctgataaaaatgattattgggccgcttatattttccacgattgttgccggattaatgtcaattggagggtcatcatctgttggacggatcactatcaaagcaatgatatggtttattgttgctggcttgatttcgattagcattggcactctgatagctaatttgttccagccaggagtcgggctgaatattgcaattccacaacatggaaatatcgatacgagtctgaatgctggtgaattttccctgaaaaactttatcagccatatatttcccagtagttttgtggaagctatggcaaataatgaaatcttacagatccttattttttctctcttttttggttcagcattgtcatatatttgccggaatagtcagaaaacaagccctatagtaactatgattgaagatctggggcgcatcatgttccgcatcacagattatgttatgtcattggctccaattgcggtatttgctgccattgcctctgcaattactattgaagggatggggttgctttatgagtatggagaattaattgctctcttttatctggggatatttttactttggtgcattttactgaccgttgggtttcttttcctcggcaaagatatttttttgctgatgcagcttatcagagagcctaccatactggcttttgccactgcgagtagcgaatctgcctatccaaagaccatgaatgcactgaactgctttggtgtaccgaaaaaaatttccagtttcgtattgcctctgggttactcatttaaccttgatggctcaatgatgtaccaatcctttgccattctttttattgcgcaggcttacaatattgatttgagtattacagaacagatcctgattatgttaacgttgatggttaccagcaaaggcatggctggcgtagcccgtgcttctgtagtagttattgccgccactctaccgatgttcaaactgcctgaagcgggtatattattgatccttgctattgaccagctccttgatatgggacgcacagccactaatgtggtgggtaactgcattgctacctcagtcattgctaaattggagggaaagcggagtagttctgaatctgaagtgcaggaaaaagagtttgtcgga

SEQ ID NO: 24045 - DNA, 1059 bp, Xenorhabdus nematophilus
cgtgaagttctgcatttaggttcctataactattctggactcaatggtcatcaaaagattatcgaatccagtatcaatgcaattcatcaatacggaactacatccagtggtgtacgccttctcaatggtactagtgacctacatcttgaaatggaacaacggttggctaaattccttggtgtggaagaagtcattactttcagctctggattttcagcgaatctcgcagccctctccacgctatgtcgtgaaggtgacatagttttcagtgatatgcttaaccatcaatctatcgttgatggtctgaaactaagtggtgcaacgacccggatttaccagcatgcttctctgaaaagtcttgagaataagcttagccaaacttcatttcaagcacgtaaatttattatcactgacggtgtgttcagtatggatggtgacttggcacccttgcccgggattgtcgacttagcacgaaaatataatgcgttcgtcattgttgatgatgctcatggtactgggcatattggaccgaacggccggggaagttgtgcttattttggaataacggatcaggttgatgttatcaccggtagtttgagcaaaggcttgcctggcgttggcggatttattgctaccaacaagaaaacaggaaatattatccgtattgctgcaaatccttacatttattctgcttcgttacctcccgctgtactcgcttcaatcatcagcgccatcgacattcttgagagttcacctcagttgactctggagttgcaagccaaggctgagtatttccgtcagaaattacgcgatgcaggatttaatatattgaacagcgaaacggccattgtgccattgattacgggggatgagcattgctgtttcgctatggcccgtatgcttcatgagaaaggcatatacgttaatcctgtgacttatcctgctgtaagtaagacacgggcacggattcggattaatttgagcgcaaacctgaacaacgaagagttggattatagcattcgtactttcatccaaattggtcaaaagctggctttaata

SEQ ID NO: 24046 - DNA, 3222 bp, Xenorhabdus nematophilus
atggcaaaacgtactgatattaaaagtatcctgatcttgggtgctggcccgattgttatcggtcaggcatgtgaatttgactactcaggtgctcaggcctgtaaagcgctgagagaagaaggttaccgtgtcatactggtgaactccaacccggcaaccatcatgaccgaccccgaaatggctgacgcaacttacatcgagccgattcactgggaagttgtacgcaaaattattgagaaagaacgtccggatgccgtcctgccaacaatgggcgggcaaacagcactcaactgcgcactggagctggaacgtcagggtgtattgcaggaattcggcgtaaccatgattggtgcaaccgctgacgccattgataaagcagaagatcgtcagcgttttgacaaagcgatgaagaaaatcggtctggatactgcacgttccggcatcgctcataccatggaagaagcactggcagtcgctgaagacgtaggcttcccttgtatcatccgcccttctttcaccatgggtggaacaggcggtggtatcgcttataaccgcgaagagtttgaagagatctgcgagcgcggtctggacctttctccaacgaatgaactgctgatcgatgaatcgctgattggttggaaagagtatgaaatggaagttgttcgtgacaaaagtgacaactgcatcatcgtctgctccattgaaaactttgacgcgatgggtatccataccggtgactccatcactgtcgcaccagcccagactctgacggataaagaatatcaaatcatgcgtaatgcctcgatggcagtactgcgtgaaattggtgtagagaccggtggttcaaacgtacagtttgcagtaaaccctaaaaatggccgcctgattgtcattgagatgaacccgcgagtctcccgttcatccgctctggcttccaaagccactggcttccctattgcaaaaattgcggcaaaactggcggttggttacacccttgacgagctgatgaatgacatcaccggcgggttgactcctgcttcttttgagccatcgattgactatgtcgtcactaagatccctcgtttcaacttcgaaaaatttgccggcagtaatgaccgtctgaccactcagatgaagtccgttggtgaagtcatggcgattggtcgcactttccaggaatctctgcaaaaagcattgcgtggtctggaagtcggcgcaacaggttttgacccgaaagttaatctggatgatgtacaatcactgaccaaaatccgtagcgagctgaaagatgctggcgctgagcgtatctggttcgttgccgatgctttccgtgcgggtatgtccgttgatggtatcttcaacctgaccaatattgatcgctggttcttggtgcagattgaagagctggttcgtctggaagatatggttgcagagcaaggcatcaacggcctgacttccggcttcctgcgtcagttgaaacgtaaaggttttgctgatgcgcgtctggcaaaactggctggcgtatccgaaaaagagatccgtaaactgcgccatgattatggtctgtatccggtttacaaacgtgtagatacctgcgcggctgagttttcaactgatacggcttacatgtactccacttatgaagatgagtgcgaagctaatccaaacaatgataagccaaaaatcatggtattgggtggtggcccgaaccgtatcgggcaaggcatcgaattcgattattgctgcgtacacgctgctctggcgctgcgcgaagacggttacgaaaccatcatggttaactgtaaccctgaaacggtttcaacagattacgacacctctgaccgcctttattttgagccggtaacactggaagacgtactggaaattgtccgcgttgaacagccaaaaggcgtgatcgtacagtacggcggccagactccgctgaaactggcgcgtgaactggaagcggctggtgtgccaattatcggtaccagcccggatgccattgaccgtgcagaagaccgtgaacgtttccagcaagcagtcaaccgtcttggcctgaaacaaccggcaaatgccactgtgacaaccatcgaacaggcgattgaaaaaggtaacaacctcggttatccgctggtggttcgcccttcctatgtactgggtggccgggcaatggaaatcgtatacgatgaaactgacctgcgtcgttacttccaaaccgcagtcagtgtttctaacgatgctccggttctgttggatcgcttccttgatgatgctgttgaagttgatgtggatgctatctgcgacggcgaacgcgtcctgatcggcggtatcatggaacatattgaacaagcgggtgttcactctggtgactcagcctgctccttgcctgcctataccctgagcaaggaaattcaggatgtgatgcgtaatcaggttgagaaactggcctttgaattacgcgtccgtggtttgatgaacgttcagtttgctgtgaaaaacaacgaagtctatctgatcgaagtgaacccacgtgcagcacgtactgtgccattcgtttccaaagcaacaggcatgccgctggcgaaagtcgctgcacgcgtaatggctgggcagtccttacagtcacagggtgtaaccaaggaaatcattccaccttactactccgtgaaagaagtcgtattaccattcaataaattcccgggagttgacccgattctggggccagaaatgcgctctaccggtgaagtcatgggtgttggccgtacctttgctgaagctttctccaaggcaatgctgggcagtaactccatcatgggtaaaaaaggccgcgcactgctgtcagtacgtgaaggcgataaagagcgtgttgttgatttggcggctcagttagttaagcagggctttgaactggatgcaactcatggtactgcggttgtcttgggtgaagcaggaatcaacccacgtctggtaaacaaagtgcatgaaggccgccctcacattcaggacagaatcaaaaacggtgaatatgactacattgtcaatactaccgcgggccgtcaggcgattgaagattctaaactgcttcgtcgcagcgcactgcaatataaagtgcattatgacaccaccctgaatggcggtttcgcaaccaccatggcgctcagtgctgacccgactgagcaggtcatttccgtacaggaaatgcacgcaaaaattaccaag

SEQ ID NO: 24047 - DNA, 1134 bp, Xenorhabdus nematophilus
ttgattaagtcagctatattggttctagaagatgggacccaatttcacggtcgcgccataggtgcagaaggtgtggctgttggtgaagtggtcttcaatacctcaatgaccggatatcaagaaatacttaccgacccttcctattcccgccaaattgttactctcacctatcctcatattggaaatgtcggcattaacagtgctgatgaagaatctcccgccattcaggcccaaggcttagtaatccgcgatttacctctcatcaccagcaactaccgtagtgaaaacaatctgtctgattatctgaaaaatcataacattgttgcgattgctgatattgatacacgtaaactgacccgcctgttgcgcgaaaaaggtgcacaaaacggctgtatcattgcgggtaatgaagcggatgttcaagttgcactggaaaaagcaaaagcatttcccggtctgaaagggatggatttggcgaaagaagtcaccacggcacagtcttatcagtggttacaagggagctggacactgacagaagggttgccggaagcccgtaaagaacaagaattgccataccatattgtcgcttatgattttggtgtaaaacgtaatatcctgcgtatgctggtggatcgtggctgccgcgtgactgtcgtaccagcccagacccctgcggatgaagtgttgaaaatggcaccagacgggatcttcctgtccaatggtcccggtgacccagaaccttgtgactatgccatcgaagcaattaaaaccttcctgaatactgaaatccctgtatttggtatctgtctggggcatcagttactggctctggcaagtggtgcaaaaacggtcaaaatgaagtttggtcaccacggtggcaaccatcctgttaaagatttagatcgcaatgtcgttatgattaccgcacaaaaccacggatttgccgttgatgaaaattcattaccagcaaacctgcgcgtaacccataaatcactctttgacggcacactgcaaggtattcaccgtactgacaaacctgcattcagttttcaggggcaccctgaagccagccctggtccgcatgaagccgcttctctgttcgaccactttattgcattgattgaacagcatcgt

SEQ ID NO: 24048 - DNA, 819 bp, Xenorhabdus nematophilus
atggctgatacagatattcgcattgctatcgtaggggccagtggccgtatggggcgtaatctcattcaggccgttcagcaggcggatggcgttacactgggggctgctctggtgcgttcaggttcttcattagtaggagcggatgccggagaattggctggcactggtactaacggtattacgatccatgataacctccactctgttattgatgactttgacgttttgatcgactttaccctcccggaaggcacactgacctatcttgccatttgtcaccaacaccgcaaagcggtgatcattggtacaaccgggtttgatgacgcaggtaagcaggctattcatgatgcttcccgtgacattccgattgtttttgccgcgaatttcagtgttggtgttaaccttgtcctgaaactgttggagaaagcggcaacagtaatgggagagcacacagacattgaaattattgaagctcaccatcgccataaagtggatgcgccatcaggcaccgcgctggcgatgggggaatctattgctcacacattaggccgtgacctgaaaacatgtgcagtctatgcccgcgaaggctatacgggcgaacgagacccgaaaagtattggttttgccactataagagccggtgatattgtcggagaacacactgctatttttgctgatattggggagcgagttgagataacccataaagcctcaagccgaatgactttcgcaaatggtgctgttaaagcagcaacctggataaccaataaaaatagtggcctttatgacatgaaagatgtccttaatctcgaaaactta

SEQ ID NO: 24049 - DNA, 1125 bp, Xenorhabdus nematophilus
attaaaccgaaaaaatctgttgctctgtcaggtgttaccgcgggtaataccgcgctttgtactgttgggaaaaacggcaaggaattgcattaccggggttatgatatttttgatttggcctcccaatgcgaatttgaagaagttgcctacctgttagtccatgaaaagctgccttcacgtgccgaactgactgcctataaggccaagctgaaagcattaagaggtttgccgagcagcgttaaatccgcactggaagctctaccagcagttgcacatccgatggatgtgatgcgcacaggagtctccgttcttggttgtacattaccggaaaaggaggaccataatcctgctggtgcccgcgatatcgctgaccgcctactcgcttccctcagctcgatattgctttattggtatcactatagttataacggacgccgtatcgatgtagaaactgatgatgattctatcgggggtcacttcctgcatcttttacatgggcagaaaccacgggcatcgtgggaaaaagcaatgcatacttcccttatcctgtatgcagagcatgaattcaatgcttcaacttttaccagccgggtgattgccggtacaaactcagatatttactctgccattatcggggggatcggggcgctgcgaggttcaaaacatggcggtgccaatgaggcttcatttgatattcaacagcgttatgatacgcctgatgaagcagaaactgacattctccgccgtctggagagaaaagaagtcattattggcttcgggcatccggtttataccatttctgatccacgccacaaagtgatcaaagaggttgcgcaaacgctatccgaagaagccggcacactgcaaatgttcaatattgccgatcgcattgaatctgtgatgagggatgagaaaaaaatgttcccgaatctagactggtttgcagcggtgtcgtatcacatgttgggggttcctacagccatgtttaccccactgtttgtgattgcccgtacttccggctgggctgcgcatattattgaacaacgtattgataataaaattattcgtcctacagctaattataccggcccggaaaatctgccgtttgtcccgattgaaaagcgc

SEQ ID NO: 24050 - DNA, 1878 bp, Xenorhabdus nematophilus
atgtcatttcaagatttttaccgacgttcgattgatgaccccagcggtttctgggcagaacaagccagacggattcattggcagcatccttttgaacaaacgctggatcacagtgatcctccttttgcccgctggttttgcggcggaaaaactaacctatgctacaacgcgtcagatcgctggctggaaagtcagcctgatgccaaggcgttaattgcggtttcaacagaaacaaataccgagcaagtcttcacctatcgggagttatatcaggaagtcaatcaggcagccgcgattatgctttctctcggtgtcaaaaaaggcgaccgtgtcgtggtatatatgccgatggtggctgaagccctgtttatcctgcttgcctgtgcccgcatcggtgctatccactccgttgtttttggcgggtttgcggcccatagtcttgctacccgattagataatgcagagccggtactggtcgtttccgctgatgcaggatcgcggggaggaaaaattatcccctacaagccattattagatgaagccattgaactggcagcacatacaccacgtcatgtattgatgataaaccgtggtttgagtgagataaattgggtcaaaaaccgggatctggatttcgcgacattacggcaggctcatctgggtaccgaagtccctgtagcatggctcgaatctaatgaagtttcctgtgtgctctatacgtctgggacaacaggaacgcccaaaggggtgcaacgggatgttggtggttatgccgttgcgctggcaacatccatggatattatttttggcggtaagcccggaggaacattcttctgcacatcagatatcggctggattgtagggcattcctatattgtttatgccccgctgattgccggaatggcaaccgttatgtatgaagggctgcccatccgaccggatgccgggatttggtggcggattgtggaaaaatatcacgtcaccagaatgttttctgcgccaacagccattcgagtcctgaaaaaatacccaacagacaatattgctcaatatgatatttcctctcttgaaacgctctatctggcaggtgaacccctcgacgaacataccgcacgctggattactgaaaccattaatgtccctgtgattgacaattactggcaaactgaaactggctggccaattatggcaattgcacgagcactggatgacaggcccggtcgttttggtagcaccagcttcccgatgtacggttttaacgtcaaattaattaatgagctgaccggacaagaatgtggtgataacgaaaaaggaatggtggttatcaaaggtccgttacctccggggtgtatccagaccatttatggtgataatcaccgttttgtaaatacctactggaaacacttcgatcaacaggtttattctacttttgactggggtattcgtgacagtgaaggctactactttatcttagggcgttcggatgatgtgattaatgtttctggccatcgtctgggaacccgggaaatagaggagtgtattgcaagccatgaagatgttgcagaagttgccgttatcggtattaaagatgatgtaaaaggacaagctgctgtttcctttgtcgtcctcaaagagggaaaagaaattcagagtgctgaccactttgcaacattggaaaaatcactgatggatctggtcgataaaaagattggcagtgtcgggcgtccggcacgtatttattttgtcacacaattacccaaaacccgctccgggaaaatgttgcatcgcactatgcaggcgatttgtgaaggccgtgaccccagtgatatcgctttgatagaaaacccggcgtcactggatgtgatacgtgatgcagtt

SEQ ID NO: 24051 - DNA, 1068 bp, Xenorhabdus nematophilus
acgtttaaaattgcagcaattccgggtgatggaattggtcatgaagtgcttcctgaaggtattcgggttttgcaggcggtggctgaaaaatgggatcttcatttatcgtttgaatattttgaatgggctagctgcgattattatctcaggcacggcaaaatgatgccggatgactggtttaatcaattaatgcagtttgatgctatttattttggcgcagtaggctggcctgaaaccgtgcctgatcatatctcactttggggctcattacttaagtttcgccgtgattttcagcagtatgttaatttgcgtcctgtgcgtttgttaccgggagtgccttgtccattagcgaataagaaaccggaagatatcgatttctatgtcgtccgggaaaatactgaaggggaatattccgctattggggggcgtttcaatgaaggtacagagcatgaagtggtgattcaggagtcggtttttacccgccgtggtgttgatcgcatcctgaaatatgcgtttgaattagcccagagccgcccgcgcaaattattaacttccgcgacgaaatccaatgggttatccatcagtatgccttactgggatgagcgggttgaaaagatggcaaaacagtaccctgatattaaatgggataaacagcatattgatattctttgtgcccgctttgtgttgaatccagagcggtttgatgttgttgtcgcttccaatttatttggcgatattctttccgatctagggccggcatgtaccggaactattggaatttccccttctgctaatttaaatccggaaaggaatttcccttctttgttcgaacctgtgcatggctctgcaccagatatttatggcaaaaatattgctaacccgattgctatgatctgggcgggagccatgatgttacagtttttgggggagggtgagcagcgctatcaggatgctcatgatgatattttagcggcgattgaagcggtaattgtgcaaggcattgtaaccccggatatgaaaggaaaggcatcaacacagcaggtgggagaagccatcgttaatcatttg

SEQ ID NO: 24052 - DNA, 1884 bp, Xenorhabdus nematophilus
ctgcgtaacagtgaattaatgacactggttctgggggcattgcaggcaggtgcagccgttaaaggtgaatttgaaaaacgcttcaaaggcattatggctgaagttattcagtcaccaaaacctatcatcctgtttatcgatgaagctcatacgctgattggtgccggtaatcaggctggcgggctggatatttccaacctgctgaaacctgcactggctcgtggcgaactgaaaaccatcgctgcgaccacatggagtgagtacaaaaaatacttcgaaaaagatgcggctctttcccgtcgtttccagttggtcaaagtttctgaaccgagcgcagaagaagcaactgtcatcatgcgtggcctgcgagctatttatgagcaggcacacggtgtcctgattgatgatgaagcactgaaagcctcggcggtactgagtgaccgttatctctccggccgtcagctaccggataaagccatcgacgtactggataccgcctgcgcccgcgtagccattaatctgacatcgccaccgcgccagatctcctcactgacaaccgaactgcatcagatgcagatggaaatcgatgtgctggaaagagagcagcggatggggctgaacgagcattcagaacgtctggaagaactgcaaaaccagcagcaggaaacgcaggagcaactgactgctctggaaagcgactggcaacagcagcaggaactggtgaagcaggtaatcgaactgcgcagccagcttctgtctgatgataaagaagccagccaggatgccgatagagaaaaacaggctgcggatgaagtttctgacaactcagaacatgatgcgactgagcaagaagaagtacaggaagaaacggtcactgaaccggctgatgtgaaatctctgattgaaaaactggctgaactcaatgagcagctggcagaacttcagaaaaaacaaacgctggtttccccacatgtcgataaaactcagattgccggtgttatcgctgaatggacgggggttccgctgaaccgcctgtcacagagcgagctgtcaattgtgactgagttgcctgttcatctggggcagaacatcaaaggtcaggatgttgccattcagtgcctgcataaacatctgttgactgcccgcgctgatttgcgccgtccgggacgccctctgggtgccttcctgttggtagggccaagtggtgtcggtaaaaccgaaactgtactgcaaatttccgaactgatgtttggtggccgccagtacctcaccaccatcaatatgtctgagtttcaggagaaacacacggtttcacgcctgatcggttctcctccgggttatgtgggttatggcgaaggtggtgtactgaccgaagcgattcgtcagaaaccttactccgtcgttctgctggatgaagtggaaaaagcgcatccggacgtactgaacctgttctatcaggcctttgataaaggtgaactggcagatggtgaagggcgcattatcgactgtaaaaatgtcgtgttcttcctgacctccaatctgggttaccagaccattgtcgattatgccgagcagcctgagcagatcaacgatcagctttacccggaactggccgctttcttcaaaccggcattgctggcacgtatggaagtgatcccttatctgccactgggccatgaaacactgaaaaccatcattcagggcaaactggcccgactggataaactgctgactcagcgtttcaacgccgaagtcactatcagcgatgacgtatcagaagagatcctgctgcgcgctacccgcgctgaaaacggtgcccgtatgctggagtcgattattgatggcgcgctgttaccgccggtttcattactgctgttgcagaaa

SEQ ID NO: 24053 - DNA, 1230 bp, Xenorhabdus nematophilus
aacaatcaggaaagaaaaatcatgacccatgcatttatttgtgacggagtgcgtacacctattggccgttatggtggagccctcgccagcctgcgctctgatgatctggccgctctgccgctacgggcattgctggcacgttatcccggactggactggcaagcgattgatgatgtcattctcggttgtgcaaatcaggcgggtgaagataaccgcaatgtcgctcgcatggcgacattgctggctggtctgccatattccgttcccggcacaactctcaaccggttgtgtggctcaggtctggatgcgctggcttttgctgcccgcagtatcaaagcgggtgaaactcagctggtactggctggtggtgtggaatccatgacccgcgccccattagtgatgggaaaagcggaaacggctttcagccgtcaggcgcagatatttgataccaccattggctggcgcttcattaatccgctgatacagaaacaattcggtacagattcgatgccggaaaccgcagaaaacgttgcggctctatttgatatcagccgggacgctcaggatgctttcgcgctgcgcagccagcaacgtaccgctaaagcgcagcaacaaggcattctggctgaagagatcatccctgttaccctgcctgaccgccggaaaaaaggggaaaacacgatcatttcacaggatgaacatccccgccctgaaacgacattagagcagttacaaaagctgaaaacaccatttcggaccgaaggcaccgtcactgccggtaatgcttccggcgtcaatgacggagccgccgccctgattatcgcttcagaagtcgcagcattaaaacacgggctgacacctaaagcgcgtattgtggcaaccgccaccagcggtgttgagccacgcattatggggatcgggccactgtcagctacgagcaaagtgttagctcttaccggactgagtctgaatcagatggatgtgatcgaactgaacgaagccttcgcagctcagtcactggcagtgatgcgccagtggggattaccggatgatgcagaacatgtgaacccgaatggcggtgcgatagcactggggcatccgctgggaatgagtggtgcccgacttgcactgacagcaacgcttgaactggaacggcgagccggacgctatgccttatgcaccatgtgcatcggcgttggtcagggaattgccatgattattgaacgtatt

SEQ ID NO: 24054 - DNA, 1527 bp, Xenorhabdus nematophilus
atcgctgttattggcgcgggaacgatgggtatcggcattgctcaggttgcagcactagcaggacattccgtcctgctatttgatgcaaatgttgaagccgcacaacgtgcgctggatacactccacacccgcctgcatcagcgtgtcacagcaggtaaagccgatgcagacaaaactcaggcgctgttgcaacgcatcactctggttaactcattacaggcattggctccctgtatactggtgattgaagcgattatcgaacaactggaagccaaacaaaaattattccaccagctggaatctctgtgttcagaacaaaccatttttgccagtaatacctcatcactgtcgattacagctattgcccgtgttctgagtaaaccccaacgcatggccgggctgcattttttcaaccctgctccgctaatgaaactagtggaggtcgtgcaaggtctggaaacctgcccacaaatcatcgcaacgcttaaatgcctcatgatcaactggcaaaaacagcccgtcatttgccgctctacacccggttttatcgtcaaccgcattgcgcggcctttttacgcagaagccctgcgcgcactggaggagcaagttgcatctccggcgacactggatgccgtcctaaaggatgccggcggctttgctatggggccattacagctgactgatttaatcgggcatgacgtcaattacgccgttactgaatccctgtttcacgctttctacggagatcctcgctttcagccatcattacgacaaaaagaactggtggaagccaatcatctggggcgcaaaagtggccgggggttttatgtctattccgacaccaataatgcagaaaaaaatagtgtagataaaaaaccgcaattatttcctgagattgaagaaaaacaagccgcagagccaatcacatcagcacaaataaatgcgaacggagactggtctaccctgccgcattttgccgctttattacaagataagttgcaggaaaacggggtattctgcggagaaaaatgcaatatcccattaccttcacctgcattacagattgatgatgttctctttatgctggcaaccggcaaaaccagctcccagctggctgatgaaattcaggctccggtcgtgcagtttgatctgtcagccaaccatcatgctgctccgataatcacaataagcgcagccagccagaacactcaacaacaaacggcaaaagtcgcccgttttctccatttcctcggcaaacaggtcattttactgccggattatccggccatgctgacgatgcggactgtagcaatgctgtgcaacgaagcgctggatgcgcttaataaaggcattgccagcgccgaagatatcgatctggcaatgtgccgcggtgtgaattatcccatcgggccactggcatggggaactcagctcggctggcagcatattttcaatacactggaaaacttacagcagttttacggggaaacccgttatcgtccgtcacccctgcttcggcagctggcg

SEQ ID NO: 24055 - DNA, 2061 bp, Xenorhabdus nematophilus
atgcaacaattgaccagttatatttgtggtgagtgggtttatggaaacggtaacgccagaactattcaccatgcagtaagtggtgcagcgctgtatcaggtctgttcagatgatctgccactggctgatagccttaaatatgccagagaaaaaggtggaaaagcactctcagccatgacattccagcaacgtgcccagatgatgaaagccgttgcaaagcatctgcttgccaataaagaagctttatatgctatctcggcagaaaccggagcgacccgctcggatggctgggtagatattgaagggggcattgcaacgttattttcctatgcgggtctggcaggacgcgagttaccggatgatgtgttgtggccggaagatgagatgatcccactttccaaacagtcccagtttgtcgctcgtcatgttctgacttcccgttccggtgtggctctgcacattaatgcatttaacttcccttgctgggggatgctggaaaaactggcaccgacctggatggcgggcatgccggccattattaaacccgctaccgcttcagcacagttaacacaggcaatggtgaaactgatcctcgacagtggtttggttccggaaggcgcattgcagttgatctgtggcggaattggcgatctgtttgatcatctcgactatcaggatgcggtaacttttaccggctcagcccagaccggacataaattgaagtcccaccctcgtctgattgaaaaatccattccgtttacgatggaagctgactctctcaactgttgtattctgggggaggatgtgacgccagacatgccggaatttggcgtatttattaaggaagttgtccgtgaaatgaccgtgaaggcagggcaaaagtgtactgctatccggcgtattattgtaccggaaagccagcttgagtcggttaagcaggcgttggtgaaacgtttgtccggtgttgtggtgggcgatccggctttgcctgatgtccgtatggggtcattgatcagccttgaacagcgcgatgaagttcagtccaaagtggatttactgctacaaagtggttgtgaattactgcatggtggctctttagctaaactgcaactggcggataagacgaatagtcatggggcattctacccgccaactctgctttattgcgcagacccgatgaccaatcaggctgtacatgaaacagaagctttcggtccggtttccaccttgatggcatatcaggagactgagcaggcgattgagctggctttaatggggcagggcagtctggtgggttcgctggtcacggcagatgagcagattgcgatgcaggtcatccgtgcaacagcctgtgctcatggccgtatgctgattctggatgaagcggcttctgccgaatcaaccgggcatggttctccgttacccatgctggtacatggcgggccgggacgcgccggtggtggtgaggagcttggcggattacgtgctgtgaaacactatatgcagcgcacggcaattcaggccagcccaagtatgctggcagcaattggccgtgagtgggtacgtggcgcaaaagtgaaggaagatcctgtccacccgttccgtaaatatttcgaacaaattgaaatcggggaaagtctgctaaccgcccgccggacagtgacggaagcagatatcgtcaattttgcctgcctgagtggtgatcatttctatgctcatatggataaaattggcgcggctgaatccctgttcggtgagcgtgtagcacatggctattttgttgtttctgccgccgccggcttattcgtcgatgcatccgttgggccggtactggcgaattatggcatggaaaacctgcgctttattgaaccggtgaagattggcgatacgattcaggttcggctgacctgtaagaagaagatcaagaaagtgcagaaaacgccggatgataaaccacatggtgtcgttatgtgggatgtgcaggttttaaatcaggagcaacagcctgtcgcgctttacagcattctcacgctggtggaacggcaattgagggattatgtt

SEQ ID NO: 24056 - DNA, 852 bp, Xenorhabdus nematophilus
gtgctggataatattaaaatcagactacaatatttactgccaaagcaatgtattactcacttagcaggctggttcgccaataaaaaagcaggctggttgacacagcttgtcattaaggcttttgccaaagtttataaagttgatatgaatgaagcccagaatccatcttttcaggcttattcaacctttaacgaattctttgtccgaccattaaaagaggacattcgtcccgtcgtcaatgaaacacacctgttggcactgcccgcagatggagccgtcagccaattgggtgccatccgggaagagcagattattcaggctaaaggtcactactatacggtagaagcactgttggccggccaacatcaacttgctgagcagttccgtaatggccattttgtgacaatttacttatcaccgaaagattatcaccgtgttcatatgccatgtgacggcgtattgaaagagatgatttatgttcccggcgatctgttttcagtcaacccgctgactgccgccaatgtaccgaatttgtttgcacgtaatgaacgtgttatctgtatatttgatacagcctttggcccaatggcacaaattctggttggtgccacaattgtgggtagtatagaaactgtctggagtggctgtgttaccccaccacgcgaagggattatcaaacgctgggtctatccggcagaaggcgaggaaggggcggtttctctcaagaaaggagaagaaatgggccgtttcaaactgggttcaaccgtaatcaatctgtttgcccctaatcagattcagtttgccaataacttatacagtggttcacaaaccctgatgggtggcctgctggca

SEQ ID NO: 24057 - DNA, 975 bp, Xenorhabdus nematophilus
aaagcaagctggttaaaccgtgagcctcagttttctgcttttacaaatggattattgctggatttttggaatatcagagatgaacgtgaattcatgggtgttgataatatccctatccgttatgtctctttcagttcacctcatcatgataaaacattggtgatatctccggggcgtagcgaaagctatgtgaaatacccggaggtagcctatgatttttaccatctgggttacaacatccttattattgatcatcgcggtcaggggcgttctggcagaatgctgacagatcctcagaaagggcatgttgaatcgtttgatcactatgtagatgatctggcaaaactcattgaactggaaatttcttcacttaagtcgcatcgctgttatgcactggctcattcaatgggaggggcaatcctgagctctttgctgttacgtcatgcgtcggtattccgtgctgcggctttatgtgctcctatgtttggtattaatttgccaatgcctcgctgggcggcaaactttttggttaatcaggctgaaccttatcctggaaggcgtaacagatatgcggtcttaaccgggcaatggcgtccattaccctattttatcaacctgttaactcatagctatgctcgttaccagcgatacttacgctattatgtagattatcctgaattgcgcctgggtggcccgacttatcgttggatgcgtgaaagtatgcgggctggagatagcctcgttgagaaggctggcgaaattcagacaccactcatcgtcttaaaagcaagcgaagataaagtagttagcaatcgggagttgttggctttttgtgcatctcgtcaaaaagccggagcaggaaaagaagaatataatcctctggttatccaaggggcacgccatgaaatcctgttcgaaaaagatgcattgagagcacaggctcttaatgcgatttgtgatttttttgaccaaaat

SEQ ID NO: 24058 - DNA, 846 bp, Xenorhabdus nematophilus
tggaaaatactggttattacctgtttattatcaacattagcttatggctcagataaacaggctgacgcagttagaggcagtgtaatttcggcaatgctgcaagaatatgattcgccttttatgctctatccttatgatacaaattatattctttacacttacagctcccgggtaaataaacaggcaattagcagttatgattgggttgatcatgcccgtaaagatgaagttcactttcaggtcagttttggttttccaatatggcgaggtattgttggtgaaaattcattgctgggggcttcttatacacagcgttcatggtggcagctcagtaataaaagagaatcttctccatttcgtgagactaattatgaaccgcagttatttctggcatggctgactgattatgaacttgccggctggcacctgcgggaaattgaagcgggtattaatcaccagtctaatggtcgtccggaatccacttcccgtagctggaaccgggtttatgcacggctgatggcacaaaaaggaaactggcaggtagatttgaaaccgtggtatcgcctgactgaaagtaacaggcgggatgataacccggatatgaaccgttatatggggtattatcgcctgaaagtcggctatcactatggtgaaaatgtatttaccatgcaggggcgttataactggaacagtggttatagtggcggagagctgggctggagttatcctctatctaaacatgtccgtttttacgcacaactcttcagcggatatggcgagtcaatgattgattacaatttcagacagacccgattcggtatcggtgttatgctgaatgatatgctg

SEQ ID NO: 24059 - DNA, 1920 bp, Xenorhabdus nematophilus
ctgtgttatgtagactggccgccacgattaatgaggcaccattacatgaccactgagactgaaatctcttttgctgatttagggttatcagcacctattctttctgcgttgcaagacatgggctatgagaagccttctccaattcaacagcaatgcattcctcacctattaaatggtcgtgacgtgctgggtatggcacagactggtagtggtaaaactgcggcatttagcttacctctactacataatattgatgctgagcttagagctccacagatccttgtgttagcaccgacccgtgaactggcggtacaggttgctgaagcatgttcagatttttctaaacacatgcgcagtgtgaatgttgtcgcactttatggtggacagcgttatgacgttcagctgcgtgctttgcgtcaggggccacaagttgttgtaggtacaccgggtcgtctgctggatcacctgaagcgtggtacgctggatctgtccaacctgaaaggtctggtactggacgaagctgacgaaatgctgcgtatgggctttatcgaagatgttgaaaacatcatgagccagatcccggcggaacatcagactgctctgttctcagcaactatgcctgaagcgattcgtcgtattactcgtcgtttcatgaaggagccacaggaagttcgtatccagtccagcgtaaccaaccgtccggatatcagccagagctactggtctgtttacggtggtgtacgtaaaaacgaagcactggtacgtttccttgaagcagaagattttgatgcggcgattattttcgtacgtaccaagaatgcaacgctggaagtggcagaaacccttgagcgtaacggttataactctgcggcactgaacggtgacatgaatcaggctctgcgtgagcagactctggagcgtctgaagaatggtcgtctggatattctgatcgcgactgacgttgctgctcgtggtttggatgttgaccgtattagcctggttgttaactacgacatcccaatggatgcggagtcttatgtacaccgtatcggtcgtacaggccgtgctggccgtgcaggtcgcgcgctgctgtttgttgaaaaccgcgaacgtcgtctgctgcgtaacattgaacgcacaatgaagctgacaatcccagaagtagaactgccgaatgcagaactgctgagccagcgccgtctggagaaatttgcaggtaacgttcagcaacaactggaaagcagcgatctggatcaataccgcgctctgctgtctaagctgggtaccggtgaagaactggatatggaaacactggcagcagcactgctgaaaatggcacagggtgaacgcccactgatcctgccaccagatcctgtccgtcgtcctcgtcgtgaattcaatgatcgtgatgaccgtcgtcgtaatggtaatagcttcggtgagcgtgatcgtggcgacagaggtgacagaggcgaccgtggtgatcgtcctcgtcgtgagcgtcgtgatgttggcgatatggaactgtaccgtattgaagtgggccgtgatgatggtgttgaagttcgccacattgttggtgcgattgctaacgaaggtgatatcagcagccgttacatcggtaacatcaaactgttcgcaactcactctaccattgagctgccaaaaggaatgccgggagacctgctgtcacacttcactcgtacccgtatcctgaacaagccactgaatatgcagctgctaggtgatgcacaaccatttgaacgtcgtgaacgtcgtgagcgtcgtggtggtggtcgtaatggcggtaatggtggcaacggcggtaacggtgcacgtcgtgatcgtgacggttttagcaacggcaacggtggtggtcgtcgctttaataacaatgaacgtcgtggtggcggtgagcgc

SEQ ID NO: 24060 - DNA, 2331 bp, Xenorhabdus nematophilus
atgaatcctgagcgttccgaacgcatagaaatccctgtattgcctttgcgcgatgtagtggtttacccacatatggtgatccctctgtttgttgggcgagagaagtcgattcattgtctggaagcagcaatggatcatgacaaacaggtcatgttggtagcgcagaaagaagcatccactgatgaaccgggagtcaatgatctattctcggtaggcacagtggcttctgttctacagatgctgaaattaccagatggcacagtgaaggttctggttgaaggcttgcagcgtgcccgcattacaacactgacagataacggtgaatacttttatgcgcaggttgaatatcaggactccccgatcgttgatgagcgcgagcaggaagttttggtaagaaccgcgattaatcagtttgaaggctatatcaaactgaataaaaaaatcccgccggaagtgctgacatcactacacagtattgaagatgccgcaaaactggctgataccattgctgctcacatgccgttaaaaatcaatgacaaacaggctgttttagaaatgtctgatgttgttgagcgcattgaatatctgattgcaatgatggaatcagaaatcgatctgctacaggtagaaaaacgaattcgtaatcgcgttaaaaaacagatggaaaaaagccagcgcgaatactacttgaatgagcaaatgaaggcgattcagaaagaattaggtgagatggatgatgcacctgacgaatatgagacgctgaaacgtaagatcgaaaatgccaagatgcctaaagaggcacgggaaaaagcagaagctgagctgcaaaaattaaaaatgatgtccccaatgtcagcggaagcgacggttgtacgtagctacattgactggatagtgcaggttccgtggaacgcacgcagcaaagtgaaaaaagatttggtgaaagcccaggaaatactggacaccgatcattacggtctggaacgagttaaagatcgtatccttgagtatctggcggtacaaagtcgtgtcagtaaaatcaaggggccaatactatgtctggttgggcctccgggtgtgggtaaaacctcactggggcgttctattgctcgtgcaactggccgtaaatacgtccgcatggcactgggtggagtacgtgatgaagctgaaatacgtggacatcgccgtacttacatcggctcaatgccgggtaagttaatccagaaaatgtctaaaatcggggttaaaaacccactgttcctgttagatgaaattgacaaaatgtcgtctgatatgcgcggtgatccagcatcggctttgctggaagtacttgatcctgaacagaacgtgacattcaacgatcattatcttgaagtggattatgatctgtctgatgtgatgtttgtggcgacatccaattccatgaatattccggcacctttgctggatcgtatggaagtgatccgcttgtcaggttacaccgaagacgaaaaactgaatattgccaagcgtcatttgttacctaaacagattgaacgcaatgcattgaaaaaaggtgaactgaccatcgatgatggtgcgattctcggcattatccgttattacacccgtgaagccggtgtacgtagtctggaacgtgaaatttccaaactgtgtcgtaaggcggttaaagcattgttgatggataaagcgcttaagcatatcgagatcaatgctgaaaacctgaaaaattatctgggtgttcagaaagtggattatggtcgtgctgacactgaaaaccgtgttggtcaggtaaccgggcttgcatggactgaagttggtggtgatctactgaccgtggaaacagccagtgttccgggtaaaggtaaattgacttacactggttcgttgggtgaagttatgcaggaatccattcaggctgcattgacagtagtccgggctcgcgcggataagctgggcatcagttctgatttccacgaaaagcgcgatattcatgttcatgtccctgagggcgcaacacctaaagatggcccgagtgcaggtatcgcaatgtgtacagcgttggtttcctgcctgactggtaatccggttaatgccaatgtggcgatgactggtgaaattactctgcgtgggctcgttctgcctattggtggtttgaaagaaaaattgctggcagctcatcgtggcggaattaaaacggtcatcatccctgatgagaataaacgcgatttggaagaaatccctcagaacgtaattcaggatttggaaatccaccctgttaagcgtatagaagatgttttgactattgctttgcaggagcctgcatttggt

SEQ ID NO: 24061 - DNA, 3247 bp, Xenorhabdus nematophilus
cgtttggctgttaagctgcgtagtgatttttaccagagattgagccgtcaggatcctgaattttatttacgtcacagaacgggggatttaattgcccggtcaacaaatgacgttgatagagttgtttttgccgcaggtgagggagtacttacttttgttgatgccttagtcatgggatgcgctgtacttattgtgatgagcgtagagataagctggcaattaaccctattatcattgttacctatgcctattatggcattagtaattaaacggtacggtcaacagcttcaccatcgttttaaattagcccaaggtgctttttctgcactgaataaccatgctcaggaaagtttaaccagtattcgcatgatcaaagcttttggattggaagacctacaatccagtcagtttgaagaagtcgccaccgaagctggccgcaaaaatatgcgtgttgcacgggtggatgctcgttttgatcccactatctttattgccatcggtttttctaacttactggcagtcggtggaggaagctggatggtagtaaatggttctctgacactgggggagctgacaagctttgtcatgtacttagggttgatgatttggcctatgttagcgctggcatggatgttcaacattgttgagcgtggtagtgcggcatatacgcgtattctcagtctgttacaggaacctttggtgatcgaagacggttcacactccttatctgcggagcgtggcgcattaactgcggatatcaacacctttatttatcccggttatagtgaacctgttttgcagaatatctattttcagttattgccggggcagttattaggtatttgtgggccgactgggtcaggtaaaagtacattactcgctgtattgcaacgtcagtttgatattactgatggtgaaattctattccagtcacaaaatgtttctacattgaggatggatgaatggcgctcacgactggctgttgtgaaccagacaccttttttgttttcagatacggttgcagggaatattgctttagggcgtccagatgctactcaagaacaaattgaggaagttgcccgtttagcaaatgttcatgatgatattctgcggttaccacaaggttatcaaacagaagtcggagaacggggtgtgatgctttctggcggtcaaaagcaacgtatttctatcgcaagagcacttctattagatgcagaaattttgattttggatgatgccctttctgctgtagatggtcagactgagcatcagatcatgaaaaacctcagtcaatggcggcagcagcgaactgttattatcagtgcgcatcgattatctgctttagtagaagctgataatgttctggttatgcaaaatggtatgatttctcaacaggggcagcataaacagctcattgcacaatctggttggtattcagaaatgtatcaataccaacaacttgaagctgcattggatggtgaatatgagtaacactggtatggaaaagcctaatacacgcaaactctggccgtctttaaagcgcctgctgtcttacagtaaaaatcatcgcaagcccattgttctggctgtaattatgttatgggtagctgctctggcagaagtcagtggtccaatgctcatcagttattttatcgataatatggtttcaaccggccacatcccgcttggtattgccagtggccttgcggttgtatttttgatattacaggtggtagctgctgcgttacattatttccaatctctactgtttaatcaggcatcagtaggagtcgtgcagcaaattcgaacagatgttatggattcagctctgcgtcagccgctgagtacttttgataaccaacctgtcgggcagttaatttcccgtgtgacaaatgatacggaagttatcaaagatctgtttgtgaatgtcattcctacggtttttcgtagcgttgcactgattggcgcaatgctaatggcaatgttctttttagattggcgtatggcgagtgttgcgctgactattttccctgctgtttttcttgtcatgatactttatcagcgtttcagtacgcctattattcgtcaggtaagagaatacctcgctgacatcaataatgtttttaatgaagccattaatggtatgacagttatccagcagtttcgtcagcaggcgcgctttggtgagaaattgtttgctactaaccgggctcactatcaggcgcgaatgcaagcattgcgcttggatggcgttctgttaaggcctttgttaagcctgttttctgctgcagtattgtgtggtttattactgttgtttggttttcagggaacagactttattggagtaggggtattgtatgcatttatcagttaccttggacgcttgaatgagccactgattgagctgacagctcagcagtcgttattacagcaggcggtggtttcaggtgaacgcgtttttgaattaatggatagccctcagcagcagtatggtgttgataaacagattctagagagtggcagaattgatgttgaaaatttaagctttgcttatcgtaatgacaaagttgtattagataatatcaatctgcatgtaccatcacggggttttattgctttagttgggcatactggcagtggtaaaagtacactggctaatttgctgatggggtattacccatggcaaagcggtgaaatttatcttgatgggcggtcggtatcttcgctttcccataccaccttgcgcaatggtgtggcaatggttcagcaggatcctgttattctggctacctcatttttcgataatatcacgttaggacgagatatttgtgaggaaaaagtctggcaggtactggaagtggtgcaactggcggagtttgtacgcaaattaccggaaggtatttattcaagactgggagagcagggaaatacgctttctgccgggcaaaagcaacttttagcaatggctcgggtcttggtgcaaacaccacaaattctgattctggatgaagcgacagcaaatattgattcaggaacagaacaatccgttcaacaggcattacggatgatccgcaaacagacaaccttggtagttatagcgcatcgtctttcaacgattgttgaggctgattccatatttgtgctgcatcgtggtgcaattgtagagcaggggcagcatcaacagctactggaaaggcgtggccgttattaccagatgtatcagctccagcaagtaggcgaaacatta

SEQ ID NO: 24062 - DNA, 1095 bp, Xenorhabdus nematophilus
atgctgaaagttatccagtctccatccaaatatatccaagggccagatgcgatatcctacattggtcactatacgaaaatacttgctgaccacgtttttgttattgctgataattttgtactcaatcttatcggggatacagtcagtaaaagcctgaaagaaaatgaagtcaccagccattttgaagtcttcaacggcgagtgcagccgtaaagaaatagaacgcctgtcagccatcctactcactaatcaatgtcaggccgtaattggaattggtggaggaaaaacgcttgataccgcaaaagctgtagcacacgaatcaaaattacccattcttgtttccccgactctggcctcaacggatgcaccaaccagtgcactttccgttctgtatacagaattgggggaatttgatagctacctgttctaccctaaaaatcccgatattgtgttagtggacacgaaaattattgcaaaatcacctgtccggctgtttgttgctggtatgggagatgcactggctacctactttgaggcaagggccagcagtacagctcataatccgactatggcaggaggaacaacttctctgaccgggctggcactggctaaattgtgttacgacacattattgtcagaaggttataaagcaaaactggcggtagaagccggagtgacaacgcctgcggttgaaaatattgttgaagcaaatacctatctcagcggaattggttttgaaagcgcggggcttgccgctgcacacgccatccataatgggtttaccattctggaagagtgtcaccacctgtatcatggtgaaaaagtcgcatttggtacactgacacaactcatattagaaaatagccccagtgaagaactagaaaccgtactcgacttttgtgtacaagtcggccttccaattacgctggaacagcttggcctgcgcgatagtgaaaatttgcatcagaaaattatgcaggtcgctaaagtaagctgtgcagaaggggaaactattcacaatatgccatttaccgtcactccggagcaggtctatgctgcaattctggcagcagatcagatgggaaaagactggtta

SEQ ID NO: 24063 - DNA, 1279 bp, Xenorhabdus nematophilus
atgaaatttgatgctgtcattattggaagcgggctggcgggactgactagtggtattcggctggcagaagcaggtaaatcctgtgcgatagtcagttcaggccaaagttctctttatttctcttctggttcgatggattttctttcccgtctacctgacggaggtgaagtcacccatcccttacatgccttgtctgaactgaccagacaggctccgcatcacccttacagtcggataggcgaaaaaaacgtagtatcactggcttatcaggctgaaaaattaatcagggacagcgggctggttatgaccggttctgcttcacaaaaccattatcgtgttacgcccgttggccgtcagcgcatgacttggttaagcccggcgcgagtaccggtttgtgagctggaacggccatttaaatgggaaagtgttgttgtgatcggcattgcgggatttctggattttcagcccggcattgtcgccagtgcattacagaggcagggggtgaaagccagtgcgcaggagattcacttaccttttctcgacagactgcgtgataaccccagtgaatttcgctccgttaatatcggcccatttactggatctgcctcaaaacctgacactgatagcggaggaaatcagccgtctggcgcagggatatgaggctgtgttcctgcctgcctgtattggtctggaaactgatcaagttgtacaggcattgcagatacaggtgaaaaagcctgtctatttgttaccgacgttaccgccttctctgttggggatccgggtggatcagttgttgcgtgctcggttccgccattttggcggagtgataatgacaggtgatacggtcaacggtgtggaaatggcagataaccatattactggtttgtatacccgtaatcatggtgatatcccactgcgggcttctcacgtgattctagcaaccggtagttttttcagtaatgggctgaaagccaaattgaaccggatttatgaacccttacttgatttagatctgctggcgtactcctcacgtgaacaatggacgcggcaaaacgtttttgctcctcagccttatcttaaatttggtgtcaccacggatgaatatttacggccattaaaatcaggtcaggttgtgaagaatctgtatgccgccggtgctgtgctggggggatatgatccattgtttgaaggctgtggttccggagtttctttattgagtgccttatttgttgctgaacaaatcatcaccgggcaacgagtcacaaaacagcggata

SEQ ID NO: 24064 - DNA, 1671 bp, Xenorhabdus nematophilus
actgatgtcattattattggtgggggcgcaacaggtgctggtatcgcaagagattgtgcccgcaggcgcttacgctgcatcttactagagcggcatgatattgcgacaggtgcaaccggacgcaatcatggtttattgcatagcggtgcacgctatgccgtcacagacagcgaatcggcaaaagagtgtataaaagaaaacagggtcctcaaatccattgcccgacattgcattgaaaaaacacacggtttgtttattaccttgccggaagattcactggaatatcagcaaacttttattgctgcgtgtgaaaaggcaggaattgatgcgcagtcgattgaccctgaagaagcgaaacgttttgagccggcggttaatccggatttgatcggcgctgtgattgtgcctgatgggacggttgatcctttccggctgacggcagccaatatgctggatgccagagagcatggagcacaaatactaacgtatcatgaagtcatggggttaatcaggcaagaggataaaattaccggcgttcatgtttatgatcatcgcactaagcgcctgtatgacatttatgcgccgatcgtggtgaatgctggtggaatttgggggcagaaaattgcggagtatgcggatctccgagtccatatgttgccggccaaaggatcgttgctgatcttagggcatcgcattaacaatatggtgatcaaccgctgtcgtaaacccgcagatgccgatattctcgtacccggtgacactatctcgctgatcggcacgacttcttcccgcattgaatacgatcagattgataacatgtctgtgactaaggaagaggtcgatatcttaatccgggagggagcaaaattatccccccggcttgcgcaaacccgtatcttacgggcttatgcgggagtccgccctttagtcgcgagtgatgatgatccatcgggcagaaacgtcagccgtggtattgtgctgcttgatcatgcccaacgtgatggtctggacggattcataaccattactggcggtaaactgatgacatatcgcctgatggctgaatgggcaaccgataagatttgcgagaaacttaatattaccgcgcattgtacgactgcacaggagccattgcccggctcagagaattccgccgaacaaacacgccagcacacgtcacacagtaaaagcccacatagtaaaaaaccgcattgtagcaccgtaactctctccgctcccattcgtgggtcggccatttatcgtcatggagatcgcgccagccagttactgagtaccgaacgatcagataaaagtttggtatgtgaatgtgaagcggtaactgcgggagaagtacgttatgcaacggaatctttggcggtgactaacctactggacttgcgtcgccgcactcgtgttggcatgggaacctgtcagggagaattgtgtgcctgtcgtgcggcagggctacttaatcgtctcggtgtaatcacagaacaggaatcagagcagcaactgaaacagttcctgaatgaacgctggaaagggatccgtcctgtcgtctggggtgatgcgttacgggaaagcgagttcaccagctgggtttatcagggactgtgcggtttagatgatcatgatactgacgccgataaccagccagtaacggagactgac

SEQ ID NO: 24065 - DNA, 1791 bp, Xenorhabdus nematophilus
gtgcaaaccttcaatgctgatctagcaattatcggagccggtggcgcaggtctacgggccgccattgctgcggctgaagccaatccccaactcaagattgccctgatttcgaaagtgtaccctatgcgcagccacaccgtcgccgcagaaggtggatcagccgcagtcactcagtctcatgattcctatgactttcatttcaatgacacagtatccggcggagactggttgtgtgagcaggatgtggttgaatattttgtcaaacactgtccgactgacatgacccagcttgagcaatggggttgcccgtggagccgcaaagaagatggctccgtgaatgtgcgtcgtttcggtggcatgaaaattgagcgcacgtggtttgccgcggataagaccggcttccatatgctgcatacattgttccagacctcactcaagtatccgcaaattcagcgtttcgatgagcattttgtcctcgatattctggttgatgaaggccgtgcccgtggcctggttgccctgaatatgatggaaggcagtaaagttcagattcgcgcaaatgcagtcattatggctaccggcggtgcaggccgtgtttatcgttacaacacgaatggcggcattgtcaccggtgatggcatgggtatggctttccggcatggtgttccactgcgcgatatggagtttgtgcaatatcacccaaccggcctgccgggttccggcattctgatgactgaaggttgtcggggtgaaggcgggattctggtgaataaagatggctatcgctatctacaggattatggcttagggcctgaaacaccactcggccatcctgaaaataaatatatggagctgggaccacgcgataaagtttcgcaggcattctggcatgaatggcgggcaggacgaactattgcaacgccgcgcggtgacgttgtacatctggatctgcgtcatctgggtgagaagaaattactggagcgtctaccattcatctgtgaactggcgaaagcctacgttggcgttgatccggtcaaggagcctatccctgttcgtccgacagcgcattacactatgggcggaatcgaaaccaatcaacaatgtgagacccgtatcaaagggctgtttgctattggtgaatgttcttctgtcggcctgcatggcgcaaaccgtcttggctctaactcactggcagaacttgtcgtctttggtcgtctggcgggtgaggaagcggccaagtgtgctcaggaagctcctcccgccaatgaaaatgcactggctgcacaggttcacggtattgaggctaaactcaataaactgctgaatcagcagggcggagaaagctgggccaaaatccgcgatgagctgggaacggcaatggaagaaggttgtggtatttatcgcacccctgaattgatgcaaaaaacgattgataagatcgtagagctgaaagagcgcttcaaacagatccaaatcagtgatcgctccagtgtattcaatactgaccttctctataccatagagctgggattcgggctggatgtggcagaatgtatggctcactccgcgatgaaccgcaaagaatcccgcggtgcccaccagcgtcttgatgaaggctgtaccgaacgtgatgatgagaacttcctgaaacatacactggctttctacaacccggaaggtgcgccacatctggaatacagtgatgtgaagatcactaaatcccagccagcaaaacgggtttatggtggtgaagccgcggcacaagagaaaaaacagaaggagcaggcgaat

SEQ ID NO: 24066 - DNA, 726 bp, Xenorhabdus nematophilus
gagatgaaaaacctgaaaatggaagtcatgcgctataacccggaaaccgatgatgcgccttatttcacaacatacgatgtcccttatgatgaccagacttcgctgttggatgcgttaggctatattaaggataatctggctcctgacctgtcttatcgctggtcctgccgcatggcaatctgcggctcctgcggcatgatggtcaaccgcgtacccaaactggcctgtaagacttttctgcgcgactatcagcacggactgaaagtggaagccttagggaatttcccgatagagcgggatttggttgtggatatgactcactttatcgaaagtctggaagccatcaagccctacattatcggtaatgaccgtaaaccctccgatggcccgaatgtgcaaactccggcacaaatggcgaagtatcatcaattctccggttgtatcaactgtggcctatgctacgcagcctgccctcagttcggcctgaatcctgagtttatcggccctgctgccgtcacgctggcacatcgctataaccttgataaccgtgatcatggtaagaaagagcgtatgccacaaatcaacagcgataatggtgtctggtcctgtacttttgtcggttattgttctgaagtttgcccgaaacatgtcgatccggcaggcgcaattcagcaaagcaaggcagaaagtgcaaaagatttcattatctccatgctgaaaccacaa

SEQ ID NO: 24067 - DNA, 1620 bp, Xenorhabdus nematophilus
aaacaaccggcttaccggattttgttctcacttttaaatcgttcacgttggatcctgcttattgccattttagccagtatcgttaatggtatttccaacgttttcctcatcacgttggttaacagaatagtcaccacgtctggcaatagttatcacttactcgccgtatatttctgtattattgcggtgctggctattgtcagtcatgtaatgagcggggtgattttcgccagactcagccagaataccatcgcaaggatgcgtgagtttatctctgagcgtattacccgtgctccttttcgccagatagaaatactgggcgcttcccgtgcccagtctatcatcaccgatgatacaaccaatgtttcactgttgtttttcaccctacccaatatcgtgacgcagagttccattatactgggttgcctgatctatctggcttggctgtcatggtcagtgttttttcttgtgttaacggtgatagtgattggctcacttggttatgctatcggtggaaccagcgcgctcgcatcactaaaagcagcaggtaagtcacaagatcgcctgttcaatcatttcaacgccttatttaccggagcgaaagagctaaagttacatttttcacgcgctcaggctttcttcacccattcacttggtcgtgaaattggtgcggttagacagcatcgtatccgtgctttcagtgtttatgcctttggtgccggctggatgtatcttctattttatatatttcttgggctggttattttcgctccggcggtaatagtgggactgaaagtcactacaatcgcaggttacgtgattgtctttctgtttatattgatgccgctggacagtctgctgaacagtattccatcactgaatgcggctcgcgtatcgctaaaccgcatcggttatgttctgtctgaactgactgagcaggatcacttggacgagcaggtttctgccagtgaatttggtgaagctaacttactgcaactgtcaggcattacacacaattattatcgtgagaaagaagacgatatgtttcagcttggtccaatcgatatgacgcttaaacgcggagaaatcacttttctgattggcggtaacggcagtgggaaaacgacactggccaagctgttaagcgggctgtatacaccggaaagcggcacaattactgttgacggaaatttgattactgatagtaacagagctaactatcgtcagctgttctccgccattttctcggattttcatctcttcgaaacactgataggtctgactgatactgattcagtactggatgcacgagcgaacgccctgctcgctaaattacatttggagcacaaggttaaaattcaggatggttgtttttcaactcgtgagctttcacaagggcaacggaaacgcctcgctttagtggttgcttatttggaagatcggccattctatctgttcgatgagtgggccgctgatcaggacccactatttaagattgtattctatcaggatctattgcccgaattggcggcacgcggtaaagctgtactggctattactcatgacgaccgttttttccatttagcggatcattgcatcaagctggaaaatggtcagctg

SEQ ID NO: 24068 - DNA, 2463 bp, Xenorhabdus nematophilus
ttacccatttatgacgttgtggattcagtcatagctcagctggaaacttcaaaacaggtattactgcatgccccgaccggtgccggaaaatcaaccggcctaccgctggcaattctcaacaaatcacggtttagtgggcggatcatcatgctggaaccccggcgtattgcggcacgtagtgttgcggagcgtctggcagaacaattgaatgagcctgtcggcagaacggtgggttaccggatgcgtctggaaacaaaagtcagtgctcacacacgtcttgaagtcgtcacagaaggtattctgaaccggatgttgcaacaggatcctgaattgagtggtgtctctctcgttatccttgatgagtttcacgaacgtagcttacaggctgatttggctttagcactgttgttagatgtacaggaaggattacgggatgatttgcgtattctggtgatgtctgcaacgctggataaccagcgcctttcttctttattaccagaagcaccggttgtggtttcagaagggcgcagttatccggtaacgagaagctatcatcccctgcctgctcatctgccttttgaacaatcagtggcgtcaacagtattacgtttgttgcagcaggagtctgggtcattactgctgtttttacccggtgtgagggaaattcagcgggtgcaggcttacttagaagaaaaagtcggtagcgatacattattgtgtccgctatatggtgcgttatcgttaacagatcagcggatggcgataatgccagctccggcaggaaagcgtaaggttgtactggcgaccaatattgcagaaaccagcctgactattgaaggcattcgtctggtggtggatagtggtctggaacgtaccagccggtttgaaccccggacaggattaacccgtttgatcactcagcgtatcagtcaggcatcaatggtgcagcggacggggcgagccggcaggctggaagcgggtgtctgctggcatttgttcagtcaggaacagggccgagcgggcagcggaacacagcgaacctgagattctgcatgccgatttgagtatcgttctgccatcagtctaaaacagtggggacccatcggcagtggtctaatacgctgggtggataatccaccacaggctgcactggctgttgcccgcactctgcttgtacggctgggagcactggatgataagcagcagttaaccgcccgtggctggcaaatgacagaatctggttgtgagcctcgcttagccgccatgttgtgcctggctaaagaacagtatgacaggcaggattcagatcggggaatattggcaacggcagcaaaacttgtcgcaatccttgaagaaccaccgcgccggggacagttggatctcactcattgccttaatactcttcaaccgaactggcagcaacggtcaaaacagttactcagggaactggcgggtaataatatggcaaatgttgccgatagtaatgtgaagtatatacctgagttactggtacaggggttccccgacagaattgcaaaaaatcgtgataatctcgggcgattccaactggctacaggtctgggagctatgcttgcacgggaggagccgctttcgggggagacatggctggtggcgcctttattacagcagggtaataagatgccagatgcacatattttgcttgcttgtccattagatattgagcaaatcatccggcaatattcttctttgtttacagaacagacagctattgaatgggatgataataaaggcaccttgcgggcatggaaaagactgaaatgtgaacgattgacggtcaggtcacagcctttagcaaaaccctcagatgccgaattgcaggaagctctgctgaactggattcggcaggaaggtctggcagcgctgaactggtcacaggaagcattgcagctgcgtgttcgtttacagcgggcgcaggaatggttgccggaaacgcaatggccagcggttgatgatgaagcgttattggcttctcttgaacagtggttacaaccggtgctggaaggtgtgagaaatttgaaaggattgcagcaggttgaactgtcagccgctctggtgagtttacttgactggcagcaacggcaagtactggataatgaattgcctactaattacactgtgccaaccggaagccggattggtatcgaatatttttatgataaatcccccgtactatccgtaaaaatgcaggaaatgtacggagaacagcaaaatccggctgtggcaaaagggcgtgtacctgtcgttgttgagctattgtctccggctcagcggccgttgcaaatcacgcaggatcttgcagcattctggcagggggcttaccgtgaagtgcaaaaagagatgaaagggcgttatccaaaacacttatggcccgatgatccggcaaacacagcaccgacaaggcgggtaaaaaaatatatttag

SEQ ID NO: 24069 - DNA, 1278 bp, Xenorhabdus nematophilus
atgagccagtccgaaacactttactctcaggcaaaacatgttatccccggcggtgtaaactctccggttcgcgctttcaatggcgttggcggtacacctgtatttatccaacgtgccaatggtgcctatctttatgatgtcgatggtcatgcctatatcgattatgtcggctcatggggaccaatggttctgggacataatcaccctgctatccgcaacgctgtcattgaagctgctgaacgtggtctgagttttggtgctccaacggctgccgaagtagaaatggcaaaactggtaacagagctgattccttcaatggatatggttcgtatggtgaactctggtacggaagcaacgatgagtgccatccgtctggctcgtggctatactcagcgcgataaaatcatcaaattcgaaggctgctatcatggccacgcagattgcctgctggtaaaagccggttccggtgctctgactatcggacaaccgaattctccgggagttcctgccgatttcgccaaacatactctgacctgcgtctacaatgacttaaattcagtgcgtgaagcattcgaaaaattcccggaagagattgcctgtattatcgtcgaaccggttgccggaaatatgaactgcatcccaccgcaaccagagtttttgccggggctacgtaaactgtgtgatgaattcggcgctctgttgattatcgatgaagtgatgactggttttcgtgttgctttaggtggcgcacaggaatattacggagttaaacctgacctcacttctcttggaaaaatcatcggtggtggtatgcctgtcggtgcattcggtggtcgtcaggaaattatggaaaaactggctccaaccggccctgtttatcaggcgggaaccctttctggcaacccgattgcgatggcggcaggtttggcctgcctgaaagaagttgctcagattggtgtccatcaacgcctgagtgaactgacggataaactggcaacgggattaaaaaatgcggctgctaaagctgatattcctctggttattaaccacgttggcggtatgttcggtattttctttaccgatgcggaaaacgttacctgctatcaggatgtgatgaaatgtgatgttgaacgattcaagaagttcttccatttcatgctggatgaaggcgtctatctggcaccatccgcattcgaagccggttttatgtctatcgctcattcagaggaagatattcagcgtaccgttgatgctgctgctcgttgttttgctaagctg

SEQ ID NO: 24070 - DNA, 963 bp, Xenorhabdus nematophilus
atgaacttagaatcgataattaaacttacagctgatgatatggcagcggttaatgaaaccattcttaaccaattaaattctgatgttgcgcttatcaaccagcttggctattacattattagtggcggtggcaaacgcattcgcccaatgattgccgtgctggtcgctaaggcactgggtcatgagggagagaaacatatcaaagttgctgccctgatagaatttattcatacagcaaccctgcttcatgatgatgtcgtagatgaatccgacatgcgtcgcggtcgggcaacggctaatgccatgtatggcaatgcagccggggtactggtcggtgattttatctatacccgttcgtttcaaatgatgactgacctcaactcaatgcgcgtgctgaaactgatgtccgatgccacgaatgtcattgcagaaggcgaagtgatgcagttgatgaattgtaatgatccggatatttcagaagatgattacatgcgcgtcatttacagcaaaacggcgcgcctgtttgaagtggcatcacattcttccgctattttgtccaatgcaaccccggagcaggaagctgcactacgcgattatggtcgctatcttggtactgcattccagttgatcgatgatcttttagattacgattccgatgataatacgctcggaaaaaataccggggatgatctgaatgaaggtaagccgacgcttccgctcttgcatgcgatgaatcacggaactcctgagcagtcggcattgatccgcgaggcgattgaaaaaggtaatggccgccatttgttggatactgtgcttacaacgatgaaacagtgtggttcactcaattacacccgccaacgggccgaggaagaagctgataaggcaatttcagcgttacaagtacttgatgagtctccatacaaagcggcccttgtgggacttgcccatatcgctgtacagcga

SEQ ID NO: 24071 - DNA, 933 bp, Xenorhabdus nematophilus
atgaaagttgcagttctcggtgcagccggtggtattggtcaggcacttgcccttctactcaagacccagcttccttcaggttcagaactttctttgtatgacattgccccagtaaccccaggcgttgctgccgatctgagccatatcccgacagcagtgaaggtcactggttttgcgggtgaagatgcaactcctgcattggcaggcgcagatgttgtattgatttctgctggtgtagcgcgtaaacctggtatggatcgttcagatctatttaatattaatgcaggcattatccgtaatctggttcagcagatcgctaaaacatgcccgaaagcattaatcggaattattactaaccctgtgaacacgactgtagcaatcgctgctgaagttctgaaaaaagagggtgtgtacgataaaaaccgtctgtttggtataacaacgctggatattatccgctctaataccttcattgctgaactgaaaggcaaaaaaccagaagagctggaagttcctgttattggtggtcactctggggtaactattctgccattactgtctcagatccctggtgttagcttcactgctgaagaagttgaagctctgacaaaacgtatccagaatgccggtactgaagttgttgaagcaaaagcgggtggcggatctgcaactttgtctatgggacaagcagctgcccgtttcggcctctccctgatccgtgctttgcagggtgacagcaatgttatcgaatgcagctatgtagaaggtgatggcgaacacgctcgcttcttcgcacaacctattcgcttaggtaaaaatggtattgaagaacgtttagatattggtcagctgagtgagtttgaacaaaacgcactgaataatatgttagacgttctgaaaaaagatattgaattaggcgaaaaatttattaat

SEQ ID NO: 24072 - DNA, 999 bp, Xenorhabdus nematophilus
atgaaaacattaggcgaattcatcgtcgaaaaacagcacgactttcctcatgctacaggtgaattgaccgcattactttctgctatcaaactgggtgccaagatcattcatcgggacatcaataaagcgggtctcgtggatattctgggcactagcggtgtttcaaatgttcagggtgaagttcagatgaagctggacttgtatgccaatgaaaaactcaaggcagcactgaaagctcgcggtgaagtagctggtatcgcttctgaagaagaagacgatatcgtcatctttgatggcgaccgggcagaaaatgcaaaatatgttgttttgatggatccactggatggttcttcgaatattgatgtaaacgtttccgttggtactattttctctatttaccaccgaattacaccaatcgggcaaccggttactgaagaagactttctgcaaccgggccatcgtcaggttgcggctggttatgtcgtctacggctcatccaccatgttggtttacactactggctgtggtgttcataccttcacttatgatccttctctgggtgtattctgcctgacccatgaaaaagttcagttcccggcaaaaggcaatatgtactccattaacgaagggaactacattaaattccctcaaggtgtgaagaaatacatcaaatattgtcaggagcaggatgaagaaactcagcgcccttacactacccgttatgtcggttcactcgttgctgacttccatcgcaacctgctgaaaggcggtatttacatttacccaagtacagccagccatccgaccggcaaattacgcctgttatatgagtgcaacccgattgcattcctggctgaacaggctggcggtaaagccagtgacggtacaaaccggatactggatatcgtaccaaatcagttgcaccagcgcgttccactgtttgtcggaaccaaatcgatggtggaaaaagccgaaagttttatggctgagtttcccgaa

SEQ ID NO: 24073 - DNA, 1134 bp, Xenorhabdus nematophilus
atggcaaaaaaagactactacgaggttttgggtgtctccaagaccgctgatgaaaaagagatcaagaaagcctataagcgactggctatgaaattccatcctgatcgtaatcagggtgataaagaagctgaagccaaatttaaagaaattaaagaagcgtatgagatcctgactgactctcagaagcgcgcagcttatgaccaatatggtcatgccgcctttgaacagggtggtatgggcggaggtgctggcggcttcggtggtggcgctgactttagcgatatctttggtgacgttttcggagatattttcggtggtggccgtcgtcaacagcgtccaagccgtggttctgacctgcgctacagcatggacttaacactggaagaagctgtccgtggtgtgaccaaagagatccgcatcccaactctggaatcctgtgaaagttgtcatggcagtggtgcaaaagcaggcaccagtcctgaaacctgttctacctgtcaaggggctggtcaggtacatatgcgtcagggcttctttactgttcagcagccatgtcctcaatgtcatggccgtggaaaaatcatcaaagaaccatgtaacaaatgtcacggtcacggtcgcgttgaaaaatacaaaacactgtctgttaaaatcccggcaggtgtcgataccggtgaccgcattcgtttaagtggtgagggtgaagctggcgaacacggcgctccggcaggtgatttgtacgttcaggttcaggttaaagcgcaccacatcttcgaacgtgatggcagcaacctttattgtgaagtgccaatcaactttgcaactgcagcactgggtggcgaaattgaagtaccgactcttgatggtcgcgtcagcctgaaaatcccggcggaaactcagaccggcaaattgttccgcatgaaaggcaaaggcgttaaatccgttcgtggcggtgcacagggcgatttactgtgccgtgttgtcgtggaaactccggttaaactgaacgaagagcagaaagagctgatgcgccaactgggcgagtcttttggcggaaaaagcggggaaaccaatagcccacgctccaaaagcttccttgatggcgtgaaaaagttttttgatgatttgactaag

SEQ ID NO: 24074 - DNA, 1911 bp, Xenorhabdus nematophilus
atgggtaaaatcattggtatcgacttgggaactaccaactcttgtgtagcaattatggacggcacaacagcacgtgtgcttgaaaacagcgaaggtgatcgtacaaccccttcaatcatcgcatatactcaggatggtgaaactctggttggtcaaccagctaaacgtcaggctgttactaacccgcaaaacaccctgtttgccatcaaacgtttgattggccgtcgttttcaggacgaagaagtacagcgtgacgttgctatcatgccatacaaaatcaccaacgcagacaacggtgacgcatggctggaagtaaaaggccagaaaatggcaccacctcagatttctgctgaagtcctgaaaaaaatgaagaaaaccgcagaagactatctgggtgagccagtaacagaagcagttatcactgttcctgcttatttcaacgatgcacagcgtcaggcaactaaagatgcgggccgtatcgcaggtctggaagttaagcgtatcattaacgaaccaactgcggcagctctggcttatggtctggataaagaagttggtaaccgtactatcgcagtttacgacttgggtggcggtactttcgatatctctatcatcgaaatcgacgaagttgacggcgaaaaaacgtatgaagttctggcaaccaacggtgatactcacttgggtggtgaagacttcgacagccgtatgatcaactatctggttgatgagtttaagaaagaacaaggtatcgatctgcgtaacgacccactggctatgcagcgcctgaaagaagcagcagaaaaagcgaaaatcgagctgtcttccgctcagcagactgacgtgaatctgccatacatcactgcagacgcaaccggtcctaagcacatgaacgttaaagtaacccgtgcaaaactggaatctctggttgaagatctggtgaaacgttctatcgagccactgaaagttgcacttaatgacgctggcctgtctgtatctgacattcaggatgtcattctggttggtggtcagactcgtatgccaatggttcagaaagctgttgcagacttcttcggtaaagaaccacgtaaagacgttaaccctgatgaagcagttgcaatgggtgcggcagttcagggcggtgtactggcaggtgacgtgaaagacgttctgctgctggacgtaactccactgtctctgggtatcgaaaccatgggtggcgtgatgacttctctgattacgaagaacaccactatcccaactaagcacagccaagtattctctacagcagaagacaaccagtctgcggtaactatccacgtattgcagggtgagcgtaagcgttccggcgataacaaatctctgggtcagttcaacctggacggcattcagccagcacctcgtggtatgcctcagatcgaagtgactttcgacatcgatgccgatggtatcctgcacgtttctgcgaaagacaaaaactctggtcgtgagcagaacatcaccattaaagcatcttctggtctgaatgaagaagaaatccagcaaatggtacgtgatgcagaagctaacgcagaagctgaccgtaagttcgaagagctggttcagactcgcaatcaggctgaccaactggttcacggcactcgtaagcaagttgaagaagctggcgacaaactgactgctgacgaaaaaaccgctatcgagaaagctgttgctgaactggaaactgcggcgaaaggcgaagataaagctgaaatcgaagcgaaaattcaggctctggttgaagcatctaagaaacttcaggaaatcgcacagcagcaggctcaggcaggcgcagctgatgcagatgcaggcaatgccgcgaagaaagatgatgatgctgtagacgctgaattcgaagaagttaaagacaaaaaa

SEQ ID NO: 24075 - DNA, 786 bp, Xenorhabdus nematophilus
atgggtttcatgaccggcaagcgcattctaatcactggcgtcgccagcaaactgtctattgcttatggaattgcgaaagcaatgcacgaacaaggtgcagaactggcttttacctaccagaatgacaaattgaaacctcgtgtcgaagaattcgcagcatctctgaattcaaacatcgttctgccatgcgacgtggctcaagatgaaagtatcgacacattgttcgttgaactgggtaaagtatggccgaaattcgatggttttgttcactctatcggttatgccccagccgaacaacttgatggcgattacgttaatgccgtcagccgtgaaggtttcaaaatagcacatgatatcagcgcatacagcttcgtcgcattggcaaaagcatgtcgtagtatgctgaatcctgactcagcgctgctaactttaagctatttaggtgcagagcgtgcaatccctaactacaacgtgatgggattagcaaaagcttctctggaagcaaacgtgcgttacatggcgaatgctatgggtgctgaaggtgttcgtgttaatgctatttccgcaggcccaatccgtactctggcagcatccggtatcaaagatttccgtaagatgctggcacactgtgaatcagtcacacctatccgccgtaccgtcactacagaagatgtaggtaatgcggctgcattcctgtgttctaacctgtctggtggtattaccggtgaaatcctgcatgttgatggcgggttcagcattgctgccatgaacgaactggaatagaaa

SEQ ID NO: 24076 - DNA, 1263 bp, Xenorhabdus nematophilus
atgaaaaatacagagttgaatcaacgtcgtctgaatgctactccacgcggagtaggtgtgctgagtgactacttcgcgcaaaaggcggaaaatgctactctgtgggatgtggaaggtaacgaaatcatcgattttgcggctggcattgctgtgctgaatacaggtcatcgtcaccctgaaatcgtatccgcaattgaacaacaactaaaagcattcacccataccgcatatcaaatcgtaccttatgaaagctatgtgacactggcagaacgtattaacgcgctggcaccgatcaacggcccgacaaaaaccgcgttcttcaccaccggagcggaagctgtcgaaaatgccgtgaagatcgcccgcgcttatacccgtcggccgggagtgattactttcagtggtggctttcatggccgtacttttatgacgatggcgctcacaggcaaagtagcaccgtataaaatcggttttggcccattccccggttccgtttaccacgccaaatatccgaacgggcttcacagcgtatcagtcgataatgctctggcaagtctggaacatattttcaaagccgatatcgcaccggatcaggtagccgccattattattgagccagtacagggtgaaggcggattcaacatggcgcctaccgagtttatgcaggcgctacgtacattgtgcgatgagcatggcattctgttaatcgccgacgaagtacaaactggcttcgcccgcacgggaaaactgtttgcgatggaacaccacaatgtaaaagcagacctgatcacgatggcgaaaagtctggcgggagggatgccgctttccggcgtaacgggacgtgcagaagtgatggatgcaccggcacccggagggcttggcggtacctatgcgggcaatccactggcggtggcagccgcccatgcagtacttaacatcatcgaaaaagagcagttgtgcgaacgagctaatcagcttggtcagcatctggtggaaatactggcacaagcgcgtactcagtgcccggcaatcgccgaaattcgcgcactgggttctatggttgcagtggaatttaacgatccacaaaccggtaaaccctcaccagaatttacccgcgaagtacaaactcgagctaaacgcgaagggctgctattattgagctgcggtactcacggtaacgtgatccgtttcctctacccgctgacgataccggaggctcaattcggtaaggcactgcaaattctgtcacatattctgaaaaat

SEQ ID NO: 24077 - DNA, 1629 bp, Xenorhabdus nematophilus
gtggcgattcatcctagggcagggcaactggcccagcagcatgatctgatcaatgttgcactcctcacatcacagtattacaccttacaacccaatcccgaaaatccggctcataaagtcaaatttggtacttccggtcatcgtggcagtgccgggcgtaatagctttaacgaagcgcatattctggcaatttctcaggcgattgtagaagtacgtaagcaatatgatattactggcccgtgttatatcgggaaagatacacatgcactttctgaagccgcttttatttccgtgctggaagtactgacagcgaatggtgttgatgtggtcgtgcaggagaataatggttttacgccaacgcctgctatttcacatgctattttgtcttataaccgtcagggaaaaaatctggcggatggcattgtgattaccccttcccataatccaccagaagatggtggtattaaatataatccgcctaatggtggcccggccgatacggatctgacttccgttattgaaaatcgggcgaatgaattgttggccggtaatctgaaaggcgttaaacgtcagtcttacgaacaggcattaaaaagtgaatatctgcaccctcaggatttagttgatccttatgtcaccgcgctgggtgaggttgtcgatatggccgcgattcagaaagcgggtctgaaaatcgggattgatcccttgggtggctcaggtattgcttactggcagcgtattggtgagtactataatctcgatctgacgctggtgaatgataacattgatcagactttccgtttcatgacgctggatcgtgatggtgtgatccggatggattgttcatcccgctgggcgatggccgggttgctggagttgcgggataaattcgatttggcattcgccaatgatcctgattatgaccgccacggcatcattaccccagccggcctgatgaatcctaaccattatctggcgacagcagtggattatctgtttcgtcatcgtccgcaatggtctgagaaagtggccgtgggtaagacgctggtttccagtgccatgatcgatcgggttgtggctgatctggggcgtgaactggtggaagttcctgtcgggtttaaatggtttgttgacggactatataaaggtgaactgggctttggtggagaagaaagcgcgggcgcatctttcctgcgttttgatggtactccgtggtcaacagataaagacggcatcattctttgcctgcttgcagcggaaatgatggcagtgaccggtgaaaatccacaacagcgctatgacaaattggcggcccgttttggtacaccgagttatagccgtcttcaggctccggcaagtcatcagcagaaagcacagttagctaagctgtcaccggaaatggtgaaagctgacactctggcaggtgatcctattacggctcgcctgacaactgcttccggtaatggtgcttccattggcggcctaaaggtaatgagtgataatggctggtttgcggcgcgcccttcaggtacagaagaagcatataaaatttattgcgagagtttcctgggtgcagaacaccgtgaaaaaatcgagcaggaagctcaggaattgttaaccaagtatttg

SEQ ID NO: 24078 - DNA, 1434 bp, Xenorhabdus nematophilus
ataagcatgtcgatagccactctcaggcattttattaatggacagtatattgaatctaaaggctctgaatattttgatttgatcagcccggtcacgggtgaatcttatgcacgttctcctaatgcgaatgctgaagatgttaataatgcttatgcatctgctaaagcagcatttaaagtatggggccggagtaccccttctgagcgccagaaggcgcttttagcactggctgactcggtagaaaaaaacgctgaacgtctggttgaggtgcaaagccgcaataccgggcagctcaaacatctgattgcctctgaggaagtggcaacttcggctgatcatatccgctttttcgctggtgcagcccgctttttggaaagtaaggcaacaacggaatatctttccggtatgaccagtagtatccgccgcgagccgctgggtgtagtggggcaagtgactccatggaattacccattgatgatggcagcatggaagattgcccctgctctggccgctggcaatactattgtccttaagccgagtgatactacgccggagagcactttattgctggctgaactggctgcaacgttctttcctgccggtacgttcaacgtagtactgggcaatgccagcgcaggcgctctggttgtttcacacaaaaccccggctatggtttctatcactggctctgtgcgggctggtttgcaggtcgcttcttcggcagcagccaatctcacccgatcacatctggaattgggcggcaaagctccggtcattgtttttgccgatgcggatatggacaaagtggtggaaaccattgctattgcggggtacttcaacgccggtcaggactgcacagccgcttcgcgcgtgctggtgcatgaatcggtttacgataccttcgtgacgaaattagtcgcggcagctaaagcaacccgatttggcgatcctgaagatgaaaaagcgctatatgggccacttaacaatattcgccagctggaacaggttaagggatttattgcacgtcggcctgcttatgcccgtatcgaaacagggggacgtcaggctgaacgtccgggatattactttgaacctacggtaatcaccggtctggagcagcacgatgaaatgattcagaccgaaattttcggcccggttatcacagtacagaaattcagaacagaagaagaagctatcgagaaagccaacgacgtgaaatacgggttagcctccagtgtctggacccgtgaccatgctcgaacattgcgcctgtcccgtgagcttgattttggcacggtctggatcaacgcccatattcctcttgcggcagaagccccacacggtggttttaagcactccggatacggtaaagatctgtcggcttatagtttcgatgaatatacgcgtatcaaacacgtgatgagttccaacgac

SEQ ID NO: 24079 - DNA, 732 bp, Xenorhabdus nematophilus
ttaagtaataaggtcgctattgttactggtggtgcaactaaaataggtgcggctgttgccagagtattgagtgaatatggtgttaaggttgctatttttgatattgatcgtgaaggcggaaaaaaagcctgcgatgtccgacctgatgatattcatttctggcctgttgatattactgatgacaaacagctctctcaggggatacaagaggttgcagcttactatggccaccttaactgtctcgttaatcttgctgcaacttatctggataatggtgccgactccggccgcgaaatgtggctgacggcactgaatattaatgtggtcagcgccatcaaggcagctcagtttgcacatccttattttatggcagccggaggtggagcaattgttaacttcaccagcgtttcatcctctgttgcccagacaggccgttggctatatcccgcctcaaaagccgctttattacaagctacccgcagcatggcaatggactatgccgctgatcgcattcgtgttaactccgtttcaccgggttggacttggtcccgggtcatggatgaactgactcagggcagtcgccggaaaacagatgaggttgccgcagattatcacttacttggccgtgcgggcgatcctgaagagattgcccaggtcgtgtcctttcttctttctgatttgtcgagttttgtgaccggagccgattactccgttgatggtggttattcagtg

SEQ ID NO: 24080 - DNA, 1035 bp, Xenorhabdus nematophilus
gtgaccaacaaaacctctcttagctataaagatgctggtgtcgatattgatgctggtaatgccttagtcaatcgtatcaaaagtgtagtgaaacagacccgacgcccggaagtgatggggggattgggtggctttggtgcattatgttctctgccacaaaaatatcgtgaacctgttttagtttctggcacagatggtgtggggactaaattgcgtctggccatggatctgatacgccacgatacaatcggcattgatttggtcgccatgtgcgtcaacgatctggtggttcagggagctgagcctctgttcttccttgattactatgcaacagggaaattagatgttgataccgcatcaagcgttataaccggcatcgcagaaggctgtaaacaggctggctgtgctctggtcggcggagaaacagctgaaatgccgggcatgtaccacggtgaagattacgatgttgcaggcttctgtgtcggtgtggttgaaaaatcagaaatcattgacggcagtaaagttcaggctggagatgcactcatagcactgtcatccagcgggccacactccaatggttattcactgatccgtaaaatccttgaagtcagtcagaccaatcccgagacaactgagctggatggtaaaacactggctgatcatcttctcgctccaacccgtatttacgttaaaccactgcttgaactgattgagcaagttgaaatccatgcgatttgccatcttacaggtggtggtttctgggagaatattccccgcgttctgcctgaaaatatgcaggcaaaaatcgacggcaccagttggcaatggcctgccatttttaaatggctgcaacaggctggcaatgtcagcgaccatgaaatgtaccgtacgtttaactgcggcgtcggcatgataattgcgctgcctcagtctcaggcaacacaggcaattgaatggctgaataaagcgggtgaaaacgcatggcaaatcggcagcatcgctgaatctgatcatagcgggcaacaagttacgatc

SEQ ID NO: 24081 - DNA, 1281 bp, Xenorhabdus nematophilus
atggctgataaaaaggctacgttgaccataaatggttcagctgctatcgaactagacgtactaacgccaaccctaggctctgaagtaattgacgttcgtaccctcggctcaaaaggcttctatacctacgatcccggtttcacttccactgcatcctgcgagtcgaaaatcacctatattgatggcaatgaaggcattttgttgcaccgtggttttcccatcgatcagcttgcaatgaaatcaacctatctggaagtttgttatattctgcttaatggcgaaccaccaactcctgaggagtatgaaaaattcaaaacaacggtgactcgtcatactatgattcacgaacagattacccgcctgttccatggtttccgtcgtgattctcaccctatggctatactctgcggtgtcacaggcgctctcgctgccttctaccatgatgcgctggatgttaataatccccgccaccgagaaatcaccgcataccgtctcatgtctaaaatgccaactgtagcggcgatgtgttacaaatattccgttggtcagccttttgtttacccgcgtaatgatctctcttacgccggtaatttcctgtacatgatgttctcaactccctgtgaggaatataaggtcaatccggtactggaacgggcaatggatcgcatttttattcttcatgcagaccatgagcagaatgcttcaacttcgacagtccgtacagcaggttcttctggtgctaacccgtttgcctgtatttctgcggggattgcatcattgtggggaccagcacatggcggagcaaatgaagcttgcctgcgcatgctggaagagattcagactgtcgatcacattcctgagtttattgcccgggccaaagataaaaatgacgctttccgcctgatgggctttggtcatcgcgtctataaaaactatgacccacgcgcaaccgtaatgcgtgaaacctgccatgaagtactggatgagcttggtctgaatgacagcctgctggaagttgccatggagctggaacgcattgccctgaatgacccgtacttcattgagaagaaactgtacccgaatgtcgatttctactcaggaattattttgaaagcgatgggaattccgtcatccatgtttactgtgatcttcgctattgcccgcacaatcggctggattgcacactggaatgaaatgcatgatgaaggcatgaggatcgctcgtcctcgccaactgtatactggtcatgcagagcgagattttaacagtcagttaaaaaaa

SEQ ID NO: 24082 - DNA, 1764 bp, Xenorhabdus nematophilus
atgaaactgccggtaagagagtttgacgctgttgttattggtgctggtggcgcaggtatgcgtgctgcactgcaaatttcacaaatgggcctgtcctgtgccctgatttctaaagttttccctacccgatcccatacagtttctgctcagggtggtatcacagttgctctgggtaacactcatgaagataactgggaatggcatatgtatgacacggtaaaaggttccgattatatcggtgaccaggatgccatagaatacatgtgtaaaaccggtcctgaagccattctcgaattggaacacatggggctaccattctcacgtctggataatggccgcatttatcagcgcccgtttggtggtcaatccagaaattttggtggtgagcaggcagcccgtactgcggctgcggctgaccgtaccggccatgcattacttcataccctgtatcagcagaacctgaagaaccacacgactattttctctgagtggtattctctggatttagtcaaaaatcaggacggtgccattgttggctgtacagcaatctgtatcgaaacaggtgaagttgtctatttcaaagccaaggcaactattctggcgacaggtggtgctggtcgtattttccaatccacaacaaatgcgcatatcaatacaggtgatggtgttggtatggctctgcgtgccggtgttccggtgcaggatatggaaatgtggcaattccacccgacaggcattgcaggcgcgggtgtgctggtaacagaaggctgccgtggtgaaggtggttatctgctgaacaaagatggcgagcgctttatggagcgttacgcaccaaatgctaaagatctggctggccgtgatgtcgttgctcgatctatgatgatcgaaattcgtgaaggtcgtggttgtgaaggcccgtggggacctcacgtgaaactgaaactggaccatctgggtaaagatgttctggaatcccgcctgccgggtatccttgagctgtcccgtacctttgctcatgtagatcctgtaaaagaaccgattccggtgatcccaacctgtcactatatgatgggtggtattccaaccaagattaccggtcaggcactgactatcaatgataaaggcgaagatgttgtcattccgggtctgtttgccgtgggtgaaattgcctgtgtatccgtgcatggtgcaaaccgtctggggggtaactccttgcttgatttggtggtctttggtcgttctgctggtttgcacctgaaagagtgtctgatggagcagggaaccacccgtgatgccagtgagtctgatgttgatgtagcactgcaacgtctgaaccgttggaataatacccgttcaggcgaagatccggttgagattcgtaaagcattacaagcctgtatgcagcacaacttctctgtattccgtgaaggggaagcaatggcgagagggctggacgaactgaaagtcatccgtaaacgtctgcacaatgctcgtctggatgatacatcatcagaattcaatactcagcgtatcgaatgtctggagctggataacctgatggaaacagcttattcgactgctgttgctgcgaactatcgtacagaaagtcgtggagcacacagccgtttcgattatccagagcgtgacgatgcaaattggctgtgccacagcttgtatttaccgcagactgagagcatgacccgtcgagaagttaacatgcagccaaaactgcgtgaagccttcccgccgaaagtgcgttcttac

SEQ ID NO: 24083 - DNA, 714 bp, Xenorhabdus nematophilus
atgaaacttgaattctcaatttatcgttataatccggatgtagacaacgcaccccgtatgcaggattacacgctggaagcggaagaagggcgtgacatgatgctgctggatgccctcattcagttgaaggagcaggatccaaccttgtcattccgccgttcatgccgtgaaggtgtatgtggttccgacggtttgaatatgaacggtaaaaatgggctggcctgtattacatccatttcagccttgcgccgtggaaacaaaaagattgttatccgtcctctgccgggtttgccggttgtccgtgatttggtcgttgatatgggccaattttatgcgcaatatgagaaaatccgtccttatttaattaatgacggtaaaaaccctcctgcgcgtgaacacctgcaatcaccagagcagcgtgaaaaactggatggcctttatgaatgtatcctgtgtgcctgctgttcgacgtcttgtccgtcattctggtggaatccggataaatttattgggccagcgggtctgttagcggcatatcgtttcctgattgatagccgggatactgaaacttcatcccgacttgatggtctgaatgatgcattcagtgtgttccgttgtcatggaattatgaactgcgtcaatgtatgtcctaaaggtctaaatccaacaaaagcgattggtcatattaagtctatgttgttaagacacagtgct

SEQ ID NO: 24084 - DNA, 2802 bp, Xenorhabdus nematophilus
atgcagaacggtgcaatgaaggactggctggattcaagctttctggctggtgcaaaccagtcttacatagagcaaatctatgaagactatataaccgatcctaattctgttgatgcaggttggagagaaatattccaacaattaccggatgaaggacttcacggggaacaacttcactcacagacacgtgattacttccgtcgtctggcaaaggatgccactcgttaccacacttcagtcagcgatccagcaatggatgcaaaacaagttaaggttttgcagctaatcaacgcattccgcttccgcggtcatcaaaatgcgaaccttgatccattgggattatggaaacaggaacctgtaccagatctcgatcctgctttccataatttaaccaaagcagattttgaagaaacatttaacgtaggctcatttgctatcggcaaagagacgatgaaactggctgatttatatgacgccctgaagcgcatttattgtggttctattggtgcggaatatatgcatatcaccaatacagaggaaaagcgctggctccaacagcgtctggaatctgtggcggtgggttcacagttcaatacggaagaaaaacgtcgttttctggcagagctgacggcagcggaaggtttggaacgctatttaggtgctaagttcccgggggcgaaacgtttctcccttgaaggcggtgatgcgctgattccaatgctgaaagaacttatccgtcacgcaggtaaacaagatactcgtgaagttgtactgggaatggctcaccgtgggcgcctcaacgttctggtcaacttattcggtaaaaaaccagcggatctgtttgacgagtttgctggtaagcataaagagcatcttggcacgggtgacgtgaaataccatcagggtttttcttctgatttcgaaactgatggtggaccagtgcatctggcgctggcatttaacccatctcaccttgaaattgttagccctgttgttattggttctgtccgtgctcgccgtgaccgcctcgatgaaggccgcagtaacatggttctgccagtgaccattcatggtgactcagcagtaacagggcagggaattgttcaggaaacactgaatatgtctcaggcgcgcggctatgaagttggtggcacaattcgaattgtggttaacaaccagattggtttcacaacctctaatcctaaagatacccgttcaacagaatattgtactgatattgcgaagatggttcaggcacctatcttccacgttaatgcagatgatccggaagccgttactttcgtcacccgtcttgctctggatttccgtaatacgtttaaacgtgacgtgatgattgatttggtttgttaccgtcgtcatgggcataacgaagctgatgagccaagcgcaactcagcctttgatgtatcagaaaatcaagaaacacccaacaccacgcaagatctacgcagataaacttatcgcagaaaatctactgtcacctaatgatgtcactgaaatggccaacttatatcgtgacgcattagatcacggtgattgtgtcgtggatgaatggcgtccaatgggcctgcattccttcacatgggaaccttatctgaaccatgaatgggatgcagagtatccacatcaggtggatatgaaacgcttgcaagatcttggcaaacgtatcagctccattccggctgaagtcgcaatgcattcccgcgttgcaaaaatctacgctgaccgtgcagaaatggctaatggaaacaaattatttgactggggcgcggcagaaacactggcgtatgcaactctggttgatgaaggtgttccggtacgtctgtccggtgaagatgcgggtcgtggtacattcttccaccgtcatgcggttatccataatcagactgatgcctctgtttatgtgcctctggcaaatgttcacaatggtcagggtgaattcaacgtatgggattccgtgctgtctgaagaagcagtactggcgtttgaatacggttatgcaacaacagagccacgcacgctgaccatctgggaagctcagtttggtgattttgctaacgtagcacaggtcgttattgaccagttcatcagctctggcgagcagaaatggggccgtatgtgtggtctggttatgttgctgccgcatggatatgaagggcaaggcccagagcactcatctgcacgtctggaacgttatctgcaattatgtgcagaacagaacatgcaggtctgtgtgccatcaactccggctcaggtttatcacatgctgcgccgtcaggctctgcgtggtatgcgtcgtcctctgatcgttatgtcacctaagtcactgctgcgccatccattggcagtatccagtctggatgaactggctgacggtaagtttgagacagtgattggtgaagtcgacgctttagatccgaaaggtgtgaaacgcgttgtactttgctccggtaaagtctattacgatctgctggagcagcgtcgtaagaatgaacagagtgatgttgctattgttcgtattgagcagctatatccattccctcgtcaagatttgcagaatctgtttgagcagtatgctcatgttcatgatttcgtttggtgtcaggaagaacccctgaaccaaggggcttggtattgcagtcaacataatttccgtgaagcgatcccatttggggcttctttacgttatgcagggcgtccggcttctgcttccccggctgtgggctatacgtccgttcaccagaagcaacagcaagctctggtaaatgacgcactgaacgtt

SEQ ID NO: 24085 - DNA, 1209 bp, Xenorhabdus nematophilus
agcgtagaaattctggttccagaccttcctgaatctgttgcggatgcgactgttgcaacatggcacaaaaaaccgggtgatgctgtagagcgtgatgacattctggttgaaattgaaactgacaaagtgattttagaagtaccagcaagtgaagcaggtgttctggaagctgttttggaagaagaaggcgccactgtattgtctaagcaattgcttggccgtattagcctgagcaacagtgctggtatgcctactgctgtgaaggaaaccactgaagcaactccggcacagcgccagactgcctctttggaagatgagagtaacgatgctcttagcccggcagttcgccgtctgattgcagagcacgatttagatccggctgcgattaaaggcagtggtgtaggtggtcgtattgtgcgtgaagatgtagaaaaacatatcgctgcgaacaaaaaagagagcgctaaacctgctgcatctgcaccagccgctcaacagtctgaactgccacaccgcagtgaaaaacgtgtgccaatgacgcgtttacgtaaacgtgttgcagaacgtctgcttgaagcgaagaacaatacggcaatgttgacgactttcaatgaagtcaacatgaaaccaattcaggaactgcgtaagcaatacggcgatgtgtttgaaaaacgtcatggcgttcgtctgggcttcatgtccttctatgtgaaagctgttgttgaagcactgaaacgttatccagaagttaatgcttcaattgatggcactgacgtggtttaccacaactattttgatatcagcattgcggtatcgactccacgtggtctggtaacgccagtattacgtgatgcagatgccctgagcatggctgatctcgaaaaaaccatcaaagagctggctattaaaggccgtgacggtaaattgaccgttgatgaactcaccggtggtaatttcaccattactaatggtggtgttttcggctctctaatgtccactccgatcattaacccaccacaaagtgcgattctgggcatgcatgccattaaagatcgcccaatggcagtaaatggtcaggttgagatccttccaatgatgtatctggcactgtcttatgaccatcgtctgattgacggacgtgagtctgtaggcttcctggtgaccatcaaagaaatgctggaagatccaacacgtttgttgctggatgta

SEQ ID NO: 24086 - DNA, 1164 bp, Xenorhabdus nematophilus
atgaatttacacgagtatcaggcaaaacaactttttgcacggtatggtttaccagcaccagctggttatgcctgcacaacgccgcgcgaagcagaagaagcagcatccaagattggttcaggtccttgggtcgttaaatgtcaggttcatgcaggcggtcgcggtaaggctggtggtgtgaaagtcgtcaatagcaaggaagatattcgtgcttttgctgaacaatggctgggtaaacggctggtaacctatcagactgacgtacaggggcaacctgttcaccagattctggtagaaggagcgactgatattgctaaggagctgtatctcggggctgttgttgaccgtggtacacgtcgtgtagtgttcatggcctctaccgaaggtggcgtcgaaatagaaaaagtggcggaagaaacgcccgaactgattcataaagcaatcatcgacccactggctggccctatgccctatcaaggccgtgaactggcgttcaagttaggtttgactggtaaacaagtcggtcaattcaccaagattttcatgggattggcaaaccttttccttgagcgtgatctggctctggttgaaattaacccattggttattacaactgaaggtgatcttatctgtttggatggaaagttgggtgcagatggtaacgcgatgttccgtcaggccgaactgcgtgaaatgcacgatcctttacaggaagatccacgtgaagctcaggctgcacaatgggaactgaattatgttgcattggatggcaacattggctgtatggtaaatggtgctggtctggcaatgggaacgatggacattgtcaaactgcacggtggtgcacctgctaacttccttgatgttggtggtggcgcaacaaaagagcgtgttactgaggcatttaaaatcatcctgtcagatgaaaatgtgaaagctgtcttggtaaatatctttggtgggatcgtccgttgtgatctgattgccgacggtattattggtgctgtggaagaagttggtgtacacgtaccggtagttgttcgtctggaaggaaacaatgctgaacagggtgcgaaaaaactggctgacagtggcttgaacattatagcagcaaccagtttgacagacgcagctaaacaggcagtcgcagcagcggggaataaa

SEQ ID NO: 24087 - DNA, 864 bp, Xenorhabdus nematophilus
atgtctattttaatcgataaaaacaccaaagtgatttgtcagggttttactggtagtcagggtactttccactcagaacaggcgattgcttacggtactcagatggttggtggtgtcacaccgggtaaaggtggcactgaacaccttggcctgcctgtgtttaataccgttcgtgaagcggttgaagcaacaggtgcaacagcctctgttatttatgtaccggcaccattttgtaaagactccattctggaagctattgaagctggcattaaactgattattaccattactgaaggcattccaactctggatatgctgactgttaaggtaaaactggatgaagccggtgttcgcatgatcggccctaactgtccgggtgtgattactccgggtgaatgtaagatcggcattatgcctggtcatattcatcaagcaggtaaagtgggtattgtatcccgttcaggtactttgacatatgaagcggtgaaacagacaactgatgcaggattaggtcaatctacctgtgttggtatcggtggtgacccaattccgggttcaaacttcatcgatatcctgaaactattccagcaggatccacaaactgaagctatcgtcatgatcggcgagattggtggaacagcagaagaagaagctgctgcgtacatcaaagagcatgtaacgaaacctgtcgttgcttacatcgcgggtgtgacagcacctaaaggtaagcgcatggggcatgctggtgcgattatcgcgggtggtaaaggtactgcggatgagaaattcgcagcgctggaagccgcaggcgtgacaactgtccgtagccttgctgacatcggagatgcagtaaaagggttattg

SEQ ID NO: 24088 - DNA, 777 bp, Xenorhabdus nematophilus
ttgacaggtaaagttatgcaaaaagccattcttattacgggatgctccagcggtatcggattaaccgcagccaaaacacttcatcaacgtggctatcgtgttttggctgcttgcccgtaacctgctgatttagcacatatgcgcgaattaggtttagaacccatcgaactggatttagatgatccggaaagtgttaagaaagctgctgagcaagttattgagttaacaaatggtcgtttgttcggattattcaataatggtggttttggcgtttatggcccgttggcgagtatttcccgtgaacagatggaaaaacaattttccaccaacttctttggtacccatcagctgacgtgtctgcttctacccgcaatccgggcgaatggtgaagggcggatcatccagaccagctctgtgctggggttaattgccacgccgggacgtggtgcctattctgccagtaaatatgcgcttgaagcctggtctgatgccctgagaatggaattagcaggaagtggaataaaagtcagtctgatacaaccgggaccgattaaaacgcgtttcacagaaaatgttgctcagaccgagattgataaccccgtcgaaaactcggcaatggctcgccgtttaacgatgacgccggaagatgttgtggaaaaattaatccatgcactggaaagccctaaccctaagttacgctatcctgtgacgctaatatctcatgctgttactgttctgcgtcgcctgctgccagcaagattaatcgataaaatcgta

SEQ ID NO: 24089 - DNA, 2553 bp, Xenorhabdus nematophilus
attgcgttacaactttccggattaagctgtatgaagtgtgtcggcaaaacccagaaagccctggaatcagtggaaggtgttgttgctactgaagtcgataagcaaacagccagaatttacggcaaggctgacgaaaatgccttaattagcgcagtgaaacaagcaggctatcatgctgaatcagtcatgagttcgcatctcccaaaaaatgagccgctgacaacacctgaaccagaatttttgccagcggcaacagattccacttctattcctatcacaaaatctgataaaaaaactggctctggtgcttctcataacagcgacgacagcattcagcttctgctggatggcatgagctgtgcaagttgtgtcagtaaagtgcaaaaagctctgcaatctgttgaaggtgttaaaaatgccagagtcaatctggcggaaagaagtgctctggtcacgggttcagcttcccctgatgctttggtcaatgcggttatcaaagccggttatggcgctgaaatcattctggatgaaactgaacgccgggaacgacagcaacaaattgcacaagccaatatgcgccgtttccgctggcaatcagccctcgctctgattgtcggggttccggttatgatttggggcatgataggcgacaatatgatgctcacaccggaaaatcataccatctggctgagtattggtctggtgactcttgccgtcatggtatttgctggcgggcatttttatcgcaacgcctggcaaagcctgaaaaatggcagcgcgacaatggatacattagttgcactgggaacaggggctgcatggctatattccatcagcgtcaacttatggccggatatttttccacctcaggcgcgccatatttattatgaagccagcgctatcattatcggcttaattaatcttggtcatgccttagaacagcgagcacgccagcgctcttcacaagcacttgagcgactgttggatttaacgcctccaacagcccgagtcatcacatcagaaggcgaagtatcattaccgctggctgatgttgaacccgatatgacattacggctggtaacgggtgatagggttcctgttgatggagagatcattcagggcacagtctggctggatgaagcgatgctgacgggagaagctattccgcagcaaaaaacactcggtgatacagttcatgccgggacagtcgttcaggacggaacggtactgttcaaagcttcagccgtaggcagccaaaccactttagccagaattatcaatctggtacgtcaggcacaaagcagtaaaccggaaatcggtcaactggtggataaaatatcctcaatatttgtccctgtcgtcgttgttattgcattggttgccggtgctatctggtattttgccggcccggctccacaaatcatgtatgcactggtcattatcacaacggtactgattattgcctgcccttgtgcgcttggtctggcaactccaatgtctattatttcaggagtcggaagggctgctgaattaggcgtattaatacgcgatgctgatgccctgcaacaggccagtcaactcgatacccttgtttttgacaaaaccggaaccctgacagaaggcatgccacaggttacggaaattcatactttcaacggctacacggaagaacaggtattactgtgggcaggtgcgctggaaagcggttcaaaccatcctttagcaaaagcaattctcctgaaagctgaagacagaaaaatagagagtaaacaattaactgacgtcacgcagtttcgcactctggcaggcacaggaattagcggcaatatcggtaacacggcactgctgttaggtaatctgagcctacttgaacagaatcaggttgaaacaagcacattacaacagcaagtagtacaacaggcggaaaaaggtattacccctgttcttctggctgttgacggtaaaatagcagccctgttttcaatacatgatccactgcgtcaggatacaatctcagccctgcaacgtctgcataagcaggggtatcatttagtgatgctgacgggagatcatccggcaacagctcatgctatagccaaagaagcgggcattgatcaggttattgctggagtcttgcctgatggtaaggcagcaactattcagaccttacaatcagagggcagaaaagtagcgatgattggtgacggaattaatgatgctccggcattagcacaagccgatgtaggtattgcgatgggaagcggcagtgatattgctattgaaacagcatcaattaccctgatgcgccacagcctgcatggagttgccgatgccgctgaattatctaaagggacattacgtaatatgaaacagaacctgttcggggcatttatctataatacgctggggatcccgattgcagccggtatcctctaccctttcaccggtacattattaaatccggtgattgccagtgccgccatggctctctcttctattaccgtagtcagtaacgctaaccgattattacgctttaaaacgaaagattaactg

SEQ ID NO: 24090 - DNA, 1482 bp, Xenorhabdus nematophilus
atcactttgctggcgtccgttacggcttttttgcagcgttctcatggccattacattaatggacaatccgttcgtggtcagggagacaaaaccttttcagtcgtcaaccccgcgtctgatgagatgatcgctaccgttaatcagggaagtgaggtcgaagccaatgctgctatgcaggctgcatctgatgcttttcatggttcatgggcccggacttcaccgatggaacgtggaaattgcctgatacggctggcggatttgctgcaaaaacatagcgaagaacttgcccagttggaaactctatgttcaggaaaaaccattcagttatcacgtatgctggaggttggagcttctgcccaatacttgcgttattttgctggctggtcgagcaaaataagtggtgaaacactgaatgtttctttgccatctttcaagggtgaagaatataccgcctttacccgtcgtgaaccagtcggcgtggtcgtcgggattattccctggaatttctcgatcatgattgccatctggaaactgggggcagctttggcctgcggttgtacgattgttctgaaaccaagcgaatataccccgttaacaatgctgcgcgtggcggaactggcaaaagaagccggaattcctgatggcgtgattaatattgttaatggctccggagccagtgtagggactaaactgttaactcatccgctgtgttccaaagtgtcttttaccggatcagtacctacaggtaaacttataggtaaatctgttatggaacaggggcagttccgtgcaacgctggagctgggcggcaaaaacgcagcggctttcctgtcagatgtccccgtagagaagatagttgatggaatattggaagccggatatctgaatcaggggcaaatctgtgcggcagcagaacgtttctatattccttctgttcatatggatgcggttttgaagttactctccgaacgcctgtctacgatgaaaattggctctccccttgatgaaacgacggaaatggggcctttagccaataaagagcactatgaaaaaattctgtccctgtttgaaaaagcgcgtcaggaagggaatgaaattgtttatggtggtcgtgcactggaagggaaaggtttttttgtaatgcctactgtgatccgagccaaaagtgcagatgatacgttgatgaaagaagagacattcgggccgatagggactttcctcagttacgatgatgaggaggagctgattgctatgatgaacgcaacgccattcggtttatccgccagcttatggacgaatgatctcagcaaggcgatgcggatgatcccgcgtattcaggccggtgttttgtgggttaacatgcatactcatcttgatcctgctcttccattcggaggaataaaatcatcaggactcggccgcgagtttggcaaggcattcatcgagtattacacagaactgaaatcagtcatgatacggtat

SEQ ID NO: 24091 - DNA, 1203 bp, Xenorhabdus nematophilus
atgacgaaagaaattcagagaaattggtttgaacagtatatggttccttgtttcgcaccagctccatttattcctgtcagagctaaaggctccagagtatgggatcaggatgaaaaagaatacgttgattttgctggaggtattgctgttaacgcattaggacatgctaataatgaattaaaagaaacattaagcaatcaaatggaaaacctctggcatattggtaatggttacaccaatgaaccggtcttaaatctggcaaaagatttagtcgagaataccttttctgataaggtttttttctgtaactccggcgctgaagcaaatgaagctgcgctgaaaattgccagaaaatatgctttagataaacatggcagccataaaagcgaaattatctcatttgaaaactcttttcacggaagaacattatttacagtgacagtaggtgggcaacctaaatattcacaagattttgctcctcttccacaacaaatcactcatctcccttataacgatattgaagccattaaagcacatatttctgacaaaacctgtgccgtcattgttgaacccattatcggcgaaggtggtgttatcccggcaacgccagattttctgaaggcgttaagagagctgtgtgatcaatatcaggcattgctgatttatgacgaaatacagaccggaattggccgcacggggtatctgtatgcctatgaagaaacgggaattgagccggatatactgaccagtgcaaaaggattgggcggtgggttcccaatcggagcgatgctggttaaacagcatgtcgcagaagtattccagccgggctcacatggcacgacattcggtggtaacccactggcaagtgcagttgctcataaagtgctgaacatagtgaaccagaaggcgtttttggcaggtgtgcaggagcgccatcaggaattcatccggcatatgactgatttgaaccagcgttaccaagtgtttagtgaaatacgtggtaaaggattattgctgggcgcagaactggcggacaaatatcagggtaaagcgaaaacattaaccaatcttgctgcggaagaagggttaatcgcgctgattgctgggccgaatgtactgcgttttgctccggcattaaatattgaacaacaggatatcaacgacggttttgcccggcttgaaaatgccctcaagcgatttgtt

SEQ ID NO: 24092 - DNA, 1464 bp, Xenorhabdus nematophilus
agtgatcaggcaaattacattgatggtaagtgggtaaccgggcagggtgtacaggtagttaaacattcgcctattgatcagcaaattctgtggcaggcccgcagtgcttctgttaagcaagtggaagaagctggtctggcagcacgcagggcattttcagactgggcaaagctggcagttgaaaaacgtattgccattgttcaggcattcgctgatttactggcaaaggaaaaagaaacaattgcccgtgtgataagtgaagaaaccagcaaaccattgtgggaaacccggacagaagttcagtctatgattggtaaagttgctatttccattgaggcatggcagcaacggacaggttattcagaaaccgccatgccggatggaaaggcaatattacagcatcgtcctcacggcgtgatggccgtttttgggccttataatttccccggtcatttacctaacggccatattgttcccgctttgattgccggtaacacattaatctttaagccaagtgaattaacgccgattacagcagaaaaaaccgtggagttatggatcaaagccggattacctgcgggagtattgaacctcgttcaggggggaagggaaaccggtggtgcgttactggattgtcgggaaatcgacggaatactgtttacgggcagtgcaacaaccggttttcacttccaccgtctgttagctggtcagccggaaaaaatgctggcactggagatgggggggaataatgccctgattgtcgatgattatgatgatcttgatgcggcagtttataccattatccagtctgcttttatttccgcgggtcagcgctgtacttgtgcccgccggttgttggtaaaacagggtgagaagggcgatgccctgattcaacggctgaccgaagcggctcgtcagatagtcccgtcccgctgggatgctgaacctcagccttttatgggcggtgtgatctctttggcagcggcagaaagtctgctgaatgctcaatcagggttgctggcactgggcggcaaggccctgctgacactcacacaaccggatccgcattcaacctttatgactcccggcattattgaactgacaggcgttagtcaggttcctgatgaagagtatttcggccctctgctgaccttacagcgttatgacacctttgaggaagctatttccatcgccaatgatacccgtttcggtctggcgacagggttgatttcacctgatgaaagccttttccttcgattacaggaagaagcaagagccgggattgtgaactggaacaaaccactgaccggcgcttccagtaaagcaccttttggtgggattggagcatcaggcaatcatcgccccagtgcttactatgctgctgattattgtgcatggccaatggcatctttggtgacagacaaactgtctctgccagacacattcgtccccgggcttgatttt

SEQ ID NO: 24093 - DNA, 1392 bp, Xenorhabdus nematophilus
atgacgaatacggtaaaaacacctgcggagcaatccgcaggtgcgcagaaacttcaccgtggattaggaaaacgtcatgtccagttgattgccattggcggtgccatcgggactggtctattcatgggaacagggaagactatagctgtatcaggaacttctattattctgacttatctgctgatcggcttttttgcctttatggttatgcgggcgatgggagagttgctgctctccaagttggattatcgtacgtttgctgattttgttgctgattatctaggggaaaaagccagttattttctcggctggacatactggatgagctgggtagtgagctgtattgcggatgttgtggtctgtggtggctatattcagtattggtttcctgatatttccctctggtttactgcgttgttcattcttggattaatgtgtttatgtaactttttttcagtcaggctgttcggtgagacggaattctggtttgccatgattaaggttgtggcgatagttgcactgattattgttggtgtgggtatggttgctattggctggacatcaccaaatggcgtcacggcttctgttcgccatctgacgaatccggaggtttttctgcccaatggcgtatttggttttctggccggttttcagattgcgattttctcttttactggtattgaactagtgggtactgttaccgctgagacgaaagagccggagaagattttaccgaaatctatcaacagtattcccattcgcattattatcttttatgtgttttccatgatgtgcattattgctgtaacttcatggcctcacatctctccggaagtcagcccgttcgttacgctatttgcactggcaggattaccggctgccgccgcagtgattaattttgtggcactgacatcggcaatgtcttcagcaaacagcggactatacgcctgtacccgtatgttatatggcctgtctactgaaaaattggctcatggttggttcgggcgactttcagtcaatagtgcaattcctgttttcagcctgatattttctgttgtttgcatggcaagtggtgtacttctgttgtttatcgttcccgatgtgatgaagctatttaccattgtttccactgtagccgccatcatggttgtttatagctggtgtatgatattgcttgcttatctggcttaccgtaaaaaacgccctgatttacatgagaagtccatctataaaatgccgatgggcattcctatgacatggtgcactctgatatttttcgcttttaccgtggttatcatgatctttgattacgatacacgtattgccttgtatggcacgccaatctggtttgttatccttgaggttttatggcgtatgcggaaaaagcgtaag

SEQ ID NO: 24094 - DNA, 1032 bp, Xenorhabdus nematophilus
tttaatcaggctgattatccacacaggcgctataaccctttaacagggcagtggataattatctcaccacatcggctgaaacgaccgtgggctggggtagagaaactattacagcatcctgtatctccgggctacgataaacagtgtgctctatgcccgaataacacacgtgcctcaggggatatcaatcctgattatcaggatatctacgtatttcagaacgattattcagccttactgccggaaactcccgctattgccactgctgacgatccgctgtttataagcaaaccgacaagaggaacctgccgcgttatctgcttttcaccaaatcacagtaaaacctttcctgaattatctctgaccaatatccgccgtattattgatgtctggaacagccacatagaagaacttggacaacgctatatctgggttcaggtatttgagaataaaggggaaatgatggggtgttcccagcctcatccacacggacaaatctgggccagtgattttctgcctaatgagctgactcgcaaagatgagttactgaggcaatattatgatcagcatggatctaatttattgctggattatgccagagctgaacagaaaaacggtgtgcgtacaatcgtggataccaaacactggctggctgttgtgccctattgggcggtgtggccgtttgaaacaatgttattgccgaaaagccctgtccggcgtatgaatgaactgacgaaagagcagcgtgatgatctggctgttgcgatgaaaaaactgacctgccgatacgataacttgttccaatgctcctttccctattctatgggctggcatttcgctcctttctttaccaataagcagaccgatattgagcactggcagttacatgctttgttttatccgccattattgcgttctgcaactgtccgtaaatttttggtgggttatgagatgctggctgaatcccagcgcgatctgacaccggaacaggccgcccaacggctacgggatgtcagtgatgttcatttcagg

SEQ ID NO: 24095 - DNA, 912 bp, Xenorhabdus nematophilus
attagttccttaggaaaccaaatcgataactctctggtttcaaacgcctttggcttcctgcgcttcccgttgaatttccagccttattccggtgatgcggagtgggttattaccggtgtaccctttgatatggcaacatccggccgggctggtagtcgccacgggccggccgctattcgtcaggtctcgacaaatctggcttgggaaagcagccgatggccatggaacttcagcctgcgcaagcgcctgaatgtggttgattgtggtgatctggtctttaattttggtgatgcgcaggatatgagcgataaactacaggctcatgctgagaaagtgctggcatcaggcaaaaagatgctgacttttggtggcgatcactttgtcacattacctctgttgcgcgctcatgcgaaacatttcggtaaaatggctctggttcatttcgatgctcataccgatacttaccctaatggcagtaagtttgatcacggtacgatgttttaccatgcgccaaacgaggggctgatcgatccggcgcattctgtccagatcggtattcgtactgaacacgatacagataatgatttcacggtattagatgcagggcaggtgaatgatcgcagcgttgaagatgttgtcgatcagatcaaatctgttgtcggtgatctgccggtatacctgacttttgatattgattgtcttgatccagcatttgcacctggtacgggaacgccagtgatcggtggtttgacttcagatcgtgcgctgaaaattctgcgggctttgcaaccgctgaatatcgttggaatggacgtggtggaagttgctccttcctatgatcagtcagaaattaccgcgctggcggcagcaacaatcggtctggaattgctgtatttgcaggcttctaaaaaa

SEQ ID NO: 24096 - DNA, 1668 bp, Xenorhabdus nematophilus
gtattttggactatcggtttatttacagttttcatcaatcttctgatgctggctccctctatctatatgctgcaagtctatgatcgagtattgccctccagtaatgaaatgactttgctaatgttgacgctgattatccttggcatgtttgccatcatgggcgggctggaatatattcgaagcatggtagtgatacgcattggtaatcaatttgatatgtgcctgaaccaacggatttatactgcttcgtatgaatccaacttaaaaaatggttcaacagatgcagggcagatgctcaatgacttggcgactatccgccagttcctcacagggaatgccctgtttgctttttttgatgccccttggttccctgtttatctgtgtgtcatttttctattcaattcgtacttaggtttgctggcgttggtaggtgctaccattctgatttctctggcggtattgaaccagtggttatccaaagctcctttagctgaagcaagtcagctgtctttacgctcaactaatttggccagtactaatttgcgtaatgccgaagtgatcgaggcacttggcatgttacctgcgctgcgtcatcgttggtttgggttacatgagcgttttctgaattttcaacgtattgccagtgaacgggttgcatccattacagcgttgactaaaacagtgcgtatggctttgcaatcgttgattttgggtttggggggctggctggcgattgaagggcatatcacgccgggcatgatgattgcgggttctattttaatgggacgggcattatctccaattgaacagttgatacaggcgtggaagagctggaatgccgcccgcttgtcatggcagagattggatacgttattgcaagcccaacctgaacgtaaaagtggcatgtcgttgcctcctcctaagggcgcattgttgttagaaaatgtatctgcaatgccccccggaataatacgcttggaacaagatcaggcgtctaaaaatccccattatgttttgcaaaatctcaatttcgctctgaacaacggtgaggttctgggcataattggccccagtgcatctgggaaatctacattagcgcgtttgttggtcggaatttggcctactcaggaaggtatagtgcgtcttgatggggctgatatttaccagtggaataaagatgaattgggagcatccattggttacttgccgcaggatattgagttatttgcgggtaccattgctgagaatatcgcccgttttcatcatgctgatcctgaaaaaatcattgaagcggcaaaaaaagcgggtgttcacgaattggtgcttaatcttgaacagggttatgacacgataattggcgccagtggtgtggggttatcgggtgggcaaaaacaacgtattggactggctcgtgctttatatggcaatccgtcgcttgtggtattggatgaacccaactcaaatctggatgatcttggcgaaaaagcgttaaaccgtgcgattattcaattacgggatcagggaaaaacagtggtgattatcactcatcgtccttcacttctctcacaaacgagtaaaattttgtttctagtacagggaaaaatgaaaatgtttggtgcttcccagcaagttatggcggcattatctcaatctaagccttcagcacaa

SEQ ID NO: 24097 - DNA, 1863 bp, Xenorhabdus nematophilus
atgtctatcgaaattaacgtgcctgatattggtgcagatgaagttgaagttaccgagattctggtgaaagttggtgacacagtagaaatagaacagtcactgatcactgttgaaggtgacaaggcttctatggaagttccttctccacaggcgggtgtggttaaagagatcaaagttacagttggtgacaaagttgaaaccggcaaactgattatgatctttgaatccgcaactggtgcagcagaagcagtacctgtacagcaagaagcggctccggcagcagcgcctgttgcagctgaaagcaaagaagttgctgtaccggatatcggtggtgatgaagttgaagttaccgaaatcatggtaaaagtgggtgataccattactgaagagcaatctctgctgactgttgagggtgacaaggcttccatggaagtgcctgcgccattctcaggtacagtgaaagagatcaaaatcgcggttggcgataaagtaaaaactggttctctgatcatggtatttgaagttgcaggttctggtgcagcgccagctccggcagcagctcctgctccagcagcagcgcctgcggcatctgcggcaaaagaagttaatgtaccggatatcggtggtgatgaagttgaagttaccgaaatcatggtaaaagtgggtgacaccattgctgaagagcagtcactgatcactgttgaaggtgacaaggcttccatggaagtgcctgcgccattcgcaggtactgtgaaagagatcaaaatcgcggttggcgataaagtaaaaactggctctctaatcatggtatttgaagttgcaggcgcagcacctgtggcagcacctgcagcggctccggctcttgcggctgcaccggcgaaagcagcaccagctccggctgcggctaagccagcagaaggcaaaaatgagtttgcagaaaatgacgcctacgttcatgcaactccggttattcgccgtctggctcgtgaattcggtgtaaacctggctaaagttaaaggtactggtcgtaaaggtcgtattctgcgcgaagacgttcaggcttacgtgaaagatgcgatcaagcgtgctgaagctgcacctgcggctgcgggtggtggcttgcctggtatgctgccttggccgaaagttgatttcagcaagtttggtgaaatcgaagaagttgaaatgagccgtatccagaaaatctccggtgcaaacctgagccgtaactgggtaatgatccctcatgttaacctgttcgatgaagcggatatcactgaagttgaagaattccgtaaacagcaaaacaaagaagcagagaagaaacagctgggcgtgaaaatcactcctctggtattcgtcatgaaagcggctgcaaaagcactggaagcaatgcctcgctttaacagctctatctctgaagatggccaaaagctgatcctgaaaaaatacgtcaacatcggtattgcggttgatacgcctaacggtctggttgttcctgtattcaaagatgttaacaaaaaaggcatcatggaactgtcaagagaactggctgaagtatccaagaaagctcgtgctggtaagctgactgcttccgacatgcagggcggctgcttcaccatctccagcctgggtggtatcggtacaaccggctttgcaccaatcgtgaacgcgccagaagtggctattatgggtctgtcccgttcttctatgaagccggtctggaatggcaaggaattcgttcctcgtctgatcctgccaatgtctctgtctttcgaccaccgtgtgatcgatggagctgatggtgctcgtttcatcacttatattaatcagttgatgagcgacattcgccgtctggtgatg

SEQ ID NO: 24098 - DNA, 1425 bp, Xenorhabdus nematophilus
atgatgagtactgaaattaaagcccaggtagtggtgcttggagcaggccctgcagggtattctgctgcttttcgttgtgcagacttaggtttggataccgttctggttgagcgctactctactctgggtggtgtttgccttaacgttggttgtatcccatctaaagcattgcttcacgttgctaaagtcattgaagaagcaaaagcactggcacaacacggtatcgtgtttggtgagccacaaactgatatcgataaaatccgtctctggaaagaaaaagttatttcccagttgacaggtggtctgggtggcatggctaagggccgtaaagttaacgttgttaacggtgttggtaaatttactggtgctaacactctggtagttgaaggcgagaatggcgcaacaacgattaattttgataatgccattattgcagcgggttcacgcccaattcagctgccattcattccgcatgatgaccctcgcgtatgggattctactgatgcactggagctgaaaacagttccggaacgcatgctggttatgggcggcggtatcatcggtctggaaatgggcactgtttatcacgctctgggttctcagattgacgtggttgaaatgttcgatcaggttatccctgctgcggacaaagacgttgttaaagtattcactaagcgtatcagcaagaaattcaatctgatgctggaaaccaaagtgactgctgtagaagccaaagaagatggtatctacgtgacaatggaaggtaaaaaagcaccggcagaacctcagcgttatgacgcggttctggttgctatcggccgtgtaccaaacggtaaactgatcgatgctggtcaggcaggtgttgctgttgatgagcgtggctttatcaatgttgataagcaaatgcgtactaacgtacctcatatcttcgctatcggtgacatcgttggtcagccaatgctggcacacaaaggtgttcatgaaggccatgttgctgccgaagttatctccggtaagaaacattacttcgatccaaaagtgatcccatccattgcttacaccgagccagaagttgcatgggttggtctgactgagaaagaagcgaaagagaaaggcatcagttacgaaactgcaactttcccatgggctgcttccggtcgtgcaatcgcatctgattgttcagatggtatgactaaactgattttcgataaagaaagcaatcgtattatcggtggtgctattgttggtactaacggtggcgaactgctgggtgaaatcggtctggctatcgaaatgggttgtgatgcagaagatatcgctctgactgttcacgctcacccgactctgtacgaatcaatcggtatggctgctgaaatgtacgaaggcagcatcactgacttgccaaaccctaaggcaaagaaaaag

SEQ ID NO: 24099 - DNA, 1662 bp, Xenorhabdus nematophilus
atgagtgaggcagatactcgcccgacaaactttattcgtcagattattgacgaagatttggcaactggtaaacatacttccgtacatacccgtttcccgcctgaacctaacggctatctgcatattggtcatgcaaagtcgatctgcctgaatttcggcattgcacaagactatcaggggcaatgcaacctgcgttttgacgatacgaacccggttaaagaagatattgaatacgttgagtctatcaagcaagacgtacaatggctgggtttccagtggagtggtgatatccgtcattcttctgattacttcgaccagctgcatcaatacgccattgagttaatcaataaaggtctggcgtatgtggatgagctaagccctgatgagatccgcgaatatcgtggtacgttgaaagagccgggtaaaaacagcccataccgtgatcgtagtgtggaagaaaaccttgctctgttcgagaaaatgcgggcgggtgagtttgcagaaggtaaagcgtgtctgcgagccaaaattgatatggcttccccttttatggtcatgcgcgatccggttctgtatcgtatcaagtttgcagaacaccatcagtctggtaataaatggtgcatctatccgatgtacgattttacccactgtatttccgatgcgttggaaggaattacgcactctatttgtacactagagtttcaggataaccgccgcctgtatgactgggtattggataacatcacaattgactgccatcctcgtcagtatgagttttcccgcctgaatctggaatacgcagtaatgtccaagcgtaaactgaatcagcttgtgactgaaaatattgttgatggctgggatgatcctcgtatgccaaccatttcaggcctgcgtcgtcgtggttattctgctgcgtcaatccgtgaattctgccgccgtatcggtgtaactaagcaggataacaacgttgaaatggctgcactggaatcctgtatccgcgatgatctgaatgaacatgcaccacgagctatggcagttcttgatccggtgaaactggttattgaaaatatgccggaaggcgaagttattctgaccatgcctaaccatccgaataagccggaaatgggtagccgtgaagtaccattcagccgtgaactctatattgatcgggcagacttccgtgaagaagctaaccgccagtataagcgtctggtcatgggcaaagaagtacgtttgcgtaacgcttatgttgttaaagctgagcgtgttgagaaagacgcagaaggcaacatcaccacgatttactgtcattacgatgagcagacactgaataaagatccggctgatggccgcaaagtgaagggtgttattcactgggtaagtgcagtacatgccgcgccagctgaattctacttgtatgatcgtctgttcagcgtgccaaatccgggagcggaagaggatttcctgtctacgcttaataccgagtcattagtggtacgtaaaggttttgttgagccgggtctggtcaatgccatgctggaaaaaacttaccagtttgaacgtgaaggatacttctgtgctgatagcaaactttcaactgctgaacacttagtgtttaaccgcacagtaggtctgcgtgatacctgggcgaaaatctctaaa

SEQ ID NO: 24100 - DNA, 531 bp, Xenorhabdus nematophilus
aatataaaggctattttatttgatatggatgggactttagttcaatctttatcggaagttgaaatgatttggtctaaatggtgcgaaatgcagaatgtgcctatccaacatgtattggagatatgtcatggtgttcgttccagagatgttattttgactattgccccacatttgaatgtggaagaacaggttcagttattggatgatttagaagttcaacattcaggttcagcgcaagctttatttggtgcaaaagaatttttactttctttaaatgattgcccttgggctgtagtcacttcagccagccagagagttgcatatcatagaatgaatgtttgtggtcttaagataccggagctcatcgtaggttctgatgatgtacaggacgggaaaccacatccagctccttacctcatggccgctgaacgtttgggaatgaaagccaaagactgtttagtttttgaagattcgtatgcaggaatacaaagtgcattagcagcaggttgtgaggtcatacaaattgggggg

SEQ ID NO: 24101 - DNA, 2514 bp, Xenorhabdus nematophilus
tcattagaaggtgccactgctttctgtaagttacgtggtaacccttatgttgaactggttcattggctacaccaaatcatgcaacaacaaaacagtgatttacagaaacttatccaccatttagggctggatgaatctgcattgaccaaagatattgttgctgcgctggatagcctgccccgtggtgccagtgccatttctgatctctcagaacatattgacaatgccgtagagcgagcctgggtttacggctcgctaaaatttggtgttgctcagatccgtagttcgcatttactgataggtatattaaaaactttcaatcttcgcaatgcactgaaagcaatttctcccctgtttgatcatatcaatgccgataccctgatcgataattttaacaatatatttgatggcagtgatgaggctcaggaaagcataatatcatcaaccgaaactcagggagcatcgccacagtctgtaacaggctcagctttgcaacaatacggacaggagttaacagcccgggcccgtaatggtgaaattgaccctgtttcaggacgcgatgaagaaatccgccagattatcgatattgtgatgcgtcgcagacaaaacaacccattactgactggtgaggctggcgttggtaagactgcggtcattgaaggtctggctttgagaattgtggctggcgaagttcctcccccgctgaagaacgttcagctttggctgctggatatcggtatgttacaggccggtgcgggtattaaaggagagtttgaatcccgtctgcggaaagtcattgaagaagtccagtccagcccgacacccatcattttgtttatcgatgaaattcacactctgattggagccggtggacaacaaggtacaggcgatgccgctaacttattaaaaccagcactagcaagggggcagttgcggacactgggcgctacaacctggtcagaatataaaaaatatatcgaaaaagatccggccctgacccgccgttttcaggttgttcaggtgcatgaacctgatgaaaccaaggctctgataatgctgcgtagtctggtcaatacgctggaaaaacaccatcgtattcttttactggatgaagcggttgatgcagcagtacacctctcccatcgctatattcctgcccgtcagttaccggacaaagccatcgcattactggacaccgcctgtgccagagttgcagtcagccagcatgcagaacccccgcagctggaaaactgccgtcataagatagattcgttgaatgttgaactgggaatagtggaacgggaatccaaagttggtatgggcgatcccctgcgggcagaaaatattctcagccagttggcaacgctgacagagcaacaagagcagctagaagcgcgctggcaacaggaattgttgctgacagacaaaattatccagctacgtcttcagttacatgaagaacaagccgatgaagaacaaaacaataatgataaaatcactcttcatacggagctggctgagctgcaacaacaactggaaatgttacagggtgaagaacctcttatctttgccgcagtagacagtaatgttgtttccgctgttgtctcagactggactggcattcctttaagccgaatgatgaaagatgaaattgaggctgtattgcaattagccgatacccttaaccagcgtgtcattggtcagtatcatgcgttagaaaccatcgcaaaccgggtacgcacttcacgggcaaaactggacgaccctaataaaccggtaggggtctttatgctgtgtgggccttccggcgtcggtaaaactgaaaccgcactcgctctggcggaaacactgtatggtggtgaacaaaacctgatcactatcaatatgagtgaatttcaggaagcacatactgtatcaacattaaaaggtgctcctcccggctacgtcggatatggcgaagggggtgtcctgaccgaagccgttcgtcgtcgtccatacagtgtcgtattactggatgaaattgaaaaagcgcatcctgatgtccatgaaattttctttcaggtattcgataaggggtggatggaagatggtgaaggtcgtcatattgactttcgtaatacgattattattctgacatcgaatgtcggcgcggatttagtcaactcaatgtgctaccagcattaccaacagagtaatacactacctgagccggagcagcttagttcagcactacgcaaaccgctattaaacacattccccgccgctttactggggcgtttattagtcattccatactatccattagatgatgaagtcatgaccagtatcgtttatttgcagcttggacgcatacagaaacgattgctggaaaaccacggtattactgccacgttcgatgaagccatgattgaaaatattgtcagtcgttgtaccgaagttgagtcggggggtcgtacggtagatgctattttaaccaatactctattgcctcagataagccagcggctgctatct

SEQ ID NO: 24102 - DNA, 843 bp, Xenorhabdus nematophilus
ttacaggcattacccattggatactgtttcaatgagttggaaattgaaaaagtagtgggtaaaggaggatttggtatcgtataccgagcctgggatcacagcaaacagtgtgcagttgccataaaagaatatctgccatccatgattgtggttcgccgtaatgatttgaaactaaaattacgccacccaaatttacaggaaagattcagaatcgggcttcacagttttatgcgtgaagcccatatcatgacttgctttaaccatccgtgcctaccccgcttcatacgtttctggcaacagaacagcaccgcttatatcgccactcccttttaccatggcatcaccttgaaagtattacaggtaaagtatgcaaagatagttacacagagttggctgtgccatattttgtcccctctgcttgatgccatcaacaccctccaccaggctggctatctacactgtgatatttcgctggataatattttacttcagaatgatcgattacctgttttgctggatttagggtctgcccggaaaatagcagaacgtttatctgacgaagaagaaataacggtcaggccggggttcacaccctgtgaacaatacacggccaatgaagaggggcagcagggcccctggagtgatatttatgcgctaggggcagtattgcatactttgattgtcgggaggccaccaccggtaagcatagtacgcaatattgaagatcgttatcagcctttaacggaacggtgtcttaccggttattcattatcatttctacatgccatagattgtatgttggcaataaaaatagcagaacggccatcctctatttctaaatta

SEQ ID NO: 24103 - DNA, 1104 bp, Xenorhabdus nematophilus
tggatgccgtttagtgccaatcgtcattttcagcaagacccacgcatgatcgtctctgcggatggtcactggctgacggatgataaaggtcgtcgcatttatgacagtttatctggtttatggacttgcggagcagggcactcacgctcagaaattcgtcaggccgtttctgaacaattaggtacattagattactcacccggtttccagcatgctcatccactgtcatttcggttagcagataaaatcgctagtctgatgcccggcgatttaaaccatgtattttttaccaattcaggttctgaatctgttgatacagcagtaaaaatagcacgcgcatactggcggataaaagggcagccgactaaaaccagaatgattggcagaatgcgcgcttatcacggtgttaatatcgggggaacaagtcttggcggtattggcggaaatcgcaagatgttcggtcagttgatggaagttgaccatctgtcacacaccttacaaagcaatatggcatttactaaaggcgttccggcaactggcggcattgaattggctgatgaactactgaaactgatagaacttcatgatgccagtaatatcgccgctgttattgtcgaacctgttgctggatctgccggtgcgattgtgccaccacaaggttatctgcaacgtttaagggaaatatgtacccaacacaatatactgctgatttttgacgaagttattaccggattaggccgtttagggcgctggacaggggctgaatattttggtgtcactccggatattcttacttttgctaagcaggtcacaaatggtgcaattcctcttggtggtgctgttgtctccagtgagatctacgacacattcatgtcacaacctcttcctgagcatatgattgaattcagtcatggctatacttattctgctcatcctgttgcctgtgccgctggtctggcaacgttaacattactggaaaaggaaaatctgatccaacaatctgctgaattagcacctcattttgaaaaaatcctgcatgaactcaggcattgccctaacgttgttgatattcgtaactgtggtttgattggcaccatccaaatt

SEQ ID NO: 24104 - DNA, 504 bp, Xenorhabdus nematophilus
atgactcaagaaaaatcagtagatattgagtgggttgatattgtcaatgaagaaaatgaagtcatcgcgcaggcaacccgtgagcaaatgcgtaatcaaaacctgaggcatcgggcaacttatattgttgtacatgatggcatggggaaaattctggttcagcaccgtacagaaacaaaagatttttaccccagcaaactggatgcaactgcgggtggagtggtaacgatgggagagcatctgcttgaatcagcccgtcgtgaagcagaggaagaactgggaattgcgggaattccttttgctgaacatggcatcttctattacgaagaagaaatttgccgtatatggggaggcttgttcagttgtgtcagccgcgggccattcgcattacaggaagaagaggtttctgcggtttactggttatcaccggaagaaattacagcccgatgtgatgaatttacgccagattctttgaaggccctttctctatggctgtcacgtaat

SEQ ID NO: 24105 - DNA, 597 bp, Xenorhabdus nematophilus
atgatagacctatactatgctcctacacctaatggccataaaatcgcgctgtttcttgaagaagtgggcctcccttatacgatttatcccatcgatataagcgccaatgaacagttcacgccagagtttctcgccatttcacccaataataaaatccctgctattgtcgaccatcaacctgccgacagaggagaacccttatcgctcttcgaatcaggtgctattttgctctatctggcggaaaaaaccgggaaactattgagccagaatgaacgggaacgtatccggcaattacagtggctattctggcaggttgggggattcggcccgatgctcggacagaatcatcactttaaccgctatgcgcctgaagttgttccctacgcaataaatcgctatgtcacagaaactcagcggctatacaaagtactgaatacccagctggaaaaaacaccttatctcggcggcaatgaatacagtatcgcggatattgctacttatccgtgggcgtattgctatgaatatcaaaaaattaatttgcaggattatcccgctgtagaaaaatggttagaaaaaatcagccagcgccctgccacg

SEQ ID NO: 24106 - DNA, 1008 bp, Xenorhabdus nematophilus
atgtcagaaggttggaatattgcgctgttgggtgcaacgggcgcagtaggtgaggcgatattggcgttattacaggagcgccagtttccggttggtgaactgcatcttcttgccagtgaacaaagtgccggtagcattaagcggtttaacggtaagaacgttactgttcgcgatgttgccgaatttgactggtcacaggtacagctagcattttttgctgtgggtatggaagtcacagcacaatatattgcacaggcaacagaagcgggctgtctggtgattgatagcagcggattgtttgctgctgaaccggatgttccattggttgtgccgacagtaaacccgcatgtgctggctgagtatcgtaaccgtaatattgttgcggttgccgatagtgcaaccagtcaggtgttaacagctatcaagcctttaattgatactgcgggtatcgcgcgtttacaactgaccaatatcctgccggtttctgtgcatggtaaagcagcgattgacgaactggcggggcaaagtgcccgtttattgaatggaattccaccagatgaagggcgtttcaataaacaactggcattcaacttactgcctttgctgcctgatgcggaaggcacagtgcgtgaagagcgccggattgtcgatcaggttcgcagaatattacaggatgaaggtttgcctgtttcagtcagctgtgttcagtcttccgttttctacggtattgcccagatggtcagtgtggaaacactgcgtcctgttggcgtagaagaagcgcgtgacgaatttgaacgtcttgaagaaattcaggtctcagaagaaggggattacccgactcaggtgactgacgcatcaggtgctgatgggctgagtatcggctgtctgcgtaatgattacggaatgccggagatgttacagttctggtctgttgccgataacattcgtttcggcggtgcattgatggcggttgaagtcgcagaaaaactgatgcaggagcaattttac

SEQ ID NO: 24107 - DNA, 552 bp, Xenorhabdus nematophilus
attatgaccgctaacgcacaaaaactgcaatttattaaagatagtatcgaaacaatacctgattatccgaaagcgggcatacttttccgcgatattaccacgttattggataatcctgttgcatatcaggcgacgatcgatttattggtagcccattttcaggacaaaggtattaccaaaattgtcggtactgaagctcgtggtttcttgttcggggcaccagtggcactgcgtcttggggtaggttttgttcctgtccgtaaaaaaggcaaactacccagagagacgttaagtgaaacttatgctctggaatacggtactgatacattagaaattcataaagatagcatcaaagccggagataaagttctcgttgttgacgacctgcttgcaaccggtggcacgattgaagcaactgtgagcttaatccgccgtcttggtggtgaggtttcagaagcagcctttattatcggtcttcctgatttgggaggcacagaacgcctgaaaaatcagggcattgatagctacacccttgttgaatttccaggccac

SEQ ID NO: 24108 - DNA, 1890 bp, Xenorhabdus nematophilus
ttgaggtaataaatgagcatgaaagatcaggaaacccgtggatttcaatcagaagtcaaacaactgttacagttgatgatccattctctctattccaataaagaaattttcctccgtgagctgatttcaaacgcatcagatgcggcagataaattacgtttccgttcattatcagcgccagagctgtacgaaaatgatggtgaactgcgtgttcgtctggctttcgataaagagaataaaacaattaccattagtgataatggtattggtatgacccgtgatgaagtgatcgataacttgggaacgattgcaaaatctggtactaaggcatttcttgaatctatcggctctgatcaggctaaagacagccaattgattggtcagttcggtgttggtttttattcttcctttattgttgctgataaagtgactgtacgtacccgtgcagcaggcgcggcgacggaacagggcgtattctgggaatcaaccggtgaaggtgattacactgttgctgatattgaaaaagcagaacgtggaacagaaattaccctgcatttacgtgaaggggaagatgaatttttgaatgactggcgtttgcgttctgtcatcggcaaatattctgaccacattgccttacctgttgaaattgaaacccagactaaaaatgaagaagatgattcagttactgtagcatgggaaaaaatcaacaaggcacaggcactgtggacccgcggtaaagctgaaatcagcgatgatgaatataaagaattttataaacatatttcccacgatttcgctgatcctctgagctggagccataaccgtgttgaaggaaagcaggaatataccagtctgctgtatatcccttctcaggcaccatgggatttgtggaaccgtgaacataaacacgggctgaaactgtatgtacagcgtgtcttcatcatggatgaagctgagcagttcatgccaaattatctgcgttttattcgcgggctgatcgattccaatgacctgccactgaacgtttcccgtgaaattctacaggacagttcaatcactcgtaacctgcgcagcgcactgactaaacgtgtattacaaatgctggataaactggcaaaagatgatgcagagcaataccagtctttctggcagcagtttggtctggttctgaaagaaggccctgctgaagatggcggaaataaagaagctattgctaagctgctgcgttttgcgactacgcataatgacagtgcttcacaaactgtttctctggaagaatacgtcagccgcatgaccgaaggtcaggagaagatttactacattaccgcagatagttatgctgcagcgaaaaatagtccgcatctggaactgttccgtaagaaaggcattgaagttctgctgttatctgaccgtatcgatgaatggatgatgagctatctgacagaattcgacggaaaatcattccagtcagtcagcaaagctgatgagtctctcgataaactggctgatgaaaacaaagcagatcaggaagaagaagataaaaaactggaaccattcgttgagcgtgtgaagacactgcttggcgagcgtgtgaaagaagtcaaactgacccatcgactgactgatacaccggcgatagtgaccactgatgctaacggaatgaccactcaaatggcgaaactgtttgcagcggcagggcagtcagcaccggaagtcagctataattttgaactgaacccggatcataatctggttaaaaaggctgctgaaattcaggatgacagccagtttgctgactggattgagttgttactggaacaggctctgtttgctgaacgtggaacgctggatgatccaaaccagtttatccgccgtatgaatcaattatta

SEQ ID NO: 24109 - DNA, 918 bp, Xenorhabdus nematophilus
atgagtaatcgtaattatggtgtgctattagttaatcttggcacaccagacgcgccgacacctgctgcaataaggcgttatctggcaaagtttttaagtgatcggcgagttgtggatattccgccattgatttggaagcctctgttgtatggctttattcttcctttccgttctttccgtgtagccaggctgtatcaggaaatctggacagatgaaggttctcctttattggtttacagcaaacgtcagaaacagcgattaagtgaaaaactgggtaatatacctgttgagctggggatgacttatggttcaccttcattaactcaggcagtcgataaattactacagcagggtgttgaatatctcatcgtacttcctttgtatcctcagtattcaagtacaacatcagcggcagtatttgatagtctcagcaaaatattacagggatatcgtactatcccacatttgaaatttatccgcagttacgcccagcatccggcatatatcgccgcattaaaggaaactgtagaacagagctttgaaaagcatggtcaacctgatcgcctgattctttcctatcacggtatccctgagcgtctggctgaaatgggggatatttatccacagaactgtctggcgacaactaaactgctaacggaattgttggactatccggcagatagaattatgatgacataccagtcgcgttttgggcgtttaccgtggttagcaccctatacggataaaacaatagccctgttgccagagcagaatgtggagcatattcaggtactgtgtcccggattcgcagccgattgtctggagacactggaagaaattaagcagcagaataaagctatttttttagatgcgggcgggaaaaagtttgaatatataccagcacttaacgataatgag

SEQ ID NO: 24110 - DNA, 982 bp, Xenorhabdus nematophilus
caccgtcatctcctgagattacttgattacaagcctaaagaaattgagctttttttatccctgtcaatgaaattgaaagcgaataaaaaatcaggtaaagaaattcccttgctggcaggaaagaatatcgccctgatttttgagaaagactccacccgcacacgctgtgcatttgaagttgcagcacatgatcaaggggctaatgtcacctatttaggccccagcggcagccagattgggcataaggagtctatcagggatacagcaagggtacttgggcgttggtatgatggcattcagtaccgtggctatgggcaggcaatagtcgatacgctagctgaatatgctggtgtgcctgtctggaatggactgacggatgagttccacccgactcagctactggcagatttgctgacaatgcaggaacacagtagaaaacccttaactgaaataaaactggcctatctgggcgatgcccgtaataacatgggtaatagcttgctggaagcggctgcattaacaggattagatttgcgtctggttgcaccaaaaacctgcctggccggatgctcaattagtgagtgaatgccaaaaacaggcaacgaaaacaggtggaaaaattacactgacggaagatatcgtggctggcgtacaggctgctgatttcctttataccgatgtctgggtctcaatgggtgaacctaaaaatgtctggcaggagcgcattgaattattagcgccttatcaggttaatatggatctcgtgaaactaacgggaaatccggatgtgaaattcctgcattgcctgccggcttttcatgatgaagaaaccattcttggtaaacagcttgcggaagaattcaacttgtctggtggcctggaagtgactaatgatgtgtttgaatcagaatacagcattgtttttgatcaggcagaaaaccgtatgcatacgattaaagctgtcatggtggctacattagta

SEQ ID NO: 24111 - DNA, 756 bp, Xenorhabdus nematophilus
atggataagttgttttggcagactttaggcgaagctcctcgtgatcttgtgatgctgcacggatgggggctgaacgctgaggtctggcgttcagtggaaacacgattagcttcgcattttcgtttacatttagtggatttaccgggatacgggcgcagtcagccgtatcctgctatgacactgaaagagatggctgatacggtatggcaacaggcgccagaaaatgccttatggcttggatggtcgctgggagggcttattgccagccagattgcgttagatcatcctgataaagttgcgggtttaatcacagtagcatcatcgccaaaattcagtgaagagggggattggccggggatccagccttcggttctgagtgcattcaaacaccagttgagtgaagattttcagaagacggtcgagcgctttttagcattgcagactttgggcactaacagcgctcgtcaggatgcgcgtttattgaaatcagtggtattgagcctgccgatgccgacagtcgaagtgctcaatgccgggctggaaattctgcgcactgatgatttaagaagtgagctggcacagcttcagcttcctttcctgcgtatctatggttatcttgatggtttggtaccacgtaagattgctgccttgcttgatagtgaatggccgcacacccgttctgtgattatgcgtcatgcggcacatgcgccttttatttcccatccggatgaatttgtcgatctattgatagcattt

SEQ ID NO: 24112 - DNA, 759 bp, Xenorhabdus nematophilus
gatgtggcagggagtaaaattcaggtacgtgatctgaacttctattatggcaaatttcatgccctgaaaaatgtgacgttagatattgcgcagaataaagtgaccgcttttattggcccttcaggatgtggaaagtcaacattgttgcgcacctttaacaaaatgtatgaactgtacggagaacagagagccgaaggtgagatcctgcttgatggaacaaatattctggccgataaacaggatatagctttactgcgggctaaagtggggatggttttccagaagccgacaccttttccgatgtcgatttacgacaatattgcgtttggaatacgtttgtttgaaaaactcccaagagctgaaatggatgaacgggtgcgatgggcactgacgaaagcggcattgtggaacgaaacaaaagataagctgcatcagagcggttatagcctgtcaggaggccagcagcagcgtttgtgtattgcccgtggtattgccattcgtccggaagtgttattgctggatgaaccctgctcggccctcgacccgatttctacggggcgtattgaagagcttatcagtgaactgaaagcggaatataccgttgtgatcgtgactcataatatgcagcaggcagcacgttgttctgattatacggcttttatgtacttgggtgagctgattgaattcagtgacactgacatcttgttcaccacacccaaaatgaagcagaccgaagattacattaccggtcgttacggt

SEQ ID NO: 24113 - DNA, 1272 bp, Xenorhabdus nematophilus
ctggtggcagatgaactcagcgctaacttactggctgaaattccgcaggataagctggtgggtgttattgtgcgtgatggggcaactcattcacattctgcaatcttagtcagggcgatgggaataccggcgatcatgggcgctgatattcatcctgaattgctgcataaccgaatgttgattctggatggatatcggggagaatttttcattgatcctgagccactggttgttcaggaatatcgccagatcatcgaagaagagcaggttctcagtaaactggccgaaggcgggcagcaacaaaaagcccggcttaaaagtggagagagagtacgggttcagcttaatgcagggctgagcctgaaatatgagcaacaaataggcgatagtattgatggcgtcgggttgtatcgtactgagatcccttttatgctgcatagcggtttcccatcagaagatgaacagagaaatcgctatcaggaaatgctgacacttttccctgacaaatcagttgtgttgagaacactggatattggcgctgacaaacatcttccgtatatgcctattcatgaagaaaacccttgtcttggctggcgagggattcgcataacgctggatcagccggaaatatttctgatccagcttagggcgatgttgaaagcgaatatatcgaccggaaatctgaaaatattgttaccgatggtaagctgtattgaagagattgatgaagccaaaaaactgatcaacagggcaaagacagaagctgaacaatctgctggcacaaccattgcgatgccacaaattggcgtcatggtagaagtgccctctctgatcctgctgttaccacaattgaagaaacgggttgattttatctctattggtaccaacgacttaacccagtatttacttgcggtggatcgtaataatacccatgttgcttctttgtatgacaatcttcatccggcaatgattaaggccttaaaacagattgttgatgaaagtcagcgtattggtttacccgttagtgtttgtggtgaaatggcgggtttgccgatgggagtgctgatattagttggtttgggttatcgttgcctgagcatgagcggccggagtattccacgaattaaatacctattacatcatttagattccgcagaactgagttattttattcaggaaattctgagggcagaaaccacccaacaggtgaaagaaatttgttctgcttttatggaaacccacggccttggtgggctggtgcgtggtggcatt

SEQ ID NO: 24114 - DNA, 5395 bp, Xenorhabdus nematophilus
ggctataccttaaaatactggcatgagcggatacgacacgatgtggagtccgtttttgctttactgcaacagcatctagattcctttttacctgatgataatgcctggatttatcttgcaacaccggagcagttacaggctcagattggtttacttttaccggcttatcagcgtaatcccgacgcatttcctttgttcggtattccttttgcagttaaggataatattgatgttgctgactggccgacaaccgcggcctgcccggcgtttgaatatatcgcagatgaagatgcgacagcggttgccagactaaaagcggcgggagctatcgtcgttggaaaaacgaatatggatcagtttgctaccggattagtcggcactcgttcaccttatggcgtcgttaaaaacagtttcaatgatcgttatattagtggcggctccagttctggctctgcttctgtcgttgcccggggattagtgccattcgcgcttgggacggataccgcaggttccggacgggtgcctgctggcttcaataatattgtgggtttgaaaccaacaaaaggctggctttccgccaaaggtgttgttcctgcctgtcgactcaacgataccttatctgtttttgccctgacggttgaagatgctttcagtgttgcggatattgccggaggattcgacgaaaatgatgcttattcctgcataaatccggcatctacacccgcaacattgccggatcaccctctatttgctattcctgccaatcctgtattttgtcatgacacgattgctgaatccgcatggcaggaggctctgcacgagttgcaaaatatgggggccactcttcagccaattgatttcttggtattcaaccaactgggtgagcaactttatcagggagcatgggttgctgagcgcacgactgttgtgaatggcatgctcagttttcctgcaatgatggatccagaagtgcgccagattattgacagtggtaaaaattacagcgccgtcgatgcgtttaatgccgaatacctacgggcagaactggcgaggaagatccagcacatattagccggctttgatgctcttattgttcccacgacaccgacaatcagaacgattgaagaaattaaaagaacgccgattcactataattctgaacttggcatttataccaatttcaccaaccttgccaatctttccgcacttgccttgcctgcaccgttccgaactgatggattacccgcaggtatcaccttacttgcaccagcctggcacgaccgggcacttgcatcatttggtctacgctggcagcagcacctcgcattaccacttggtgctaccggccaattacttgatggggaagcgatggtgttaccaccatccgggcagcatattcgtttagcggttgtcggagctcatcttcggggcatgcctctgaacgaccaattaaccgaacgtaacgccgtatttgttgagacgacacagaccgcgagctgttaccgactttacgaactagccaacactcagccccccaagcccggattagtgagggatgacacaggagcatccatcagtattgagctttgggatattccactggcctattttggtgcattcgttgctgaaattccgccaccattaggcatcggttcactggagttagccgatggtcgctgggtgaaaggttttatctgcgaaccggttgcactgaaaggtgcaacggatattacagagttcggtggctggcgtaattgggttatcaatcaggagaaagacaatgtttaaaactgtattgattgctaaccgcggagaaattgcctgccgtgctatccgtactctgaaacggctcggaattgtcagtgtggctgtgtattcagacgcagataaaaattcacaacatgttaaagatgctgatatcgcattaccgataaacggggaaaaagccagtgagagttacctgtgtatcgataaaatcataagcgcagcacaacagagccatgcagaggccatctggccgggatatggatttttgtctgaatgtctactgtttgcacaagcgtgtgaaaaagcgggtattgtctttgttggcccgacatcacaccagattggtgaatttggcctgaaacaccgagcgagagaactggccgcagaagcaggtgtaccgatgacaccgggaacagggttgctcaattcactggatgaagcacttagtgccgctgagactatcggttatccggttatgctgaaaagcactgccggtggtggtgggatcggccttagctgttgttatgacgcaaatgcactgagtgaggcatgggagagtgtgcgccatcttggtgaacagtttttcagtgataccggtgtttttctggagcggtgtatcaggcaggcacgccatcttgaagtgcagattttcggcgacggtaaagggaatgttgtggcgctggaagagcgtgattgctctttgcagcgccggaatcaaaaagtcgtagaagaagctccggcgcctaatttgccggagcagacccgaacggcgttgctggattccgcagtacaattgggccagttggtgaagtatcgcagcgcaggtacggtagagtacatttacgatgtcgaacaggatgaattttactttcttgaggttaatacccgtctgcaagttgaacatcctgtgacggaatgcgtgaccgggcttgatttagtggaatatatgctgcgggttgcggctgggctacccattgactgggaggatttaaagcgggcaccggttggagccgcgattgaagtgcgcctgtatgccgaaaacccactgaaaaactttcagcctgctccgggtgttctgacggaagttaaattctctgaaggtatacgtatcgatagtggtgtgagcacgggcagtgaggtttccgcgttttatgatccgatgatcgctaaaatgattgttcatgcagaaaatcgagaaaaagcgctgatcaaactgcgtgaagcactggattcctgccaattgcatggcattacaactaatctggaatacctacgtcaaattacagccagtgaaccattccaaaaaggacaagtctggacccgaatgctggatagctttgaacctcaggcaagtgttattgaggttctgaaagcggggacatggagcagtgttcaggattatcccggccggtcagggtattgggatatcggtgttccaccatccggcccgatggatgatctggcttttcggttagcgaaccggattgtcggtaatcatgaatcggccgccggactggaatttacgctggaggggccaaccttacagtttcattgtgacgcactgattgcgctgaccggcgcagagagtagcgcattattagacgggacaagcgtaccttattggcaaccactaaatatcaaagcggggcaaatacttgagatagggcgggcacaatccggctgccgtacataccttgcggtcagaaatggcattgatgttccctgttacctcggaagccgttctacctttgctctcgggcaatttggcggacatgctggccgcatcttaaaaattgccgatatgcttcccatctcacagccagccttacccgcctgtacaactcccgcaccaatcagcctaccaaaggcacctgaacctgcctcgatccccgtttatggcgatatatgggatattggcgtactttatgggccgcatggtgcgcctgattttttcgctcaggattatatagatgaatttttctctgccgaatggcaggtgcattacaattcaaaccgtctgggtgtacggttaataggcccaaaacctgtctgggcgcgtcctgatggcggcgaagcgggtttacatccttcaaatattcatgactgtgagtacgccattggttctatcaattttacaggcgattttcctgtcatcctcacccgtgacgggcctagcctcggtggttttgtttgccctgttaccattgccaaagctgaattgtggaaagtcggtcaggtcaagccgggagatcgtatccgtttccatcccgtcagtatggaagaagcgattactctggaagagcagcaaaatcgtattattgccacgttgagatcaacgtcggaagcaccattaaaactagagcgaacattacagatagaagaagaacattctggtgccgtgctggcagcggtttccgccactcattctgctccggcggttgtttatcgtcaggcgggagataactatattctgatcgaatatggtgaaaatattctggatttggcgctgcgcctgcgggtacatctgttgatggaaaaactacatgttttagctgaaccgggaattaaagaaatagctccgggtgtacgttctttgcaaatccgctatgacaatcggcaaatagaacagcagaaactcatcgctttgttgctctctttggagaaacagcttggcaatgtcagcaccatgaaagtgccatctcgcattatccatctgccgatggcatttgaagacagcgcaacactgggagccgtggaccgttatcagagcacggtaagatccagtgctccgtggttaccgaataacgtcgattttattcagcgtattaacgggctggctgatcgtgaagctgtgcgccgtatcctatttgatgccagttacctgatcctcgggttgggagacgtgtatctgggtgctccgtgcgctgttcccattgaccctcgccatcgccttttaagctcaaaatacaacccggcacgtacttttaccgcagaaggaactgtcggtattggcggttcgtatatgtgtatctatggcatggattctcccggaggttatcagctggtgggacgaaccctgccgatttggaacaaatttctgaaaaatgaacagttcgaggaagataagccgtggctgttgcgattttttgatcaaatccgtttttatcctgttactgaagcagagttagaacagttacgggaggattttcaggaggggcgtactgctatccatattgaaaatacgcaatttgattttgccgaacacctgcactttctgaaagaaaatgccgaagatattgcctatttcaaactaagacaggcagtggcttttgaaaccgaggtcatgcgctggcaacaggaacagccggaagaagagcgttctgttcaggatggggaggaacagccacaagaagaagcggatcttaatgagcatggtttgcagattagtgcggatatgagcgggaatatctggaaagtactggtcaaatcaggcgatgacgtggaagaaggccagccgctgattattgtagaagccatgaagatggagctggcgattcatgctccacaggcgggccgggttacaaagattagctgtcagccgggaagtgccattagccccggagatgcg

SEQ ID NO: 24115 - DNA, 1080 bp, Xenorhabdus nematophilus
ttaaatatcttacacacagaatcatcatgtggttggggaggacaggagattcgtattctgacggaatctcagggtatgatgcgccgtgggcatcatgtggttatcgtttgctgtcttacttctacactctatcgtgaggcccaccattatggtgttcctgttgtggcgttgccgattgaaaaaaaacgcctctcatgttttacagcaatgcgccgctggttaaaggctgaaggccaccggtttgatgtcattaacacccacagttcgaccgattcctggctggtagctgcggcgagtgccacattaaagcgaatgcccccgatagttcggacccgacatgtttccactaatgtttcaacttccatagcgacccgctggctttatttaaaatcttgccgtcatattgtgacgacgggagaaaaattgcgccaatccctgcacacaaacaatcgctaccctttatcccatatgacatctgttcccaccggcattgatctgacccgttttcatcctgaaaataaacaggcgtgccgccaacgtattggaattgcagataaaccgacaattgggattgtggcaacaatgcgaacctggaaggggcaccgctatctgttggatagctggaaagctctccatcaacgttatccggagtggcaattactgtttgtcggcgatgggccacagcgaaaaaatcttgaaccatgggttaagcaggaaggcctgacggatagtgttatctttcttggcaatcggcaggatgtgccggactgtttaaactcaatggatatttttgcattgccttcttttggtaacgaaggagtgccgcaaggtattatgcaggcaatggcctgtggtttaccggtcatatcgacatcggttggcgcgatttctgaggctgtgattgatggtgaaactggctatattatcgagcctaagtgtgttgaacaattaactaataagttagaattactaataagaaatgcagaactacgtttacagatgggagatgcctcactgaaacgggcaatagctgaatttggtatggataatatgctggataaaatggaatctatatttatt

SEQ ID NO: 24116 - DNA, 819 bp, Xenorhabdus nematophilus
atggaaaatagaaaaatcacctttatcggcgcggggaatatggctcatgccatcatcgcgggtctgatcaacaaaggctatcctgccaaacaaatcactgcctgctcgcccaacacaattcgccgtgatgttctggcagaaaaatatggcatcaacagccagagtgacaatattcgctatgctcaggaagctgatgttattgttttggctgttaagccccaaatgatggaagaagtttgtagttccttgcgttcgcaagtcaattttgagcaaaaacttgttctttctattgctgccggtattcctctttcccgtttttactcatttttgcaggaaaatctgaatattatccgcattatgccaaatacgccctcacttatcgggcaagggatcagcggcatgttcgcacctgaacaggtcaatcaatctgatcgccagtttgctgaagtattaatgaacagcgtcggcaaagtctgctgggtaaatgatgaaaatggcatcaatgatattattgccgttgccgggagtgctcctgcttatttcttcctgtttatggaatcgatgcaacaggaagcagagcgtctgggcttcgacagccaaacggccagagaactggttctgcaaacggctatgggctcagctaaacttgctgaatcacaggcagaacttccttttgctatcctgcgtgaacaggtaacatctaaaggtggtacaactgccgaagcattacgcgttttttatgaaaaccatctgccggaagttgtatcccaagctatgcagggagcaatacgccgggcacaggaaatggaaaaattattt

SEQ ID NO: 24117 - DNA, 1260 bp, Xenorhabdus nematophilus
aattcaggcaataattttacgccagaaaaccttcttgctttgcccgaggtttacggaacgccattatgggtttatgacagcgatattattagcagacaaattgggaagctaaagcagtttgatgttatccgttttgcacagaaagcctgttctaatacgcatatcctgcgcttgatgagagagcagggtattaaagtagattcggtatcactgggcgaaattgaacgcgctcttcatgctgggtttcagcccggacgtgataaatctgaaattgtgttcaccgccgatcttattgatgaagagacgctggagcgtgtcattgaactagatattcctgtcaatgccggttccattgatatgctggaacagattggtcagcgtcagcctgcacatccggtttggctgagaattaaccccggattcgggcatggtcatagccagaagacaaatactggcggtgaaaatagcaaacatgggatctggtttcaggatttgcctttagctcttgagaaaattcatcaatacaacctgaatctggtcggtctgcatatgcatattggttccggcgttgactaccagcatcttgcgaatgtttgtaatgcgatggtcgaacaggttgtatcgtgtggagtcgatattcaggcaatttcagcaggcggagggttgtccattccctataaaaacggtgaggaagccgtggatacttgccattattataatttatggcatgaagcccgtcagcgtattgaacagcacttggggcaccatattaagctggagattgaacccggtcgttttttggttgctgaagccgggattttgatggcagaagtgagagccgtaaagtcaatgggaagccgtcattatgtgttggctgatgccggttttaatgatttgatgcgcccggcgatgtacggcagttatcaccatatttctgttttatctgagaactgtgacggaacccacagtgatattggggaaaatagcagtcgttctggcttgaaagaaacattggtagcagggccattatgtgaatcaggagatgtttttacccagctggaaggaggggaagtcatcccgcgcatgctacctgatatttcagtcggtgattatctgatttttcatgataccggtgcttatggtgcatcgatgtcttcaaactataatagccgccctttgatcccggaaatattgcttgttgagggacagcctcgtttaattcgtcgtcgacagacaatacaggaattgttatcactggaa

SEQ ID NO: 24118 - DNA, 1950 bp, Xenorhabdus nematophilus
atgcagctttatttatgtgaaaagccctctcaggccagagacattgccaacgttctgggcgtgaaacagcgcggacagggatttctcttcagtacccgtatcattgtcacctgggccatcgggcatttgctggaggtggctgcacccgaacagtatggtgaacaattcggtccgccgtggcggatggaggtgctgccggtgctgcccgtgcaatggcaatggacggtaaaaaaagaggccgctgaccaatttgccgtgatccggcagttattgaaacaggttgatgaagtcattattgccaccgatgccgaccgtgaaggggaagtcattgctcgcgagttgctggaatattgtcgtttcagcggtgcggtcaggcggttgtggttgtcggcactggatgacaccagtatccggcaggctctggcggccattttaccgggagaacagacggaagcactctatcaggccgggctggggcgggcgagagccgactggctgacaggtatcaatctgacccgtttttataccctgaaagcgcaggcactgggttttggcgaggtcttatccattggccgggtacagaccccgacactggcactggtggtgagccgggataaggacattgcgaattttgtgccgaaaccctactggcaggtgatggctaatctggaaaaagacactgtccgctttcaggctaaatggctgcccgctacggaggagggcgatgaagaaaaccgctgtacccgggaggctgtggcacaggctgtgcaacagtgttgccagcaggccacacaggctacagtgatggccgtcagcaaaaaacgggagaagaccccgccgccgctctgttttgatttgggcacgttgcagcagacggcatcccgtctctgggggatgggcgccagtcaggtactgacgattgcccagtccctgtatgaaacccataaagccacgacctacccacgcacggattgcgggtatctgcctgtgtccatgcaggcggatattccggtggtattaacggcactgacgcgaaccgacccggccatgattgatactatcagtcagctggacgaacaacaggtttcccgggtctggaatgacaaaaaaatcacggcccaccatgccattatccccacccgtcacgcttttgatctcacccggttaacgaccgacgagctacaggtttatcagcttattcgtcagcattatctggcgcagtttctgcccccgcaggaaacggatgtgacggaagtgacactggatatcggcgggcaatgcttccgggcgaaagggcgggtcaatgtgaccacgggctggaaagcactgtttatggaaaacttcgcggaagatcaggaaaaatcagaagcggattcatccctcccgcgctttcatcagggcgagcgctgccggattattgcagcccgcattcagccgctgcacaccaaaccgccggccccgtttaccgaaggcacgttgattgccgcgatgaaaaatgccgccagtctggtcagtgatccgcaattaaagcaggtcctgcgtgagaatgccggactgggcacggaagcgacccgtgccggtattctggacaccttgtttaaacgccggctgattgagcggaaaaagaaagcgattcagtcaacaccactggcacgggaactgattgccgggttgccggaggtgctgaccagtccgggcatgacggcgttatgggagcagtcgctggaggatattgcgcagggcaaaacatcgctggcggtgtttatgcagaaacaggcgcagtggctgttgcatctggtggaacggggtaaagcccagccctttcatctgacattaccaaaaacgccggactgcccgaactgtggtggtcggatgcgacagcggcaggggaaaacctccccattctggggctgtgtgaactatccggtctgcaaggggatgctgaatgac

SEQ ID NO: 24119 - DNA, 840 bp, Xenorhabdus nematophilus
atgtttcccggacagggagcccagtttcaaggcatggggcgcaacctgtttgataaatatgaatatcacatgaggctcgcacaacaagtattagggtattcactcgttaaggtgtgcgaaaatgaacccaatgtgcttaacaaaactgaattcacacagcctgctctgtttgttactaatattcttcattatttagatggcttggagaaacatgggacggaagctgaaatttttgtgggccatagtctgggtgaatattgtgctttgtttgccgcgggtgcttttagttttgaaacagcgctatctattgttcaagaacggggtcgatgtatggctctttgctctgagggagcgatggctgccgttattggtcttaaattagagcgggtagaatttttattagcggactctgaatttcctgatttaacgatatccaattttaattccccaacacaatttattatttcaggttctcaatctgaattatctcaatttaggaagagtgtattaaaggcgaaaggtatttttcatcctttacaggttaatggtgcatttcattcgaaaagaatggaaagcattgccagcgaatttaaaagcttccttgaaagtgttgagatttattcactgaaggctcaggtattatcgaatgtaacagcggattattatccatgcaataaccgtgatcaactcatcgatttattagttaaacaattatcgcaccctgtgcgttggcaacaatgcatggaaaaactatattctgataaatttatttcaagtaaacctattgttggttttgaatatggaccaaaaccggtggtagggccattagccaagaaaata

SEQ ID NO: 24120 - DNA, 14256 bp, Xenorhabdus nematophilus
gaatattctatcattggcgtagctgcacaattttgtggaggtttgtcattgtctcattattggcagacgttggttgaaggcggctctttgatgggagtgatcgacgaagaacgctatcaacttaataatcgccaaacgccggttaagtgggggatcaaggaaaagatacgcggtatgtttcttgaagatattgatagctttgacaggcatatcttccctctctcgggttctgcaattatgtttgcagacccacggcagagattatttctacaaacctgctggcaacttcttgaggatgcaggattagccgcatcaacgctagcaggcaagaaagtgggagtatttgttgctcaggatggctggtatttaaattcttatgtcgacagaattccagatgaacataaggaaagtcaggagtttattgtgccaggaaatgatccctgttttctggcaaatcgggtttctttctttttcaacttccatggcccatctattgttgttgatacaacctgttcaagtgcttttgtcgctttggatatggcatgtcaggcactggaagacggcgattgtgactacgctatcgtagggggaatttcgctgttcttaaatccctggaaagcgggagaaacaacagccacaccgtttgaaaccagcggagaggatattcacagtttttctgaaaaggcttcaggatacagaacttcagaaggatgcgcggctttacttttgcaaagaaacagcgatgaagtaaatcagcgccatcatgtttatggtgtcgtgcaggccagcggccataattctggtggtaaaactaattcatttgcccagcccaataaagaacaacaaatcaatctgtttcagaccgtattaaaaagagcgaaccttttgcctgagcagattaattatatcgaagcacatggcgttgcatcccaaatgggagatgcgattgaagcgaatgctttggtggatgttttcgcccgtccgcagaacgcggcaccctgctatgtgagtacggtcaaacccaatattggccataaccatgccagctccgggttttacgccatcatcaagggattgatggcgttcaggtataaccagatccctttgattcgcggattggataaagcgacgttgaatgccggcattccatccgatactcaggggattcagttcctgacagagacggttgactggccacaatctgagggaggaacaccccggcatatatttttcagcagttatgggttcagcaacgtcaatgcggctattgtcctgcgggaacccgataactcatctgccaccaaaataagccctctggtggaaacggtaacagaaaagccggtattggtttgtctgtctgcaaaaagtgatgaacagctttaccaacaggtagtcaatctgtgtaagacggtcagtgagccggattttactgagaatttcaatctgcatgaacttgcttggacacttagcacaggaagagaagcgtttacgcatcgttgggcaactctggtttcgtcaacagaacaactccggtgcgtattagaagcgtttactgaatcgccggaaaaacaatactcaacaatctatcagggaatattggcccaaaatgtacgggaagaagtattaacagctcaacgcgctgaacttgccgtggcagcaaataatgggtttccggtaacgtcattagaaactgttgcgagatgctggattaccggtgttgatattgactggatgcagtattggggagatgcggaatggcggcgtattcctttacctacctatccgtttgcgaaaacttgctattgggtgcctaaaggtgaaattcgcagcctatcgtcacaggaggtctcgtctcagaaaggagccagccaatttatccatccgtttgtccaccaaaatacttctgattttgcggaacagcgcttcagcaccacattttccggtgaagaattctgcctgaaggggcatgtgattcacggtatccgcgtattgccgggagtcgggcatttagagctggcccgcgttgcgtcacatcactctttcggctcaacaccgaattcttcgtcagaagtgaaggaaaaaaccggactggcgctgaaaaatgtcgtctgggcgcagattatcggtgtcattgatgaacctcagcaggtacatattcgttttatcaatcatggaaatggtgaagcaggttatcaactatatagcggggcagaagaagagacgatccataacaccggcgtagcgacacgaaaagcactcacgccagcacctgtctatgatattgacaacctaaaatccagatatctgcaaaacgcatactctcctaagcaatactatgacatgtattacgcgctgggcttatacatggcacctgactatcagggcattgaagaactttatgtggggatggatcatgtcttggcaaaactgtcactgcctgaatctttggagccaaccagagatcaatttgttttgcatccctgtttaatggatggggctcttctctcatccgtcgggcttttaatgcgttttggcgatctcaatcggcccattccacctaaatgtttaatcccttttgcccttgatgaaattgaatttcatgatgaagaatcccaattacactgggcctggatcagttatagctcagacagcagtgcttcggatcctttcccgaaagttgatgtcgattgttgtgatattaacggcaaggtgtgtattcggttcaaagggttcagttgtcggggattgggtgcgcagtctgcgccaccggcagaggaggcaccttatttattacagcctcagtggaaaaatcaggcgttgcctgctgatactgcattacgcgctgccacaaaacgcatcgtgttcctgtgtgaattagagagtcttcaatctgagctgttgtttaggtcagataccgacacatgtgaatatattgtattgcccaaaattcttcatgatgaatcgccgttaaaaaggcaacaaaacgttattacactctgtaaaaaaattgatgatctgattcagcattcccccacagaacccgtacttattcagttggtattaccggaagcccgtccggaatatgccatcgtgaccgcgctattaaaaacagcctatcagaacaatgccaatctgcttagccagacgatttattgtgatgatgaagatgggcttattgagaaattgtcagaggaaacctcacaaataaaatatgacaccgttctatggcaatcggaggaacgctgggttccacattggactgcctggacgcctgaaagtgattctgtggacaatttaacgcctccgtggaaagaaaaatctgtttacttaattgtcgatgaggatggcagcatggggcgtgcgattgccagagatattacaacgcataccgattcagctattgccattgttttgagtgaaagtgaaaagaaccaataccaaatcacaatagcatcaaagacgacaacgattaacgacagtgttatttgtcttgatacggtcacattagcggcacttgttagccgtattgagcaaaattttggcgcattgcggggcgtatttttctgtgtggggacacactttgcaacaaattcacagcatacagagaaccaagccttaacttcaatacttgaacgttatcagggactgtcacggctggagaaagtcactcagggggtgtcgcttgatttctttacagttctgacctatcgggatggtgtattaggtagctctgggtatcctctgttttctgcctattgtgctgcggtcaataactttgttcgtcacagtcaacagagtcctgaatcagcacaatatcaaaagcaaacactgtcattgatcctgcctcaatctaacggaacaaatgagggggaatttattcgccatatggcgcttcagtctttatatcaggcactacatgagagattcagtggtgaattgatgctgatggaaggcggaacaatagagcgtttcagagcagaaatgctgggaattcgtccttattatgaacctgctttctcgtcaactacagaaaataacgtcaactcactggccagtcaggagcaggcatcatccgatctcgaacctactgcggtggatttgattaagagggttgtgagcaaggcggtaagccttcctttagccgaaattgatgaaaatgctggcatggaaaaatatggaatagattccattttatccatcaagatgacggaagcactggaacaggatttcggtgtcctgccgaaaaccctgttttttgaatatctcaccatccgggaactggcggcttattttgttaagcatcatcgccttgttttactggaaggggcacaaaaccactcacaaaacaaaaacgttcagacatcatcaatctcagaagattctcgcctgtcagtacaaccgtttcccggtagaacagacaaaacagaaaacctttttgtttctcagacaggcgaggtagcgaataccacttccgagtcagatgatatcgccattgttggtctggccggacgttttcctcaggcaagaaatatgcgtgatttttggcagcttctgagagaagggcaggattgcattaccgaaatcccttttgagcgctgggatcattcgcgttatttcgacatggataaaactaaacgaggcaaaacctacggcaaatggggcggttttattgatggtgttgatgaatttgatccactgttttttaacctctcaccccgcgatgcgcgtgtgatgagtccgcaggaacggttatttttacaatgcgcctacgaaacaattgaggatgcgggatatagccacagaacactaggttcccgtgattggacacggctaccgaaaaagacaggcgtatatgtgggggtcatgtatggagaatatgagttttatagcatagaagaattggcaaaagggaacgtgctggagcagtctatcgtgacgggcagtttcggctcaatagccaatcgggtatcgcatttctttaatatcaatgggccaagccttgcggtcgataccatgtgttcttcctcactgacgtctatttaccttgcctgccaggcactcagacagggggatattgagatggcgctggcggggggcgttaatgtttctattcatcctaataagtacttgattctgggtcagtctaagtttttgtctgatgaaggacgatgccagagttttggtgagggaggaaccggatatgttccgtcagaaggggtgggagcggttttactgaaaccgttgacgaaggctattgcagatggcgaccatatttatggtgttatcaagggtatcgccgttaatcacggtggtaaaaccaacggttacactgtccctaaccctatcgcacaagctgaggtgatttctcaggcgatccagtcttcaggggtgtctccgcgtgccattagctatattgaagcacatggaacagggacttcactgggagatcctattgaaatagcgggtctcagccgggcatttcagcaatgtttacaggataacgacacacaggaaagcgcattctgtgcaataggctcagtaaaatctaatatggggcactgtgaaagtgcggcgggtattgcaggtgtcgccaaagtactcatgcaaatcaagcaccggcagttagtgccttctttacatagccgtgaattaaaccccaatattgattttgacgcctctccgttttatgtgcagcgtgaacttgcagattggaaaagaccgctgttgggtgagctaggtcaaaacaaagaagagcaatcagaacatcccagaacagcaggaatttcatcattcggagccggaggaaccaatgctcatttggttgtacaggaatacattcctgctaacgacttaaactccatcaataataccgactggccaaaatgggctgttatccctctatcagcaaaaaatcacgaccagcatcgtgaattggcgcaaaacttatcacagtatcttaaagagcaggcgaaatggtattcagaggtgtccaaagcagaatatctgcatagtcttgcctataccttacagacagggcgggaagaaatggaagagcgggtcacctttatggttgattccctttctgccctgattgatagcttaaaggttttctccctgtcctgcttaccctcagcgcatttctggatgggacgagtagaaaaatctaaatcagcaaaacagctaatgacacccgtttatgcaggaaaagataagcaggaagaagaatacgagcagttacagcaaatcgccagcgcctggactcaggggcatgacattgattggcaggggtattatcaatcccttcctgtacggccaaatcgcctcagtttaccgacttatccttttgcccgggaaagatactggatacctgaaccggaagctcagatagccgattttgctgttgcagtggaagagatagattcaacgaaagagatgacctcgacggtgctatatacatcgggttgggaacgatgtgatattagtcagagtacgacgtatgcaatgaagcccaagcatactgacctatttgtcattgggaatgccaatgaaacctcactgacagagctggctttgttaactagtgtggataacgtacattatctccgtacagaaaatgaccttcatactgatagcctgcattcaagctctttatctgatcttgttttgcgattaactaattattgccagcagcgaatccattccggtcagggattaccgacattcattgcggtttttgcaccatggaaaaataacggattaccttaccgcgctttattgggggcactcagaaccctcagcatggaatttcctgtggtacagacgaaacttattctggatgcggcactggataatgcagatagtgaaactttcatccggcatgcagaaaaagaactcctttctttagatcaactttcatctgctgtgtgctatcaggaaaaagaccagcgctttgtctggcgtcaaaaagcggtagaaccgacagacttaacgaatcttccttcgttgtttactcatgaatgcaggacgatttggattacgggtggtctgggaggattgggataccagattgcacaatatatcggtacaaaaacaggcgcacagcttgtgttatcagggcgttctgttcttgatgctgataaagaagctcaactggactcactaagaaaacgcggaataaaagccgaatatgtgccatgcgatgtgaataactacgctgcactggaaaaaaccatgctgcttatccgccagcgttttggtgctctgcatggcgttatccattgtgccggtgttatccatgatgctctgactatcaataaaacagaggaagaaattgaccatgtgatcgccactaaggcatcagcggcttgtctgctggatgaagtgactcaacacgaaccactggcattttttgtcatgttctcctcacttgcctctctgggaaatatcggccagatagattatgcggcggcaaacgcctttctggatacatttgctgaatatcgtgaagatttagttcagcagaagcaaaggagcggaaaaagcctgtcaattaattggcctctttggcaggaaggcggtatgaacgtgacaccgagagtagcaaaacacatgtttgatacctttggtatcgtcccgttggatacaaaaaccgcactggaaatactggaaattgcgattcgctcaccgttctctcagtttggtgtgatgaaggggaatgagcaaaagattaaggattacctgagattatctgacgattctttacctgttacaccgctgtctgtatcagatcacaaagattcggatatcacatttaatgataagaatatggattctgttaatccgagtgagtcagataaaagtgagtcaggtaacttgtctgccgccattgcggatattgcagccggaaaattatcagaactactgggaatgcgtagcgaagccatcgatattcaccggcagtttggcgattatggcatggattctgtcggactcattgagctggctgagtatattaattctcgttttggcgtcactctgtcacaggcgagttttctggagttcaacacattaaaccgtgtggcagagcacctgatacaactgttgccagagccgagcattccagtcccttccgacattttgccttctgacacgtcatcttccgacataccagacgctgtcagcacgccttcttttgccattgtgggctatgactgtacatttcctggtgcaaaaaatgcacatgcgtactggcagaatattgtccaaaaaaacatttctattcaagggatcacgcaggagaaatggcagcaacgccatattctcactccttccgataaagaagatgcggtaaaacgcatgcagttattcggttttttaccggatatcgatcagtttgatgctgaattttggggtattgatgccgaaacggcaaaacagatagatccgcagcaacgcctgcttatgcagtgtatctggcgatgtgttgaacatgcgggttatgacttggaagacttcactcagcgtaaagttgggttatttgttgccgctgattccacagactacaaatccctgattaaggatcattctctgattaacaacatcgaaggttgtggcgggttacaggcgggcctcagtctgggcatgatggtaaatcagatctcctatttcttcaatttcaccggcccgagtgaagtggttgataacgcctgcgccagtgtgtttgttgcgctgcaaaaagcccggcaggcgatcctacagggtgattgtgacgtggcggttgtcgcgggggttaaagtcatccttgattttatggagttttatatccgggatcagggaggcattctcagccagtcaggaaaaatggcgccttttgactacacggcagatggctatatccggggtgaaggtgtgggtgccgtcatgattaagcctctggaacaggcacatctggaacgtgaccctgtccgggccatcatccggggtatcgggatttctcataatggtcggagtgctttttcgtcgatggcaccgagtgttgagaaacaggaagagaatatcaaaaaagcctatcagacagcggggatcgatcccttgttctgttgactatattgaagcccacggttctgcgactcaatttaatgatgtcagtgaagttgcagcttttaaaaaggttttttcagaaaatcagaccgattcacatcgttgtgtcatcagcgcagtgaaaggcaatattggtcatctggaagccgcttcaggcatggcctccctgattaaggtgattcttgctatgcagcatggcgtcattccaccgattgcttctttctctcaattacatccttcgatttttattgagaacacgcccttgttctttccgcgtgagccggttctgtggcaacaggccagttcagacaaaacacagccaagacgggccggattgaactcgattggaatcacgggagttaatgcgcatgtcattttggaaacccctgaacagcgcgaagtgccggttttctcccaaaggaaagaacacgtccttattcctatttcggcgaaatctgagaaaaccttaaaggtgtatctgagtcagtggctggattatgtgcatcaagaaaaattagccggtcatgataaccccacgacgttaagaaatctggcttacagcgcccagacggggcgtgcggatatgccgttccgcacggcgatcattgtcaatgatttagaaaaactcatcgcaacgctggagtggatgatcacaggagaaaacggaacgccgccagcgggggtggttgtgacgggtgttgtttcttcaaaaagccgcttccccaaaaagcaggttgcattttccaccacattgcccgtgttgaaacaactggcggacgattgggtcacaggtgcctgtatagactggcgggcttttgcgcaggggcacggagtttacgttgacattcccggttacccgtttgacgaacagcgatattggttcctatagggaacccatttttagaaccagaaacacgcaaattcacgccgttatccaagagataacggcacaacaatatattggaaaaggaagtaaaaagatgagtgaagttaatgaaaaaaataatttattggactcattgaaaaccatcgcaaaagaaatattgcagcagagcggtgatattagtactgaggcacatattcaggatctggggtttgattctaaatcgctggttatctttacggataaaatttccggtgtgctggataaagaggtacatcccggtgtgttatttgagttcaccacgctggagaaatttgctgattatcttatgaattatcagacatcagcagcgaagcgatttctaaccgccttatcctcacccacattaacagaagaaacattaactgcgggaaaggtgtgtctttctcaaggaaatgaaaacagctgtcagaaaacctgctcctctaaaaatacgaatgatcttgcctatatgacgggaatgacccggggcatagaacaaaacatcccggtgattataggggggggtattgcaggtatgctcatcagctatcagcttagtcaggagaagatcccgcatatcatcgtcggtaagccggaaattggtgatatgccaaaactgggtgaatcaatgaccgaggtagtcagtattgaatttgcccgccgttttaaaaatctgtcccgacatttctatcccaaagagttcacgccattttttatgggggaattagttgccgggttacggttccattttttcgaatcgctggcttcgcttttcatggaagaagatattcctgaacattttattcatatcgacaggctcggatttgataaggcgctgtatgaagagactgttgcggcttctgaatgtacttggattgaagccttagtagaacatgttgaatattctgaggacagtgacaaagtttcattacttcatctgtccgatggacagattattcaaccttcttatgtttgggattgcaccaaccatgtccgtttattagggcgcaaaatcgggctttcctataccgagctggacagccgccgacaggtgatttttacccattattatcaaaaagcgggtagtaaactttgtgattccaaagagcttccctggatgcacgcaacatcattgctgagtgcagatgaagagttcgatcagctgaaaggcgtttcctggctaataccgctaggtgattatgtctccgttggtatcagtatgctgcctgacgatgtgagagatcgcacagcagaagagattattgccttgctgacaaaagcctaccagagacggggattagattactcagcacatttcacctgccgtcgggaaatagtgagcctcccgacccaacatttcatatatgaacgatttaccggtaagaactgggcactggttggcggaagtgggatcagtacatggtttacctccggctcaaatttaagtatcgcgaccctgatgtcctctatcgcgccaaaaatcattcagtcaccggaactctacggtgaatattacaccacgcatgtccgtggttttgcgaaaacacagacgatttatgatgctttcatggaatcaaatattggctccgtggatgcgcttaagtttttaagtggcgtggttgaacaggcaagaagtcgtatcacgtctttcttcctgcttgatgaaatagagggaaaatccagcggtaaagtggctcgtgagctttggcaggaaaataccgccattgataaggaatacttcgattttctgagacagatagccactcatgcccgtcccgaagatcgtcagcaacaaactgatttgatattccagaagctcatgcagttagagtcaatggaacatcaggtacgactgccttacttaaaagacagcaaagtaagacaggaaaaacctcaattattcatatgattatgtaatggatggcatttctatgaccgataaaatgacttggctattacaacatccgtatgcagagtttgttctgggattgaaagcggcatgggaagatgatctgtcttctgacgcctttaataatctgtttgctcaaaactgtgtgtgccatatgcagagtaacgagttaaatgatgctcaggcgtttcagacatttattcagtcagtcaggctgaacacggctaatttaaaacttatcccggaaagcgtgattattcaggatgatattctgcatctctttcaccgttggaaagcggatcgctggcatgatgagattatttccggtggcgaatattcaaatttttgtcagatagcaatacgcatcaatgacggcaaaatcgttgaattatggcaacaggtgcaggactttctttttttggttggcatgccgctttctgaagcatgtttgtcttaccctgcctggcaacaacgtgtgttggttaacaaagaaaaggagggtttgcatgtagcctctgatgaacagtccatccgaatgagtgagaaggctaaacagcttgttgattgtgtcttcaatcagggttcattgcgccacattgacagcctgctacacccggagctggtatttcataatggcaatgtcaccggtcatggaattgctgaatggaaaagttttatttacgcattgcgaacggcaataggaaaggagggagttacactatttgatgagttatttattcgcgatgagaacactttaacgttatttgtccgaatggaattaacccaagcctctccctttgttttatcccgcctgaatggcatgttttgtgtattaaagctggagatggacgaacaccgcatcacgaaaattcaaacgtatcctgagaattacttgtttttcttaggcattgattttcctcagcatgaaacgcgtcttaaacagctttttcggggaaacaggctacctttagagataaaatctcagccgaaacatgaagccgagataaaaatgccaccgttctctgaatctgttcggaatgagcaagtggcgattgttgggattgcagggagttttccgcaggcggattctgttgatcagttctggagaaatctgcttgaagaaaagtccggtttttcagcttttcctgaagatcgtccgtggctgtctgcgggaacaatcattcgttctgccgggtttattaatgatattttccggtttgatgaacagtatttccagatcccaccagccgttgctcagtatatggatcctcagcatcgtttgttgcttgagattattaatcaaagcattgaagacagcggtcatgctaatcaggacgtgagcggcgatcgtactgcgctgtttgtttcagctttagctaatgattacgaaaagctgctgagagataagggcgtagaggagaatttctactattgggctggtaatgagcctgccatgtcatcgggtaggatagcccgattccttgatattcaaggccctacccaatttattaatacagaatgcacgggaggcacaacggcattgctgggagcgtgtgatttgattcgctcagggcaggtcgatcaggctattgtcagtgcaagcagccttttcctgcatccttacggttttattgcgcgtgaggatggaattttgtcgtccgcggcagcacctgaattgtttagcaagcgaagcaaggggcaactcaggggagaagcggtcgtctctgtgattgttaaatcattgtcgaaagcacaacaagatggagatgatatctatgccattatcgctggtggcgcggcaaataatagcggaaggacattttccctcatttctgccaatgttgaacagcaggctaaaaccatcagtaaagcctggcaaaattcgggggtatcggcagatgatttctccgtaattgagtgtaacgcatccggcgtcagagcaggagattttacagaaatcaccgctctgaaaaaagttttcctgccccatcagcatattcatctctccacggtaaagggagctatcggacacactgaggcggtttccggtctggtggcactggtaaaagttctgctgcaattgcgtcatcagaccattatcggcactcagggactcagcgagattgatgacagcttagggttagagggttccggactttatctcaatcatcatcatcaaaaatgggactccactatacgggaaggagaggcgttacccagaattgccggtattaattcatttgccggaggtgggtataacacccatgtcgtggttaaggaatttatcaggcaagaaaatacgagcgttaagcaagcaacgatgccggtgctagtcccgctatca

SEQ ID NO: 24121 - DNA, 531 bp, Xenorhabdus nematophilus
atgtctgaatttgctactgtagctcgcccctacgccaaagcagcttttgactttgctgtggaacaccaatctctcgaacactggcagaacatgctggcgttcgttgcagaggtaacccgcaatgagcaggttggtgagctgctttccggttcattagcaccggaaacgttagccaatacctttatcactctatgtggtgatcaggtagatgagcatgctcgtaactttattcgtgtcatggcagaaaatggtcgcttgctggtattgccagaagtcttcctgcaatttatccaattgcgtgcatcactggaatcaacaattgatgttgaagtgatatctgcgtccgaactgaatgagcagcagcaggctaaaatttctgcggcgatggaaaaacgtctgtcacgcaaagtgaagctgaattgcaaaattgacaagtctgttattgccggcgtgattatccgtgcgggtgacatggtgatcgatggcagtattcgtggccgtctggatcgtttaacagacgtcttgcagtct

SEQ ID NO: 24122 - DNA, 1539 bp, Xenorhabdus nematophilus
atgcaactgaattccaccgaaatcagcgaactgatcaaacagcgtattgctcagttcaatgtggtgagcgaagctcacaatgaaggtacgattgtttccgttaacgacggtatcattcgtgtccacggtttagccgatgtcatgcagggtgagatgatcgcactgcctggcaaccgttatgcaattgcactgaacctggagcgagactccgtgggtgcggttgttatgggtccgtatgctgacttggccgaaggcatgaaagtcaaatgtactggccgtattttggaagtacctgttggtcgtggtttgctgggtcgtgttgttaacacactgggtgagccaatcgatggtaaaggcgctgttgagcatgatggtttctcacctgtagaagttattgctccgggcgttattgatcgtcaatccgttgaccagcctgtccagacaggttacaaatctgttgatgccatgatcccaatcggccgtggtcagcgtgagctggttatcggtgaccgtcagacaggtaaaactgcactggcgattgatgcgatcatcaaccaacgtgattccggtatcaaatgtatttacgtagcgattggtcagaaagcctctactattgctaacgtagttcgtaaactggaagagcatgacgcactgaaaaacactattgttgttgttgcatctgcttctgaatctgctgccctgcaatatctggcaccatattctggctgtgcaatgggtgaatacttccgtgatcgtggtgaagatgccctgattgtttacgatgacctgtctaaacaggctgttgcttaccgtcagatttctctgttgctgcgccgtccacctggacgtgaagcattccctggtgacgttttctatctgcactcccgtctgttggagcgtgcagcgcgtgttaacgctgaatatgttgaaaagtacaccaatggtgaagtgaaaggcaaaaccggttctctgacagcactgccaatcatcgaaacacaggcaggtgacgtttctgcattcgtaccgacaaacgttatttccattactgatggtcagatcttccttgaatctgctctgttcaacgcaggtattcgtccggcggttaacccagggatttccgtatcccgtgtaggtggtgctgctcagactaagattatcaagaaactgtctggtggtatccgtactgctctggctcagtaccgcgaactggcggcattctcccagtttgcatctgatctggatgatgcgactcgtaagcagctggatcacggtcagaaagtaactgagctgttgaaacagaaacagtatcagccaatgtctatcgcacaacaggctctgtctctgtttgctgctgagcgtggctatctggaagatgtcgaaatcgcgaaagtggtcagtttcgaatctgcgctgttggcgtatgctagccatgaacatgctgatcttctgaaagagattgaccagtctggcgattacaacggagagattgaagcgaagctgaaagctctgttggaatccttcaaggcgactcagtcctgg

SEQ ID NO: 24123 - DNA, 861 bp, Xenorhabdus nematophilus
atggccggcgcaaaagagatacgtaccaaaatcgccagtgtgcagaacacgcagaaaatcactaaagcgatggaaatggtcgccgcgtccaaaatgcgtaaaacgcaggaccgcatggcggccagccgtccttatgcagataccattcgcagcgtgattggacaccttgcgttaggtaatctggagtacaaacacccataccttgaagagcgtgacgttaaacgcgttgggtacgtggttgtttctactgaccgtggtttatgtggcggtttgaacattaacttgttcaaaaaattgctgatagaaatgaaagactggtctgataaaaaagtccaggttgatttggcacttattggatcaaaagcggtttctttcttttcttctgttggtggcaacgttgttgcccaggtaacagggatgggagataacccatcattgtccgaattgatcgggccagtcagcgtcatgatgcaagcatatgacgaagggcgtctggataaactgtatatagtgacaaacaagttccacaatacaatgtctcaggttccgacaatcactcagttattgcctctgccagccggagacgatgaaacactgaagaagaagtcctgggattatctgtatgaaccagatcctaaggcgctgttggataccttgctgcgtcgctatatagaatcgcaagtttatcagggcgtcgttgaaaacctggctagtgaacaggccgcacgaatggtagcgatgaaagccgcgactgataacggtggcaacctgatcaaagagttgcagttggtttacaacaaagctcgtcaggccagcattactcaggaactcaccgaaatcgtttcgggtgcagctgcggtt

SEQ ID NO: 24124 - DNA, 1380 bp, Xenorhabdus nematophilus
atggctactggaaagattatccaggtaatcggcgccgtggtggacgtcgaattccctcaggacagcgtaccaaaagtatacgatgcccttgaggttaaaaacggtgaagaaaaactggtgctggaagttcagcaacagttaggcggcggtatcgttcgctgtatcgcaatgggtacttctgatggtctgcgccgtaatttggaagtgactgatttaggtcatccaatcgaagtccctgttggtgaagcgactctgggtcgtatcatgaacgtactgggtgacccgattgatatgaaaggtgacattggcgagcaagagcgctggtcaattcaccgtactgcaccaagctatgaagagttatctaactctcaggaactgctggaaaccggtatcaaagtaatggacctgatctgtccattcgctaaaggtggtaaagttggtctgttcggtggtgcgggtgtaggtaaaaccgttaacatgatggagctgatccgtaacatcgcgatcgagcactccggttactctgtatttgcgggtgtaggtgaacgtactcgtgaaggtaacgacttctatcatgaaatgacagactccaacgtactggacaaagtatctctggtatacggtcagatgaatgagccaccaggaaaccgtctgcgtgttgctctgaccggtctgaccatggcggaaaaattccgtgatgaaggccgtgacgttctgctgttcgtcgataacatttaccgttataccctggcaggtaccgaagtatcggcactgttgggtcgtatgccatctgcggtaggttatcagccaacgctggcggaagagatgggtgttctgcaagaacgtatcacctctaccaaaactggttcaatcacttccgtacaggctgtttacgttcctgcggatgacttgactgacccatcaccagcaacaacctttgctcacttggatgcaaccgttgtactgagccgtcagatcgcatctctgggtatctatccagcggttgacccactggattcaaccagccgtcagcttgatccactcgttgttggtcaagagcactatgacgtagctcgtggcgttcagtctatcctgcaacgttatcaggaactgaaagacatcatcgcgattctgggtatggacgaactgtcagaagatgacaaactggttgttgctcgtgctcgtaagatccagcgcttcctgtctcagccattcttcgttgcagaagtatttaccggttcaccaggtaaattcgtttctctgaaagacaccatccgtggcttcaaaggcatcctgaacggtgattatgaccacctgccagagcaggcgttctacatggttggtaccatcgaagaagctatagaaaaagctaagaagctt

SEQ ID NO: 24125 - DNA, 1827 bp, Xenorhabdus nematophilus
atgtgtggaatcgttggtgcagtagcacagcgtgatatagcagaaatattgatcgaaggtcttcgtcgtctggaataccgtggttatgactctgcgggtatggctgtcgttgacagcgaaaatcagatgactcgtctgcgtgaagtgggcaaagtacagatgctggctgatgaagctgataaacagcctgttatcggtggtacaggtattgctcatacccgttgggcgacacacggggagccaaacgaacgcaacgctcaccctcatgtttctgaacatattgcagttgtgcataacggcattattgaaaaccatgaagagctgcgtgaagaattgaaagcacgtggttatggtttctcttcagataccgatactgaaaccattgctcaccttgttcactgggaacagcaacagggtggctcattgctggaaatcgtacagcgtgttatcccacaattgcgcggtgcttatggcaccgtcattatggatagccgtcagccagacgtgctggtggctgcgcgttccggtagtccattagtgattggtctgggcgttggtgaaaacttcctggcatctgaccagctggcattactgccggtgactcgccgctttatctatctggaagaaggtgacgtcgctgaaattacccgccgcacagttcgtatttttggtgtgcagggcgaagccgttgaacgtgagcagatcgaatccaacgttcagtacgatgcaggtgacaaaggtgtttaccgtcactacatgcagaaagagatttacgaacagccaatggcgattaaaaacacactggaaggtcgtgtgagccacggtgaaattattctgtcagaactgggcgctaacgcagcagaattactgtctcaggttgaacacatccagatcgttgcctgcggaacgtcttttaatgccggtatggtttcccgctactggtttgaatcactggcgggtattccgtgtgatgtagaaatcgcctcagaattccgttaccgtaaaccagcttgtcgtaaaggcagcctgctgatcaccctgtctcaatccggtgaaacagcggacactctggcagcactgcgtttatccaaagaactgggttacctgacttccctgaccatctgtaacgttgcgggttcctctctggtacgcgaatcagactttgccctgatgaccaaagcgggcgcagaaatcggcgtagcatccaccaaagcatttaccactcagctaactgtattgctgatgctggtggcttacatgggacgcctgaaaggtgcggatgattctcttgaacagaatatcgttcatgccctacacgcgttaccaagccgcattgaaagcatgttgtcgaaagacaaagtgattgaagcattggcagaagacttctctgaaaaacaccacgcattattcctcggccgtggcgatcaatatccgatcgcggttgaaggtgcgctgaaactgaaagagatctcttacatccacgcagaagcttacgcagcgggtgaactgaaacacggcccactggcactgattgatgctgatatgccggttatcatcgttgcaccaaacaacgaactgctggaaaaactgaaatccaacatcgaagaagtccgcgcccgtggcggtcagctgtacgtcttcgccgatcaggatgcaggtttcaccgacagtgaaaacatgaagatcatctccctgccacacgtagaagaactgatcgccccgatcttctatacagtgccactgcaattgctgtcttaccacgttgcattgatcaaaggtacagatgtggatcagccaaggaacttggcgaagtctgttacggtggag

SEQ ID NO: 24126 - DNA, 879 bp, Xenorhabdus nematophilus
cagtcaacctctgctgacagtacacttctggataaaaataaacaactttctcccgcaataacttcccgttcagaaaatactaaacaagctgattcgctctatcaatcattgataacggcttctcaaaaccgagttatggatacacctgaattaaaagctaatgatattgcaggaaaacattcaaaatttattgattatgcactggctcaggtcacccgtgatgtttatcgccgaaatagttttggcattggtgactatgtacgcatgtcagatgaagagctaattaaagcgggtattgaccctgatactttggatgatcgttctacagggtttcaggctggggtttatcgaaataaggggttatatattgtgtcatttaccggctcaaacgaaataaaagattttatggcgagtattcgtcaggggcttggatacaatgaagcacaatataatcaggcggtagatctggcaaaatcagcattaaaagcatttggtgagaatgttatttttaccgggcactcaatgggaggagggctggcatcaatggctgctctgacaacaggaaagcctgcggttacttttaattctgccggtgtttcagactggacactgaaacggatgggatggtcaccgggagctggtcgtgaaatggcagagcagggattaatccggaattatattgttgaacatgactggttagataatctgcaaaaagcattaccaattcctcagcccatgggaagtcagattcttcttgaatatgaatacaagccggaaaatttcatcgattcgattgtgcgctatagctatgcgttacattcattcaaggctcattttttggaagctgtgcaggaattaatggttattcataggccgtgg

SEQ ID NO: 24127 - DNA, 1335 bp, Xenorhabdus nematophilus
atgactgcgacaaacttttccgacttcgaacttgatgaatgcctgcttgatgcattaaatgataaaggctatgaacgcccgaccgcaattcaggcggcagccattcctgcggccatggacgggcgggatgtattaggttctgcaccaacggggacaggcaaaacagctgcctacctgctaccggctatacagcatttgctggatttcccacgtaagaaatcagggccaccacgtattttgattttaacaccaacccgtgaactggcgatgcaggttgcagagcaggccagagagatggctgcacatactcatctggatattgccacgattactggtggtgtagcctacatgaatcatgcagaagtgttcagtgagaatcaggacattgtcgtcgcaactacagggcgtctgctgcaatatatcaaagaagaaaactttgactgccgtgcagtagaaaccctcatccttgatgaagccgatcgcatgttggatatgggttttgccaatgatgttgagacgattgccggagaaacccgctggcgtaaacaaaccatgctattttccgcaacgcttgaaggcgaaagtatccgtgattttgcggtgcgcctgctgacagatcctgttgagatcgatgcagaaccttcccgtcgtgagcgtaagaaaatccagcaattttattatcgtgctgataatctggcacacaaaacagccttgttatgccatttgctgaagcaagaagacgttacaaaatcgattgtttttgtacgtaaacgggagcgtgttcgcgaattggttgaatggctgcatcaggcaggtattcagtccagttttcttgaaggcgaaatggtacaggctaaacgaacagacgccgtgaagcgcctgaatgatggccgggttaaggtgctggttgcaaccgatgttgcttcccgtgggctggatatcgaaaatatcagccacgtttttaactttgatttaccacgcacagcagatgtttacctgcacaggattggccggactgcccgcgctggccgcaaaggaaccgcaattgcgctgattgaatcccatgaccatccattacttggaaaaatcagtcgctatcttcaggaaccactgaaagtgcgggttgttgacgaacttcgtccacaaaccaaagcaccaagtgagaataaaagctataagccatccaaaaaagtgctggcaaagcgtaaagaaaagaaaaaaacagaagaatcgaagaaaaatcgggtgaaagtgcgtcatcgtgacagcaaaaacatcggaaagcgccgcgctccttcaggaaaccctaaaccagaattgccagaatctactgac

SEQ ID NO: 24128 - DNA, 716 bp, Xenorhabdus nematophilus
cagaaaaaaagcatgaacccgattcaatcggttcgtgctgatttatatagttgcaatataggctgatgtgctgagataatttttccatctgatctcacatttcactcatgaggtttcagtttaggtcccgcggctaatctgattggcggggcgggttatcattaacaaatagtcttagtaataccaaaaacatggcagagaaacgcaatatctttctggttgggcctatgggtgccggcaaaagcactattggtcgtcagttagctcagcaactcaatatggagttttacgactccgatcaagaaattgagcgacgtaccggagctgacgtgggctgggtattcgatgtggaaggcgaagaaggcttccgtgaacgcgaagaaaaaataattaacgaactgactgagaaacaaggcattgtattggcaactgggggggggtctgttaagtcaaaagaaacccgcaatcgtctgtctgcccgtggtgttgtcgtctatttagaaacaactatcgaaaaacagttagctcgtacccagcgcgacaaaaaacgccctttacttcaagttgatgcaccagcacgtgaagttttagaaaatctggctgatgagcgcaatcctctgtatgaggaaattgctgacctgactatacgtacagatgagcaaagcgccaaagttgtagctaatcaaattattgaattattggaaaaaaattaattt

SEQ ID NO: 24129 - DNA, 1086 bp, Xenorhabdus nematophilus
atggaacaagtgattgttacgttaggtgaaagaagctatccaattaccatcgcccaagggctgttttcgagcagtgaagcattcaggcccctgcaatctggtcagcaggtcatgatagtgaccaatgaaacactggctcccctgtatcttgaacaggtgaaatccacattgctgaatatgggccttcgggtgaatgaagttatcttacctgacggtgaacaatacaaatcactttttgtgctcaatgatatattttcggccttactggaaaataatcatgctcgggacacaacgcttatcgctctcggtggtggtgtcatcggtgatatgacgggttttgctgctgccagctatcagcgcggcacccgtttcattcaggtgcccaccactctactttctcaggttgactcttctgttggtggaaaaaccggagtcaaccaccccctcggtaaaaacatgatcggggcgttttaccagcccgcctctgtggttattgatctcaattgcttaaatactctgccagcccaagagctatatgcagggctagctgaagtgatcaaatatggcgtgatcctggacggtgaatttttcgactggcttgaaagcaatattgaaaaattattggatctcgatcatcaggctatggcttactgcatccgtcgttgctgtgagctgaaagcccttgttgtagcggccgatgagcatgaacgctcaggtatgcgggctttattaaatctcggccatactttcgggcatgcgattgaagctgaaatgggatacggagtctggctgcacgggcaagcagttgcagctgggatggtcatggctgcacgggcttctgaacttgttggctcattctccggtcaggatacacagcgcatcatcagtctgctggaaagagcaaaactgcctgtacatggcccctcagaaatgcctcctgaaaattacttacctcatatgatgcgcgataaaaaagtcactgcgggcaagcttcgtctggtattacccacagctatcgggaaagcagaacttcgttctgatatcagcaccgatatcatattagatgccatccgacgttgtagtgaa

SEQ ID NO: 24130 - DNA, 693 bp, Xenorhabdus nematophilus
aatgtagtacaagcaattcaggccattgcattcgatctggatggaacgctggtagacagcgccggtgggctggcagatgctctggatcaggccttgctcaccaaaggtctgcccgcagcaggcaaagaacgcgttgctgtgtgggtgggtaatggctcggacatcatggttgaacgtgccctgaaatgggctgtcggagagttttcccctgaactgttcagtgaaacccgcagtctgttcgataaattctatgaaactaccgtcacgacgggcagcaaactgtttcctcatgtcaaagaaactctggctgagctggcaaaacacaacctgccgatggcgattattactaataagccgacaccttttattgctccattactggaatctcttggtatcagtcaatacttttcactggtactgggaggagacgatgttaaacagaaaaaacctcacccggcaccactgtatctgacaatgggcatgtttggtttaaataaagacgaattgctttttgttggtgattcccgtaatgatattttggctgcacaggcggcaggctgcccttgtgttggcttaacctatggatataactatggggaatcgatagcactaaatcacccggattatgtactagacaattttccggatttactaccaacaattggattaccaactttgaacttacaggaagcg

SEQ ID NO: 24131 - DNA, 1845 bp, Xenorhabdus nematophilus
taccaacgttcactacaggatcctaaggggttctggggagagaaaggtaaaattgtcgattggataaaaccttatacaaaggtgaaaaatacctctttcgaccctgggcatatcagtatccgatggtttgaagatggcacacttaacctaagtgcgaactgccttgatcgccatttacaggagcgaggccatcagactgccattatttgggaaggggacaatccggctgaatccagacatgttacgtatcaggagctataccatgatgtctgccagttcgccaatgtcttgaaaaaactcggggtcaaaaaaggcgatgttgtcgctatttatatgccaatggtgccagaagctgctgtcgccatgctggcttgtgcccgggttggcgcgattcactccgtaattttcggcggcttttctcctgatgcaatttccggtcgaattatcgattcaaatgcgaagttaatcatcacagccaatgaaggtttacgagctggccgagttgttcctctgaaaaaaaatgtcgatgaagctctaagcaatccggctgtgacaaatgtgactaatgttgtcgtcttcaaacgtactgataatgcaacaaactggcataccggacgcgatctctggtggcatgaattaaccaaagagattagttcagattgccctgctgaagagatgaatgccgaagatccgttatttattctttatacatccggttcaacgggtaagcctaaaggtgttctacataccaccggtggttatctggtctatgcatctttgacattcaaatatacgtttgattaccaccctggcgaagtttactggtgtacagctgatgtaggctgggtaaccggccatagttacttgctttatggcccgctctcctgtggtgcaacaaccttaatgtttgaaggtgtgccaaactatcccgatgtgaatcgtctctgtcaggttgtagataaacatcaggtcaatatcctctataccgcaccaacagccattcgagcgttaatggcagaaggggataaagccattgaaggcaccaaacgcacatcattacgcatcatggggtcagtgggtgaacccatcaatccagaagcctgggaatggtactacaagaaaataggcaacagtaaatgtcctattgtcgatacatggtggcaaacagaaacaggtggattcatgatcacgccgttgcccggagcaaccgatctcaaagctggatcagccacattgccattcttcggcgtaagtcctgcaatagtcgataataccggagaaaccttaagcggcgagagtgaaggtaatcttgtcattaccgattcatggccggggcaggctcgtacattgtttggtgatcatgaccgttttgagcaaacctatttttctaccttcaaaggcgtttatttcagcggtgatggcgccagacgtgatgaagatggttattactggattactggtcgtgttgatgatgtgctgaatatttcaggccaccgattgggaaccgcagaaattgaatctacattggttgctcatcccaaaattgcggaagcggctgttgtcgggataccacaccgtattaaagggcaggcaatttatgcttatgtcacattaattcatggtgaagaaccttctcctgatttgtatgcagaagtcagaagctgggttcgcaaagaaatcggcccaattgcgactccggacatcctgcactggactgattctctgccaaaaacacgttcaggaaaaattatgcggcgtattttacgcaaaattgcttccggtgatactggcaacttaggtgatacttccactctggctgatcccggcgttgtggaaaaattattg

SEQ ID NO: 24132 - DNA, 1335 bp, Xenorhabdus nematophilus
atgacggggcatatacaacagtcgacgcttaagcgtggtttaaagaacaggcatattcagcttattgcactcggtggctcagtaggaacagggttatttttgggaattgcccaaacgataaaaatggccgggccttcagtgcttctggggtatgccattagtggttttatcgcattcctgataatgcgccagttgggggaaatggttgttgcagagccagtagcaggttcttttagccactttgcttataaatattggggtaattttgccggttttctatccggttggaattactgggttatgtttatactggttggaatggcggagctcacagctgtcggtatgtatattcaatactggtggcctgagatcccaacgtgggtttcagcagcaatattttttgtggtgattaactctgtcaatttaattaatgtccggctctatggtgaggcagaattctggttctctatgattaaagtcggagccattatcggcatgatcctcttcggttcttacttgctcattagtggaacaggagggccacaggccagcgtaagtaatttatggcagtatggcggtttcatgcctaatggtgctgcgggtctgatcacagcaatggctgtaattatgttttcattcggcggattggaaactgtaggaattacggcggcagaagctgaaaatccagaaaaaaatatcccgaaggcaactaatcaggttgtgtaccgtattttactgttttatatcggttcgttgttcattctattgtctctttacccgtggataaaagttgttgaggggggaagtccatttgttctgattttccataacctggatagcttttgggttgctaatgccttgaatattgttgttttgactgcagcgttgtcggtttataacagcggcgtttattgtaacagccgaatgctgtacggcttggctaagcagggtaatgcaccacgtattctgaccaaagtgaataagcgcggtgttccggttttatcaattgcattgtcagcgttggcaacatcgataggtgtattaattaactatgttatgccgggtaaggcatttgagcttttgatggcattggtagtgacaaccttagtcattaattggattatgatttgtgtgtcacacctgaaatttcgggctgcaaagaatgccgaaggggttaagacaagtttcagagcattctggtatccatttggtaatttcctgtgtctgatatttctggcttgtattcttattatcatcctgacgatacctggtatacgtatatctgttatcctcatgccattctggattggagcattgtgggttggttatttattt

SEQ ID NO: 24133 - DNA, 456 bp, Xenorhabdus nematophilus
caagaccatcagctgcaagtagaagccattaaatgcggcacagttatcgaccatattccggctcaggtcggttttaaattattgtctctcttcaaactcacagaaactgatcagcgtattactattggcctgaatttgccttccaatcacttagggaagaaagatctgatcaaactcgaaaataccttcctgacagcccagcaagcaaaccagctcgctatgtatgcaccacatgcaaccgtcaataacattgaaaattatgttgtcgtgaagaaaatgccaatcaacctgccagaacagattgatggtatccttgtctgccctaatggtaactgtatcagccataatgagcctgtagaaagcagcttccatgtcatggaaacggcaaatgacgtcatcgttcgctgtaagtactgtgagaaagagtttgatcgtcaggctgttatcaacaacgat

SEQ ID NO: 24134 - DNA, 2256 bp, Xenorhabdus nematophilus
ataaaaccctatcacgctgcggcgggaggctgggggtcattggaggcaacaacacgttttgtctttgatagtaaacaagtattaaagaacatggttaatctgatgcgcatgaacaaacccagaggctttgattgcccgggatgtgcatggggtgatgataacaaaagccttttcagcttttgtgaaaatggcgcgaaagcagttacctgggaagcaacccggcggcatgtagaccgggagttttttgccacacatagtgtcagcaaactctacgaacaaagcgattactttctagaatatcaagggcgcgttattgaaccgatgcgctataaccatgagaccgatcactatgagcctattagctgggagcaggctttttctttgatcgccagacacattaatgggatggaaaacccgaaccagttggaactgtatacttccggtcgggccagtaatgaagcctcatggctgtatcagctatttggccgggtactggggactaataactttcctgattgctcaaatatgtgtcatgaagccagcggttacgggctgctgaaaagtctgggagtgggtaaaggaacgattcgtctgaatgattttgatcatgcagatgccatttttgtctttgggcagaatcccggaacaaatcacccacggatgctgcatagcctgcggcacgcagcagaacacggagctagaattgtcacctttaatacattgcgtgaacgtggcctagagcgctttgctgatccacaaaaacccctcgaagttgttactccaatggcaggcaatatcagccaccgttattatcagcctaaattaggcggagatatggctgctgtgcgggggatggtcaaagcgttgctggaagttcataactctcgtatagctgccggagcagcgggtatttttgctcaagactttatttcggctcataccgaaggtgtggaggcttatttacaggaagtggctgctactgaatgggtatttatagaggaacaatcaggtctgacgcagcaacagctacgcgaggctgccgatatttaccagcacgctgaacgtgtgatttgcacctgggcaatgggtattactcagcataaacactctattgatacagtccgtgagatcacaaacctgcaattactgtttgggcagttaggtaaacccggtgctggtgtatgcccggtgcgtggtcacagtaacgtacagggaaaccggacgatggggattaatgagcaaccgtctcaggctttccttgatagtctggcaaatcactttggttttgaacctccccgtgctcatggtcataatgtggtgcaagcgctggaggcaatgttacgtgatgaagtgaaggtactgattgcgctgggtggaaatctcgctgctgctgcgccggacagcccacgtacagaagaagcactccggcattgtgatttgactgttcatatcagtacgaaattaaatcgcagtcatcttgttaccggtaaaaaagatgctcttatcctaccggcactggggcgtacagaacaggatattcagctcagtggtgcgcagtttgttacggtagaagattcttttagcatggtgcacgcttccgaaggaataaataaaccactatctgatacacagcgttctgaaactgcgattgttgcgggcatggctgatgctgttttaggcaataccccaaccattaactggctggaattagccggagattacaacaaaatccgtgatcacattagcgcaactattcccggttttgctgactttaataaaaaatgtgaacatccgggcggcttctatcttggtaatgcagcagcggaactgcgttttcagaccccgagtaaaaaagctgaatttagccatgccccactgccagacacactgtttccccaaattgctggagaagacgttccctttgctttgcaaaccttgcgctcccatgatcaatacaacacaaccatctatggtttagatgaccgctatcgtggcgtttatggtcaacgggaagtcttatttatgaacccggaagatattgcccagtcgggctatcaggaaggagatctggttgatatcgagacaatctggcacgacggtattgaacgcaaagtatgtggatttaaattagttccttacactattccgcgtggtaaccttgccgcttattaccctgaaaccaatccgttagtaccgatggacagctttggtcatggtacaggtacacccacatccaaatctgttccggtgaagtta

SEQ ID NO: 24135 - DNA, 741 bp, Xenorhabdus nematophilus
atgaaggttaatatgctgcattcttttactgagcagaaaattagtacaaaaaagctttttgactgggaaagcattaataaaatatttattaatgaatgtaatgagcctttagaagtcatttatgaaacggataaaataaaactgaaaccggtttatttccttgcgggtatcaatggcgctgttgaatattgtgcagtaagaaaaaatgtggctgaaaaattaatacaggcctcccaattattgcctgctcatttagggcttttagttttggatggttggcgttcacgggaaactcagcttgcattgcaggagaaaacacgggctaccattgcgcagcagtacagctacttatccattgaagaacaaaaagaattactggaacagtttgtggcaccggccccgactgagcaaaatccggtgagtccccatctgacagggggttcagtggatgtgacgctgtttgatattgtctccggtaacgcattgtttatgggcacagaatttgatgaagtagatgatctgtcttacaccgcagccttagaacaagcatcggatacaaacatgccggcagtattataccgtcggatactgcatcacgttatgcttcaggctggctttactaatctgccgactgagtggtggcattacgattatggtaatgctttatgggcattctataaaaatgatcaggctgtttatggtgcagtggaaggcatcagggaatcaggcagcacaatatag

SEQ ID NO: 24136 - DNA, 1563 bp, Xenorhabdus nematophilus
tcagggaattatctgatggcgcttgatgcaggaacaggcagtatacgagcagtcatatttgatctggaaggtaatcaaatctctgtcgggcagtcagaatgggttcaccagcctgtaccgaatgttgcaggctcaatggaatttgatctgcaaaccaactggcaacttacctgccaatgtatccgtcaggccttacaaaaggctgaactaccagccagtgcaattcagggagttgctgcctgctcaatgcgggaagggatcgtcctgtacaatcggaacggcgatcccatatgggcatgtgccaacgttgatgcccgttccagtcatgaagtcagtgaactgaaagagctgtacaataatacgtttgaatatgatgtttatcgctattcaggtcagacattagcgctgggagcaatgccccgcttattgtggcttgcccaccaccgtgctgacatttatcggcaagccagtacgttaacgatgatcagtgactggctggcctatatgctaagtggtgaactggccgttgatccttccaacgcaggcacaaccggcatgttggatttagtgagccgcgactggcgccccagtctgctggaaatggccggattgcgttctgatattctctctccggttaaagaaacaggcacattactcggatacgtaacaaacaaagcagcagcagagtgtggtctcgacagcggaacgccggtcattatggggggtggagatgttcagctcggttgccttggtattggcgttgtcaggcctgctcagaccgcagtgcttggcggcacattctggcagcaggtcgttaacctgccggaaccgatgaccgaccccaacatgaacatccgtattaatccccacgtcatccccggcatggcacaggcagaatctatcagcttcttcaccggccttaccatgcgctggttccgcgatgctttctgtgccgaagaaaaactgatggcagagcggctgggtattgatgcctacgctctgctggaagagatggcggcacgggttcccgccggatcatatggtgtgatgccaatcttttctgatgtcatgcgctttaaatcttggtatcacgctgcgccttcctttctcaacctgtcgattgatccggaaaaatgcaacaaagccaccctattcagggcattggaagaaaacgcggctatcgtctcagcctgtaatctggatatcgttgcgacattctccggtgttcagcctgattctctggtttttgctggtggtggctcaaaaggcaaactctggagccagatcctctccgatgtcaccgggttgccggtcagagttcctgtcgttaaagaagctacggcgctgggatgtgctatcgccgctggtgttggggtttcactgtatgactccatgccggaaacgggagaaagattagtgcgctgggagcgggaatatctgccgaactcaggccaatgggatgtttatcaaaaagcaaaaaaagattggcaggcggtgtatgctgatcaacttcacctcgtcgatgatgggctgacaacttcgttgtggaaagcgccgggtttg

SEQ ID NO: 24137 - DNA, 771 bp, Xenorhabdus nematophilus
atgagtatcttaatcacccgccctgcccccgcaggagaagaattggttaagcggttaaaagctgctggtaaaacggcattcagtgcgccacttatttcaattcatccgggggccgatttgccgttgctgtctcagaaactgcaaaggctaacggcaggtgattttgtctttctgctctccaaaaatgccgttcattatgcctgtgagcagcttggacaagatagcctgtcatggtctgacagactatcttattatggtatcggtaaatcaacttccctgttttttcatcaaaaaacagggaaaagcattctctggccagaccagggagaaaccagtgaagatttactgcaactcccctccttgcagcaggtggagaataaaaaagttttattactccggggtaatggtggccgtgaaatgattgcttcaaccctgcgggcaagaggagcagaagtcgactactgtgaatgctatgcacgtcgagctgtcaaatatcattcagctgagttcagtcattactggcagcggtgtggtataaaaaccatcgttgttaccagtggcgaaatgttacgactgttatataacttagttattgaaggtgatagcgctgaaggtaacgctaatgatagtagtaatagcaaagcgtggttattaaattgccgactgattgtggtcagtgaccgcctcgccagtattgcccggacactgggctggcatgtaataaaagtagccaagagtgcagataatgacgccttaatgcaggcgctggaa

SEQ ID NO: 24138 - DNA, 996 bp, Xenorhabdus nematophilus
atgacaatgaaaaccattcgcattgcgactcgccaaagccctctggctatgtggcaagctcgatatgttcaaaaacaactaaaacattttcatcctgatttgcaggttgaattaattcctatgactacccgtggagatatcattcttgatacccctctcgccaaagttggtggcaaagggttatttgtaaaagagctggaactggcaatgcttgaaaatcgcgctgatattgccgttcattccatgaaagatgtcccagtcgaatttcctgatggtttgggattggtcacaatctgtgaaagggaagatccacgagatgcttttgtttcagtagaatacgcctcgctcaatgacctcccaaccggcagtatcgtcggaacatccagtttgcgccgccagtgtcagctgcgccagcttcgtcctgaccttgtgatccgcgacttacgtggcaacgttggcacccgtttaagcaaactggacaacggtgattatgatgcaattatccttgcggctgccgggctgaagagattagggctggaagatcgcatccggatgccactcgcgccggaattactgcttcctgctgtcggacaaggtgccgttggtatcgagtgccgtctggatgacatgcagacccgtgagttacttgcacctttaaatcataaaaacacggaaatttgtgtcctcgctgaacgagccatgaatacccgtctggaagggggctgccaggttcctattggtagttatgccatctggcagggcgataatatctggttacgagcgcttgttggcgcacctgatggcagtaacatcatccggggcgaaagaactatttgtagtgaaaaaacgagctgtagtgaaaaaacgagctgtagtcaaagcactatcagcagtgataaagcaatatcatccgaagaagcttgtcaggcgggtatttcactggccgaagaattattggagaaaggtgcccgccagattctggctgacgtttatcag

SEQ ID NO: 24139 - DNA, 822 bp, Xenorhabdus nematophilus
atgcaattctccaaaatgcatggtcttggcaatgatttcatggttgttgatgcagtaacccagaatgtttatttttcaccggaattaatctgccggttgtcagataggcatactggcgtaggatttgaccaactgttggttgttgaagcaccctatgatcctgatttagattttcattatcgtatttttaacgtggatggcagtgaagtatctcaatgtggcaatggagcacgttgttttgcccgttttgttcgtttacggggattgacgaataagcgtgatattaaagtcagtacacaggcaggccaaatggtcttgagcatcaatcatgatgatcaggtctgtgtcaatatgggggaacctgtctttgaaccccagtctgttccctttcgcgcgaataaagccgagaaaacttatatcatccgggtcatggagcgcactgtgctctgtggtgttgtctcaatggggaatccccactgtgttattcaggttgataatgtggacacggcagatgttgaggtactcggtcctgttctggaacgtcatgaacgttttcctgagagagtaaacgttggttttatgcaggtcgtaagtcgtaaccatattcgtttacgtgtatttgaacggggtgccggagaaacccgggcatgcggcagtggtgcgtgtgcggctgttgcgattggtattcagcaaggtctgctggataaacaggttcgtgttgatttgcccggtggttctttgcaaattcgttgggatgggccggggcagccactttataagactgggcctgcaactcacgtttatgacggtacaattcacttg

SEQ ID NO: 24140 - DNA, 2157 bp, Xenorhabdus nematophilus
atggacgtctcttatctgctcgaaagcctgaataataaacaacgtgaagccgttgcagcaccccgtaccaatatgctggtactggctggagccggtagtggtaaaacccgtgtattggtacatcggatcgcctggttactatcagttgaacatgcctcacctttttccattatggcggtgacatttaccaataaagctgcagcggaaatgcgccatcgtattgaaaacctgatcggcaccagtcagggtggcatgtggattggaacattccatagtctggcccatcgtttactgcgggcccatcatttagatgccaatctgccgcaggattttcagattcttgacagtgacgatcagctgcgtctgatcaagcggatcattaaggcgatgaatctggatgacaaacagtggccagcacgtcagggcatgtggtacatcaacggtaagaaagatgaaggtttgcgccctcgccatattgaaagctacggcaatccggtagaagttacatggctgaaaatctaccaggcttatcaggaagcctgcgatcgggccggactcgtggatttcgctgaactgctattacgcgctcatgagctgtggctgaataaaccgcaaatattgcaacattatcgcgatcgttttactaatattctggtagacgaatttcaggataccaacagtattcaatacgcatggatccgcctgttagcaggggattcaggcagagttatgattgtgggtgatgatgatcagtctatttatggctggagaggagcgcaggtagaaaacatccagcgtttcctgaaggatttccccgcggcacaaactattcgtctggaacaaaattaccgttctaccagtaacatacttaaagccgccaatgccctgattgcacataacagtgatcgtctgggcaaaaatctgtggacagaaggcagtgaaggagaacctatctcactttactcggcttttaatgagctagatgaggcacgttatgtggtcagtcgcctgaagaactggctggataacggaggagctttgaaagagtgcgcgatcctgtatcgcagtaatgcccagtcccgtgtattggaagaagcattgttacaggcttccatgccttaccggatctatggtggccagcgcttcttcgaacggcaggaaatcaaagatgcgttgtcttatctacgtttagtggcaaaccgtaatgatgatgcggcttttgagagagtagtgaatacaccgacccggggaattggggacagaacccttgatgttgtgcgccagatggcgcgtgatcagcagaagacactctgggaaagcagccagttgttgattcaggaaaaggtactggcaggtcgggcagcatcagctttacaacgttttatcgaattaattaacgcgctggaaacggaaacacaggaaatgtcgctgcatgtgcagactgatcgggttatccgggattctggcctgtgggcgatgtaccaacaggaaaaaggtgagaaagcacaggcgcgtatcgaaaaccttgaggagctggttactgcgacccgccagttcagctatcaggatgaagacgaagatatgatgccgttgcaggcttttctgtcccatgctgcgcttgaagctggggaagggcaggcagatgcctatcaggattctgtccagctgatgaccctgcattcggcaaaaggtctcgaattcaggcaggtctttattgttggcatggaagaggggatgtttccaagccaaatgtccattgatgaaggagggcgtctggaagaagagcgccgtctggcttatgtcggtgtgacaagggcaatggaaaaactgacgctgacttatgctgaaagccgccgtttatatggtaaagaggtgtaccatcgcccatcccgttttgtcggtgagttaccggcagaatgtgtcactgaagttcgtctgagggcaacagtatcccgaccggtgagccataaacgactgggaacaccactcagcgccaatgatagtggctacgctttagggcaacgagtccgccatcctaaattcggtgaaggaacgattgttaatattgaaggcagtggggagcattgccgtttgcagatcgcgtttcagggtgaaggcatcaagtggctggtcgccgcttatgccagacttgaaacc

SEQ ID NO: 24141 - DNA, 1743 bp, Xenorhabdus nematophilus
ataatgaatgataaagacctttctacctggcagacctttcgccgactatggccgatcatcacaccatttaaggccggattgttagttgcggcggttgcgctagttataaatgctgccggtgatacattgatgctttctttgttaaagcctttacttgatgaaggatttggcaaggcagacatgagtgtattgaaatggatgccactggtggttatcgggctgatgcttatgcgtggcatatctgggtttgtatcaagttattgtatctcctgggtttccggtaaagttgtgatgcagatgcgccgtcgtttgttcaaccatatgatgggcatgccagtcgctttttttgaccagcaatctacggggacgctactttcccgtattacctatgattcagagcaggttgcatcttcttcctccggtgcgctggtgactgttgtcagggaaggggcatcaattatcggcctttttgcactgatgttttattacagttgggagctgtctttgatcctgattgttattgctccgattgttgcgggagttattcgtctggtttctgtacgttttcgtcgtatcagtaaaaatatgcaaaacagtatgggaatggtgacaaccagcgcagaacaaatgctgaaaggccacaaagaggttttaatctttggtggtcagaaagttgaaacacagcgctttaataaagtcagtaatcatatgcgtcagcagggaatgaaaatggtttccgctgattctgtttcagatcctattatccagcttatcgcttcatttgctctggcatttatcctgtacgctgccagctttcctgaaattatgggtgcactgactgcgggtaaaattacagttgtattctcatccatgattgctttaatgcgcccgttgaaatcactgactaacgttaatgcacaattccagcgtggtatggcagcctgccagacgttattcactattctggatatggagcaggaaaaagatgacggaaagcgtgaaattaaaaaagcgaaaggtgatcttgaattccgtgatgtgactttctgttatccaaccaaagagagtcctgctctgaaaaatatttctatggaaattccggcaggcaaaactattgctttggtcgggcgttctggctccggtaaatcaacaattgctaatctcctgacccgtttttatgacgtcagtgaagggagtatttcgctggatggtcatgatttacgtgagtatacattatcttctttacgtaatcagatagcactggtatcgcaaaacgtacatttgttcaatgataccgtggctaacaatatagcttatgccagcgaaggccagttcagccgtgaagaaattgaacgtgcggcagaaatggcttacgcaatggactttatcaagaaactggataacggccttgatactatgattggtgagaatggcgtcctgctttctggtgggcagcgccagcgcattgccattgcccgtgctttactgcgtgattctcctatcttgattttggatgaggcaacttcggcactggatacggaatctgaacgtgcgattcaggctgcactggatgaattgcagaaaaacagaacttctctggtaattgcacaccgtctttctactattgaaagtgctgatgaaattattgttattgaagatggcaatattatcgagagaggcaatcataacgttctgttggagaaaaatggcgcatatgctcagcttcatcgaatgcagtttggc

SEQ ID NO: 24142 - DNA, 2250 bp, Xenorhabdus nematophilus
aataaatcaaccgtgccgggtgtacatccttaccatggccccgcgggcggatggggagcattaaaagcaacggcaatcgctgtccgtactcagatggacgcttttgttgcgccaaagaccttgctaaatactaaccaacccgacggttttgattgccccgggtgtgcctggcctgataaagaacacaactctacattccagttttgtgaaaatggagcaaaagctgttacgtgggaagccaccaaaaaacgtgtcactcctgagtttctggctgaaaataccgtgagcactttactggaaaaatcagattatgaactggaaggatatgggcgtttaactcatccactggcttatgatgctgccacagatacactggttcctgtttcgtgggaagctgcatgccgtcgtattggtgaaattttaagagaaataccatcaccttctgaggtcgaattttacacttcaggacgagcttcaaatgaagcagcctatctatttcagctctttgccagagaatacggcacaaataattttccggattgctccaatatgtgccatgaacccaccagtgtgggtctgcctcaatccattggcattggtaaaggcactgtttcattagatgactttgataaaactcagcttattatttctatcggtcataaccccgggactaaccacccacgaatgatgggaacactgcacgaagttgctcgccgtggtgtgcctatagtggtgtttaatccactgcgtgaacgcgcattagagcgtttcaccgatccgcaaaatatgattgaaatggcgacctatagctcaacgaatatcgcctcttcttactatcaggtaaaagcgggaggtgatgcagcagcgctgaaaggcatcatgaaagtcttattggaatgggatgaaaaacgcgggaatattctcgatcatgagtttattgcaacacataccatgggatttgatgccgtcaaagaagagctacgcggtacttcctggcaagatattgagaatgaaagtggcatttctcaagccgatattgaaaatgttgcgctgttgtacgctaattcggatgcgaccatcgtcacttatggtatgggaataactcagcataataaaggaaccgcgaatgtccggttaattgccgatttgctactcatgaaaggcaatatcggcaaatccggggctggaatatgtccactgcgcggccactctaatgttcagggtaaccgcaccgttggtattacagaaaaaccatcgccagaattcttacaaaaactggaagaagtcttcgggtttaagcccccttatgaacacggacacgatgcagttaaagcgatgcaagcgatggttgacgggcgcgtgaaggcactgctttgtcttggcggaaactttgccgtggcattacctgatcctgaattatcattttcagcaatgaaaaaactcgacttgagtgtacatatcggaactaagcttaatcgttctcatttactggtggcgaaagaaacctttattttaccttgtttaggtagaactgaattagatattagggagttagggcgtcaatccattactgtcgaagattccatgtcaatggttcatgcatcatcgggaaaattaacaccagcatcaccactgttaaaatcagagcctgttattgtggctgaaatggcagccgctactttactgaatagtaaaacaccatggttacgctataccgaaagctacgatcttatccgtgatttgattgagaaaactattcctggatttgataactataatcagcgcatccggactccggggggatttcgtatgccattgccaccaacagagcgcatttggcctacaccaactggcaaggcaatgttttctgtgtttaaaggtgtgaaagaaaacgcagatgtgctgggtgaagatgtattgcgtctaatgactattcgtagtcatgaccaatataatacaaccatttatgcattggatgatcgttatcgtggagtatttggacgacgtgatgtgctgtttatgaatgatgttgatctggaagcccgtgatttgaagcacggggataaaatcattattgaaacagtgagccaaaacagaaagttatttctcaaagatatcactgttatttcatacaatattgcgccgggaactgttgcagcttattatcctgaagcgaatattttaattccattagattatattgatgaagaaagtggtacaccttcttataaatcagtgccagtaagagtt

SEQ ID NO: 24143 - DNA, 474 bp, Xenorhabdus nematophilus
atcagcttgattgctgcaatggcgatggatcgcgttattggtctggacaatgctatgccgtggactattccgggtgatttagcctggtttaagcgtaatacactcggaaagccggttgtgatgggaagagtaacctatgaatcgattggtcgccctttaccgggacgcctgaacattatcatcagccgtcagccaggcagcgatgatcgtgtaacctgggtcagttctatcgaagaagctctggctgcggcaggtgatgtcgaagaaatcatggtgataggcggcggtaaaatttatgaacaatttattcctctggccagtcgcatgtatctgactcatattgacgccgaagtgatcggggatacccattttcctgattatgaacccgatgagtggagttcggttttcactgaatatcacgatgctgatgagcgcaattcacacggctactgttttgaaattctggaaagacgg

SEQ ID NO: 24144 - DNA, 504 bp, Xenorhabdus nematophilus
atgtctgttcccgcgtttggattaggtacttttcgtctgaaagatgatgttgttattgcatcagtaaaaaatgctattgaattggggtatcgggcgattgataccgcacagatttatgaaaatgaagcagcagtgggtcaggctattaaagaaagtggtgtagtccgtgaggatatctatatcacgactaaaatctggactgataatatgggcgcagagaaagtgataccgagcctcaaagaaagtctcgctaaattaggcacggattatgttgacctgacattaattcattggccgtcgccaaataatgccgttagtcttgaagaaaccatgagtgcgttactggaagcgaaaaaaatggggctgacacgcgaaattggcgtttcaaactttaccgttgctctgatgcaacaggctattgatgcggtaggtgccgaaaatatcgcaactaaccagattgaagtttccccctatttacaaaaccgttatgtaacaggctgggcg

SEQ ID NO: 24145 - DNA, 1680 bp, Xenorhabdus nematophilus
ctcatcgtcattggggctggtatcggtgttcttgcaccttttttattacgcgaaattattgatactgcactaccgcaacaaaatatacagcttcttgtctggttagcattaggtttgattgtgattaccgcactaaacgcagtgattaatgcggcacaaatgatcttatctacccagataggtcaagccattatgcacgggctgcgggtacggctctacgggcatctacaaacactttctcttgccttttttactcgaactcggacaggcgaaattcaatcaagtatcgccagtgatattggcggacttcaatctgtcgttagcaatacggtgaccgaaatcattcgcagtgccaccattaccgtaaccaccgccattgcgatgttgttactggactggcgactcgcactgttttcctttgccgtcttgcctccatcactctggctcagccacaaagtcggcctcatgcgtgaacgcctgacgcatcaacaacaagatggtcatgcaaatatgtctgctatcgtacaagagaccctatcagcgccgggcattatcctgtcgcgtactttggcacgcagtttttttctgatccagcgttttgaaaaagcatcgtccaaaaccttacatttagaagtgcgtgcacatactgccggtgagtggtcatggtcggtgattgaactcctactcggtgcgatgccagcgatgacattactgttgggtggcttactgattggacaaggtgtgcctgtgactatcggtacgcttgtagccttgatcgcactacaggaacaattgttgtggcccttagaaaatttgttggaaaatgcggtcaaactgcgtacgacacgggctctatttacacgtatttttaaatacttagacacccctcccgacattgtagaacctgctcagattcgagatctcagtaatgaaggcccacgtggtcacgtccgatttgaaaatgtcagttttagctacgatggtactgacatgtcaagcttatgcaatgtgtcaatagatatcccggcagggagtcatgtggctatagtcggacctacaggtgcaggtaaaagtaccttcggttatctattggcccgactcgttgatccgagccaaggtcgaattaccattgatggcattgaccttcgagagatgagctttgaacaacttgccagcgtactcggagtagtcacgcaagagccatttctcatgaatacaagcatcgcagaaaacttacgctttgcctgcccagaggccagtgatgaggatcttgttgcgtccgcgcgtactgcacaaatccatgatttgatcgtttcgctgcctgaaggttatcagactaaggttggtgaacgtggctatcgattttcaggcggagaaaagcagcgcctcgcgctggctcgaacgatcctgcgtaacccgccaatcctgctgcttgatgaagcaaccagtgcgcttgacaacacaaccgaaaaggcaatttctctggctttggcacaaatggcatccgaacgcacagttatctctattgcgcaccgcctctccactattcgtcatgcggatcaaatattggtgctcaaggatggtcagttaaaagaatggggaacccatcaacagttggtcgaaaaagatggtatctatgcagaactgttacgtaccgctgagccaacctaaaattcaatt

SEQ ID NO: 24146 - DNA, 1596 bp, Xenorhabdus nematophilus
gataatggcaaagtcgtcattggtgttgatgtcggcactggcagtgcccgtgccggtatttttgatatgaacggtaacatgctgtcatctgccaaacgcgatatcacgctttatcgtgataacacccattttgtcgagcagtccagccgtgaaatctgggatgctgtctgctattgcatcagggaagctatgtcgcactctggctgtgtcccacaacaagttgctggcattggttttgatgctacctgctcactggttgttctgggaaaagatcaggagccaatttccgtcagccagagtaaggatccgaatcgtaatattattgtctggatggatcaccgggcaacagtacaggcagagcatatcaatgcgttaggtcactctgttctcgactatgtcggcggtaaaatctctccggagatggaaacaccaaaaatcctctggctgaaagaaaatcaccgtgaatcatttgataacgcatggcaattttttgatctggcagattttctgacctggaaatccaccagctccctttcccgctctacttgtactgtcacctgcaaatggacttaccttgcacatgaaaagcgctgggatgcggattatttccggaaaattggtttgtctgaactggcagatgaaaatttttatcgtattggacagaacattattgaaccaggtacaccttgtggtcagggcctgacagaaagtgcggcaaaacagatgggattattggcaggaatacctgttgccgcaggaatgattgatgcacatgcaggaggcatcgggacagttggtatcaatggtgatgcaacacgtaatatggcttatgtattcggcacctcttcctgtacgatgacgacaactctggagccggtctttatacctggtgtctggggaccatacttttctgcaatggtaccctgcatgtggctcagcgaaggtggacaaagtgcagccggggccgccattgatcaactattgtcttttcaccctgccgcaatagcagccaaagcgatggcaaaagaaaaacaaaaatctttgccggtttttttagccgatagggttctggaaaaaacacaatcagcctctcaagctgtagaactggcaaaaggcatacatgttgttcctgaatttctgggaaacagagcaccttttgctgatcctcatgctcgcgctgttatagctggattggggatggaggatagcctcgataatctgctttcgctttatattgccggtatatgtggtattggttacgggctaagacaaataatcgaagcacaagcgaaatcaggcgctacaattgacaatattgttatcagcggaggggctggtcagcatcctttagtccgccagctcattgcagatacctgtgatgtgacagtcattgcaacgcaggcatgtgaaccggttttacttggatccgctattttgggggcagttgccggaggtgtatgtaaaagtgttggtgaggcgatgtcgcgtttctctaatattgattgcacatatgaaccgagcgaatcctatcgggaacatcataatattcgctttacatcatttcagagcctccagcaatgcgcgcgagaacttaag

SEQ ID NO: 24147 - DNA, 732 bp, Xenorhabdus nematophilus
tcttttatggctatctcgctggaaaataaagtcgctgccatcactggcgcagcatctggtatcggtcttgagtgtgcacggatactgattgaggctggtgttaaagtagttcttattgatcgtgccaaagaacgtctgatgcaactcgtttctgaactcggtgaaaatgccatcccgctggttattgatctgatgaagccagaacaggttgacggcatacttgatgaaatactgaaaaaagccgggcgtcttgatattttccatgctaacgcaggtgcctatatcggtgggcctgttgctgaaggagaccccgatgtttgggataaggtactcaacctgaacattaatgccgcattccgtagtgtccgtgctgtgttaccccattttattgagcagaaatctggcgatgtattatttacgagttctatttctggtgtggttccggtggtctgggaacctatttacaccgcttctaaatttgcagttcaggcatttgttcactctacccgtcgtcagatggctgaacatggcgtgcgtgttggtgccgtacttccgggacctgtagtcaccgccctattggatgactggcctaaagcgaaaatggaagaggcactggaaaatggtagcctgatgcagcctattgaagtggcagaagcggtgctatttatgctaactcgcccgagaaatgtcactatccgtgatttggttattctgccaaacagtgtagacctc

SEQ ID NO: 24148 - DNA, 987 bp, Xenorhabdus nematophilus
caacataaaaagtttgatgttatctgtatgggacgtattgcggtcgatttatatggtcagcagataggtgcacgtttggaggacatgaccagtttctctaaatatctgggaggctcttctggcaacgtagcttatggtacagcgcgtcagggattaaaatcgtccatgctggccagagtcggtgatgagcatatggggcgttttctacgtgaagagctggagagggtaggatgtgataccagccatttaattactgataaagagcgtcttacggctttggtgttactcggtataaaagacaaagaaactttcccgctggttttctaccgtgacaattgtgctgatatggcgattacccgcgatgatttcagtgaggaatatattgcttctgcccgttgtttggcgattaccggaacccatctttctcacccgaaaaccagagctgccgtgctgaccgcattacaatatgcccgccgtaatggggtaaaaacagttattgatatcgactatcgccctgttttgtgggggctgacttcactgggtgacggtgaaacccgttatatcgcctcaaagcaggtgactgctcaattacaggaagtactctctcaatttgatctgatagtcggtacagaagaagaatttcatatcgctggtggctctaaaaataccttagatgccttacgcagcgtcaggaaactgagttctgccactctggtctgtaaacgaggggctctagggtgttctgtatttaccgggaatattcctgagactcttgatgaagggattactattcaaggcgttaaagtagaaatactgaacgtgttgggagcgggtgatgcgtttatgtctggtctattgcgagggtacctgaataacgaaagttgggaacaaagttgtgcttacgcaaatgcctgtggtgctttggtcgtttcacgacatggctgtgcgcctgcaatgccggataaaacagaactggataactatatc

SEQ ID NO: 24149 - DNA, 918 bp, Xenorhabdus nematophilus
ggtgtattcaacgtcgtacaaggggataaggaagccgttgatgtcttgctgactgatccgcatgttcaggctgtcagttttgtgggttcaacaccggttgccgagtatgtttatgcaacggcatcatcacatggtaagcgttgtcaggcgctgggtggcgctaagaaccacagcattcttatgccggatgctgatttggatatggcggtaaatgccattataggggccgcctttggtgccgcaggagaacgctgtatggcactgtctgttgttctggccgtaggggatgaaatagcggatgagctggtaacaaaacttcggcagcaaattgacagaatggttgttggtgcagggatcagcgaggggcgggaaaacgatatggggccggtcatttctgaacaacacaggtcaaaaatctgtgattacattaacagtggtgtggagcagggagcaaagctgctggtggatgggcgagggtatcaggtcacaggccatgagaagggttatttcgtggggccaactttgtttgattatgtcaccccagagatgaaaatttataaagaagagatctttgggcctgtactgtccattgtgcgcgtacctgattatcacaccgcactgaaattgattaaccatcatgaatacggtaatggcgctgctatttttacccgtgatggtgaaactgcccgtcagttcagtgaagatgtacaggctggtatggttggcatcaatatccctattcctgttcctatggcattccatagttttgggggctggaaacgttctattttcggtccgctgaatgtacatggcaatgatggtgtacgtttttatacccgtatgaaaacagtcacgagccgttggcctgccagcgttcgtctggaacaccatagcagtagctttgttatgccaacgatg

SEQ ID NO: 24150 - DNA, 1335 bp, Xenorhabdus nematophilus
ctgcaaagaggacttgaagcgcgacatattgagctgattgcgctaggtggcacaatcggcgtcgggctgttcatgggctccgccagtaccctgaaatgggctggcccttcagttttactggcttacattattgccggtctttttgtctttttcattatgcggtcaatgggcgaaatgctatttcttgagcctgttaccggttcatttgctgcttttggtcataaatacctcagtccctactggggatgcctgaccgcctggggttactggttcatgtgggtttctgtcgggatttcagaaattaccgctgtgggagtctatgctgaattctggttccctgatttaccacaatgggtagcggctttggtggcggttagtctggtggcactggctaatctggctgctgtgcggctgtatggggagcttgagttctggtttgcaatgattaaagtcaccacgattattgtgatgattttagtcggtattgggctgatattttttggattaggaaatgactggcaagccatcggtcttgataatctgacgactcatggtggtttctttgccggtggttggaaaggatttttgtttgcattgtgtattgtggttgcatcctatcagggcgtcgagttggttggtattaccgctggtgaagccaagaacccacaggttaccctgaaaaaagcaatcaacaatattctgtggcgtattctgattttctatgtcggggcgattttcattgttgtcaccctgtttccatggactgagataggcagtcatggcagcccgttcgtcatgacttttgctaaagttggtattgcctctgcagcggcagtgattaactttgtggtactgactgcggccctttccggatgtaatagcggcatgtacagcggaggcaggatgttgtacgcgctggctgaaaatcgtcagttgccggcttcattgcgtaagctatcgaaaaatggtgtacctgtcagatgtgttgcaatcactattggttgtctgattgccggttccagcctgaattatttgatcccaaatccacagtctgtttttgtgtatgtctatagcgccagtgtcctgccggggatggtaccgtggtttgtgattctggtgagccagttacgtttccgtcagcatcatcaggaagccctgaaacagcacccgtttaaatcgatacttttcccttatatcaattacctgacactgattttcttgtcttgtgtattgattgggatggcgattaacccggatacgcgtttttcactcatggttggtggagctttcctgctgattgtgtcactgatttattgggtaataaaatttatccgg

SEQ ID NO: 24151 - DNA, 879 bp, Xenorhabdus nematophilus
atgaaaggaattatactggctggtggctccggcacacgcctgtacccaataacacgcggcgtctcaaagcagttattgcctatttatgacaagccaatgatctactatccgttgtcagtcttaatgctggcagggatacgcgatatcctgattatttccactcaggaagacttacctgcctttaaacgtttactgggtaatggtgagcgttttggcattcatctgagctatgcagtacagccttcgccggatggtctggcgcaggcattcctgattggtgaagagtttattggtgataacccttgttgtctggtgctgggtgacaatatttactttggtcaggcattcagtccgaagctacaaagtgttgcggcccgtagtcatggcgcgaccgtattcggctatcaggttatggatcctgagcggttcggtgttgtggaatttgacgaacagtatcgcgttctttctattgaagagaagcccgtacagccaaaatccaattgggcggtgaccggactttacttttatgacaacaacgttgtggatttcgctaagcgggtaaaaccatccattcgtggagagctggaaattaccagtattaatcagatgtatctggaacgtggcgagctgaatgttgaattgctcgggcgtggttttgcctggctggacactggtacccatgacagcctgattgaagccagtatgtttgtgcagactgtcgaaaaacggcagggcttcaaaattgcctgtctggaagagatcgcatggcgtaatggctggatgagtgatgatcaggtcagggcttctgcggcagaattgactaaaacaggctatggccaatatttgctggatttactcaatgtctattcacgctgatat

SEQ ID NO: 24152 - DNA, 1071 bp, Xenorhabdus nematophilus
ctggcgttgaaacgtattctaattactggtggagcagggtttattggttctgcggtggtgcgccatataatcaaccatactgaagacagtgtcgttgtggttgatagtctgacttatgccggcaatcttgagtcactggcaccggtcgctgatcatcctcgttatgcgtttgagcaggcggatatctgtcatcgtgatgctttggaacgtatttttcagcaatatcagcctgatgcggtgatgcatctggcggcggaaagccatgttgatcgctccattgatgggcctgcggcattcattgaaaccaatatcatcggtacttacaccctattagaagcggctcgtgcattctggcagcagttagatcaggaaaaacaagcaacattccgttttcaccatatttcaacggatgaggtctatggtgatctgcatggcgaagagggctttttcacagaaacgacaccttatgcaccgagcagcccttattcagcatccaaggcatccagtgatcatctggtcagggcatggcgacgcacttatggtttaccaacagtgatcacgaactgctcgaataactatgggccttaccatttcccggaaaaactgatccctctggtgatcctgaatgcactggcgggtaaacctttgcctgtctacggtgagggaaaacagatccgggactggctgtatgtggaagatcacgcacgggcgctgcatctggtagtgactcaggctataccgggcgaaacgtataatattggcggccataacgagcgccgtaatattgacgtggtcgagactatctgcgagttgctggaagagtttaagccggaaaaaccagccggtgtggcgcattaccgagagctgattacctacgttacagatcgcccggggcatgatatgcgttatgccattgatgctgcaaaaattgagcgtgaattaggctggaaaccacaggaaacgtttgaatccggtattcgtaaaacagtgcagtggtatctggcaaacgaaaactggtggtgcagggtgcaggatggctcttatgcgggagaacgccttggtttgtctgaa

SEQ ID NO: 24153 - DNA, 1251 bp, Xenorhabdus nematophilus
atgagttttgaaacaatttctgtgatcggtcttggttatatcggtttacctactgcggcagcattcgcttcctgccagaaaacggttattggtgttgatgttaaccagcatgcagtggagacgattaatcgtggaaagattcacattgttgagcctgatttggatcaagttgtaaaaacagctgttgaaggtggttatctgagagcggtaacttcacctcagcccgcggatgcatttttgattgcggttcctacgccttttaagggcgatcatgagcctgatatggcttatgtgtattcagcagcagaatccattgcacctgttttgaaaaaaggcgatctgattattctggaatcaacctcgccagtcggcgcgacggaacaaatggccgagaggctggcagaagcccgaccggatcttacctttccgcaacaggcaggggaaaattcagatattgatatcgcttattgtcctgaacgggtattgccgggtcaggtcatggtggagctagtcaaaaacgaccgtgttgtgggaggaatgaccccaaaatcctcttccagggcaagtgagctgtataaaattttccttgaaggtgaatgtgttgtcaccaacgccagaacggcagaaatgtgtaagctgactgagaacagcttccgggatgttaacattgcctttgccaatgaactctcgcttatctgtgctgaacaggaaattaatgtctgggaattaatccgtctggcaaaccggcatcctcgggtcaatatcctgcaaccgggaccgggagtcggtgggcactgtattgcagtcgatccgtggtttattgtgtcacagaatcctacgcagtctcgcctgatccgtaccgcccgtcttgttaacgacgacaaaccactttgggtggttgatcaggtgaaagccgcagtcgcggattgtctggcggaaagcgacaaacgagccagtgaaattaagattgcctgctttggtctggcgtttaaagcaaacattgatgatttacgtgaaagtccggcagttcatatcaccaaaatgattgcgcagtggcacgctggttctactttggttgttgaaccgaatattcacgaactgcctcattcactggaaggtgtagtggagctggtcagcctacaacaggcactggaagaggctgatgttgtcttgatgctggtggatcatagccagtttaaggctatcaatggcagccagataaaacaaaaatgggttgtagatagcaaagga

SEQ ID NO: 24154 - DNA, 1245 bp, Xenorhabdus nematophilus
atgagcaaaacacatttgacagaaaagaagttttccgacttcgcattgcaccccaaggtcattgaaacccttgataaaaagggcttttcaaactgcacgccaatacaggcgctaacattgccttttactgtcgaaggccaggatgttgcggggcaagcacaaacaggaacgggtaagacgctggcatttctgacgtctacttttcattatttactcagccatcccgctgcggcggatcataaaaccaatcagccacgcgcgctgattatggctccgacccgcgaactggctgtccagatttattctgatgcagaagaactggctgaagccaccgggctgaaaatggggcttgcttatggcggagatggctatgataagcagctaaaagtactggaagccggtgttgatatcatcattggtactacaggccgcctgattgattatgctaagcagggatatattaatctcagcgctattcaggttgttgtactggatgaagcggatcggatgtatgaccttggttttatcaaggatatccgctggctattccgtcgtattccttctgcgactcagcgtatgactctgctgttttccgctacactctcttatcgggtacgtgagttagcttttgagcagatgaacaatcctgaatatgtggaagtcgaaccattacagaaaacagggcaccgtattaaagaagaactgttctatccttccaatgaagagaaaatgagtctgttacagaccctgctggaagaagagtggcccgaccgctgtattatttttgctaataccaaacatcgctgtgaagatatctgggcacatctggctgccgatggtcatcgtgtcggcctgctgaccggtgatgtcgcacagaaaaaacgcctacgtatactggaagagttcagtctggggaatgtggatattctggttgctaccgatgttgctgcacgcgggctgcatattccatcagtaacacatgtatttaactatgatttgccggatgactgtgaagactacgtccatcgcattggccgaaccggccgggcaggcgaaagtggtcattcaatcagtctggcctgtgaagagtatgcgctgaatctgccagctattgaagaatatattcagcaccagatccctgtaagtaaatataacagtgatgcattgctgaaagatttaccagtgcccagacgccgtaaccgttcgcgctcagggggacatccacgccgcactaatatgccacgc

SEQ ID NO: 24155 - DNA, 1915 bp, Xenorhabdus nematophilus
atgcgattaaatcccagccaacaacaagcggttgaatttgtgacaggaccttgtctggttctggcaggtgcaggctccggtaagaccagagttatcaccaataaaatagcccatctgatacgtgcctgcggttatcaagcccgccatattgcggctgtgacctttactaacaaagcggcacgcgaaatgaaagaacgggtggcacagacattaggacgtaaggaaaccagaggcctgatgatttccacttttcatacgctgggactggaaatcatgaagcgtgaatacaaggcgttgggcatgaagagtaatttctctttgttcgacgatcaggatcaaatggccctgctgaaagatttgacggcggatttgctggaggaagacaaagatctactacaaaaactgatctcaagtatttctggctggaaaaatgatctgatgtcaccggagcaggtaataagacgggctcgttcagaacaggaacatcactttgctgagtgttatcggcgttatgatttacatttgaacagttgtaatgtgctcgactttgatgatttgatcactaaaccaacgttgctgttaatgcgggatgaagaagtcagggagcgctggcagaaccggattcgttatttgctggtggatgaatatcaggacactaacaccagccagtatcagctggtaaaattgttggttggcaaccgggcacgttttactgtagttggtgatgatgatcagtcaatttattcctggcgtggtgcccgtccacaaaacctgatcctgttaaaagaagattttcctcagcttaaagtgatcaagctggagcagaactaccgttcatcagggagaatactgaaatcggcaaatatcctgattgcaaataatcctcatgtatttgagaaaaaacttttttctgaattgggttatggtgatcctcttcgtgtgatcgaagccaataatgaagatcacgaagctgaacgcgtagtaggtgagctgatcgcccatcactttattaataaaaccgattataaagattacgcaatcctgtatcgcggtaatcatcaatcccgcatttttgaaaagatgctgatgcaaagccgtattccgtatcgtatttctggtgggacttcatttttttcccggccggaaattaaggacttactttcttatctgcgcgtactgactaatcctgatgatgacagcgcttttctacgggttgtcaatacaccgcgtagagaaataggtgcggtgacggttcagaagctaggcgaatgggccaagcagcgtaacaaaagtctgtaccatgccagtttcgatcttggtctggagcaaaatctttctggccgtggactggcagccttacagcgctttacccactggatgaatgaaatttcacatcaggcagaacgtgatccattgttagccgtaagggatttgctgcatggtatggattacgaaagttggttgtatgaaacatcccccagccctaaagcggctgaaatgaggatgaagaatgttaaccagctttttacctggatgagtgagatgttcgaaggggatgatctgaatgaaccgatgacactttctcaggttgtagcccgcttcactctgagggatatgctggagcgcggagaggaaagtgaggagtcggatcaggtacagcttatgacgctgcatgcctccaaagggctcgaattcccttatgtttttatggtgggtatggaagaaggattattaccacatcagagtagcattgatgaagataatattgatgaagaacggcgtttggcgtatgtcggtattacccgcgcccagcgtgaactttttctcaccctgagtaaagagcgccgtcagtacggggagctgatacgcccggaaccgagccggtttttgttagagctgcctcaggatgatctgg

SEQ ID NO: 24156 - DNA, 1338 bp, Xenorhabdus nematophilus
atggggttggcaaaacaaagaaaaaacgttgcagttatagagcgttataacaatattggcggcggctgtacccactggggcactatcccgtccaaagctctccgccatgctgtcagtcgtattattgaatttaatcaaaatcctctctacagtgacaactcccgtattcttcgctcctcgttttcagaaattttacgtcatgccgaagttgtcataaatcagcaaactaaaatgcggcaagggttttatgagcgcaatcggtgtaagatgtttgccggtgaagccacctttatcgatgaacatcatgttagtgtgcgttatgctgatgatagtgtagatatattgagtgccgacaaaataattattgccacaggctctcgcccttattgccctcccgatgtcgacttcactcattcccgtatttataacagcgatactattctggaactggatcacgaaccacgccatgtcattatttatggcgcgggtgtgattggctgcgaatatgcttctatattccgggggttgggtgtgaaggtcgatttgatcaatacccgtgaccatctgctgtcatttcttgatcaggaaatgtctgacgcgttgtcttatcatttctggaatagcggtattgttatccgccataacgaagaatatgaaaagattgaaggtcttgaagatggcgtcattatccatctgaaatcaggcaagaaagttaaagcagattgtctgctgtatgccaatggacgaaccggtaacaccgataaactcgggatggaaaacgtcgggctggaaactgatagccgtggtttattgaaagtaaatcgggtctatcaaaccagcaatgaaaatatttatgctgttggtgatgtgattggttatcccagcctcgcttctgccgcctacaatcaggggcacattgcagcaaaagccatcatgaccggatctgagaatgccgaaaagtatctggtagacgatattccaacaggtatttataccatccctgaaatcagttctgtgggtaaaactgagcaggaactaacagcgatgaaagttccgtatgaagtggggcgtgcccagtttaaacatctggccagagcacagatagcagggatgaatgtaggcagcatcaagatattattccaccgcgagacaaaacagatcctcggcattcactgttttggcgaacgtgcagcggagattattcatatcggtcaggcgattatggaacaaaaaggtgaaggtaataatatcgaatatttcgttaatacaaccttcaactatccgacaatggccgaagcttatcgcgttgctgcccttaatggactgaaccggttattt

SEQ ID NO: 24157 - DNA, 1368 bp, Xenorhabdus nematophilus
atggcactttggggtgggcgcttcagtcaggaagctgatcagcaatttaagcagtttaatgattccctgtgttttgattatcgtctggcagagcaggatattgttggctctgtcgcatggtcaaaggcactggtcacagtcggtgttctgacatctgaagagcagcagaagctggagttggcgttgaatgcattactggatgaagtgagaaccaacccagaggctattttgcaaagcgacgcggaagatattcatagctgggtggaaggccagctgatcgcaaaagttggggatttaggcaaaaaactgcatacaggacgcagccgtaatgatcaggtcgcgactgacctgaagttatggtgtaaggatcagatagcggatatccggcaggctctgacagcattacaacaggcattagtgattacggctgagaataatcaggatgccgttatgccggggtatactcatttacagcgggcgcagccggtgactttcgcacattggtgtctcgcatatgcagaaatgcttgcccgtgatgaaagccgtttgcaggatacgttaaaacggctggatgtcagtccgctgggatgtggcgcgttagcgggaacggcttataatattgatcgggaacaactggcttcatggcttggttttgcttctgcaacccgtaatagtctagacagcgtgtcagaccgtgatcatgtgctggaactgctgtcaaatgccagcatcagtatgatccatctttcgcgttttgccgaagatctgattttcttcaacagtggagaagcggactttattgaattatcggatcgggtaacgtctggttcctctttgatgcctcaaaagaaaaaccctgacgcactggaacttatccgtggtaaatgtggccgggtacagggtgcattgacaggtatgatgatgacattaaaagggctgcccctcgcttataacaaagatatgcaggaagataaggaagggttgtttgatgcgttggatacctggcgggtttgtctgcatatggcagcaatggtattggatggcattcagataaaacgtgagcgttgtcgggaggcggcaaagcagggctatgctaatgctacggaattagccgattatctggtggcaaaaggtgttccattccgtgaagcacatcacattgttggtgaagtagtgattgcggcaataaagaaaggtagggcgctggaggagttgtcattgtctgaattacaaaggttcagtgaaactatttcaatcgatgtatacgatattttatcattacagtcctgtctggataaacgtctggcaaaaggtggtgtggcacagaaacaggtaactctggctattgctgaggcaaagcagaggcta

SEQ ID NO: 24158 - DNA, 1236 bp, Xenorhabdus nematophilus
gctacctctatgacaacgacgactacttcggtaaaaaacagtattaaaaagattgtgctggcatattctggcggtttggatacttctgccatcattccgtggctgaaagaacattatggcaattgtgatgttatcgcatttgtcgcagatgttggtcagagccgtgaagatttggagggtatagaacaaaaagcattgcgttccggggcctcagaatgccatatcgccgatctgcgtgaagaattcatcaaagaatatgtttatccggtactgaaaaccggagcattgtacgaaggcagttatttgctcggtacttcaatggctcgcccgattatcgccaaagcgcaggttgaactggccctgaaagtgggggctgatgcgctggcgcatggggcgactggtaaagggaatgatcaggttcgttttgagagtacttatacggcattggctccacatctgaaagtcgtcgccccgtggcgagagtgggatctgcgttcccgcgaagcgttgctggattatctgaaagtccgcgatattcctactacggcaacgctggaaaaaatttacagccgtgatgaaaacgcgtggcacatttccaccgaaggtggcgtattggaaaatacgtggaatgcggcgaataaagattgctgggagtggactgtagagccggaagatgctcctgacgaacctgaatatctttctgtcactgttgagaaaggagaggttgtcggagtcaatgggaagatactgtcaccatatcaatgtcttaatgaattgaatgagctgggtgctaaacatggtattggccggatcgatattgtagaaaaccgtctggtcggaatgaagtcccgtggctgctatgaaacaccgggaggaaccatcatgatggcggctctgcgtggtattgaacaattagttctggatcgtgacagttttaaatggcgtcagcagctgggtctggagatgtcttatgttgtttacgatgggcgctggttcgtgccgctgcgtcagtctattcaggctgcggcagagatgctggccgagaatgtcagtggtgaagtgatcctgaagctgtataaggggcaggtgacagccactcagaaaacgtctcctcatagcctctattctgaagagtttgctacttttggcgaggatgaagtttatgatcacagccatgctgaagggtttatccgcctccattcgctttcttcccgcattcgtgcgctgaaaagcaaa

SEQ ID NO: 24159 - DNA, 774 bp, Xenorhabdus nematophilus
ctgatggagccattagttatcaagctgggtggggtgttattagatagtgatgaagcgctggtacgattattttccacattacagttatatcgaaaaacgcataaacgtcctttagtcattgtacatgggggcggttgtttagttgatgaactgatgcagaaattacagttgccgattatcaagaaacagggcctgcgtgtaacgccagcagatcagattgatattattaccgggacactggctggtacagccaataaaaccttactctcctgggcgataaaataccgtttacctgcggttggtctatgtttgggtgatggctgtgttgtgaaagtttctccgtttaacgaggaatttggtcacacgggcatggcttctcccggtaatccggatttactgaaaattttactggatatcggttatatccccattattagctctattggtattacagaagacggcaaattaatgaatgtgaatgcagatcaagctgctacagctgtcgcacagtcactgaatgccgatttagtttttctgtcagatgtcagcggtattctgaacggaaaaggcaacaagatccctgaagtatcagaaaaagaaatacagcagatgattgaacagggtgtgattactgacggcatggttgtgaaagtccatgcagcactggaagccgcaaaaacactggggcgtccggtggatatcgccagttggcgttatgctgatcaactgattgctctatttaatggtatatccgttggcacccgcattctggca

SEQ ID NO: 24160 - DNA, 1002 bp, Xenorhabdus nematophilus
atgcttaatacgctgatagttggtgccagtggctataccggagcagagttagcagcatgtctgcaacgccatccttatatacatcttgcgggtctgatggtttctgctcaaagctctgatgccggaaagtgcttgtcagaactttacccacagtataaaggaacccttgatttacctttacagccgttaactgatgtggctgaagccgcaagcggtattgatatcgttttccttgctactgcacacgaagtcagccatgacattgctccggaatttctacaggcaggctgtatcgtatttgatttatctggtgcctatcgcgtacaaaatacactgttttattcagaatactacggatttgagcataaaaatatcgattggcttgagcaggcggtatatgggctggcggaatggcaggcggagaaaattaaaacagctcagctgatcgcggttccgggttgttaccctacggtttcacagctttcgctgaaaccactgctggaagctggtttgctggatacaggacagtggcccgttattaatgctgtcagtggtgtgagtggagccgggcgtaaggcgtcgataaataataatttttgtgaagtcagtttacagccttacggtgttttcaatcatcgccaccagccggaaattgctacacatttagggatagatgtgattttcaccccccatttgggcaattttgcgcgagggatcctagctacgattacctgcaagctgaaagccggtatcacagaagaacaagtcaggcatgcatatcaacaggcgtatcacgataagccacttattcggttatatgaaaacggtgttcctgccctgaaaggggtcgtcgggttgccattctgtgatattggttttgctgtacaagggcagcatctgattattgtcggggctgaggataatcttctgaaaggtgcagcagcgcaggcagtgcagtgtatgaatattcgcttcgggttcgaagaaactcaggcgttactt

SEQ ID NO: 24161 - DNA, 2634 bp, Xenorhabdus nematophilus
atgaatcaacaatattccgcaatgcgaagtaatgtcagtatgcttggtaagatactgggaaacacgatcaaagaggctcagggaaaggatattcttgataaagttgaaacgataaggaagctatccaaatcatcccgtgccggaaatgacgctgatcgccagcaactgttatcgacactgcaaaatttatctaatgatgaattactgccggttgccagagcgtttaaccagtttcttaatttggccaatgctgctgaacaatatcacagcatctcaccgcatggtgaagcagccagtaacccggttgcattagcagcactctttgaacggctgaaaagtaaaaacttcaataatgatgatttggttcaggcggtcaatgaactttccattgaactggtgctgaccgcgcatccgacagaaattgcccgtcgcactctgatccataaactggttgaagtgaatacttgtctggcacagctggatcatgatgatttggctgattacgagcataacaatatcatgcgtcgtttacgccagttgattgctcagtcctggcatactgatgaaatccgcaagatccgtcctaccccgattgatgaagcgaaatggggttttgcggtagtggaaaatagcctgtgggaaggtgttcctgcgtttttgcgtgaattcaatgagcaattggaagaatctatcggttacagcttaccggtagagtctgtgccaatccgttttacttcctggatggggggcgaccgggatggaaatcctaacgtcaccgcagaagttacccgccatgtgctgttacttagtcgctggaaagccgctgacctgtttctgaaggatattcaggttctggtatccgagctttcgatgtcggaatgtacgccagagctgcgccagctggcaggaggagatgagattatcgagccttatcgtgaaattgctaaacagttgcgtactcaattaaataatacgctggcatatctggaaaaacgcctgaaaggtgaacaggttatccctcccgcagatttattgctgcataacgatcaattgtggcagccgctttatgcctgttaccagtctctgaaagcctgcggtatggaaattatcgccgatggtcagttgctggatattctgcgtcgtatccgttgtttcggtctgtcactggttcgcattgatattcgtcaggaaagtacccgtcatactgatgctatcgccgagctgacccgatatctggaaatgggcgattatgcgagctggtcagaaacagagaaacaggcctttttgttgcgtgaactgaattcgaaacgcccgctaattcctcgtcactggcagccaagtgcagaaacccaggaagtattggaaacctgtaaagtcattgcagaatcgccaccggatgcgattgccgcctatgtgatttctatggcgaaagtcccttcagatgtactggcagtgaaattactgctaaaagctgcggattgttcattgtcattacctgttgcaccattatttgaaacgcttgatgacctgaataacgcggaaagcgtgatccagcaattgctccatatcgaatggtatcgtgaactgattcaggataaacaaatggtcatgattggctattctgactcagcaaaagatgcgggcgtgatggcagcatcgtgggcacagtatcgtgctcaggatgcactgatcagagtgtgtgaaaaagaaggtgtgaaactgacactgtttcacggtcggggaggaacaatcggacgtggtggtgctccggcacattcggcattactttctcagccgccgggcagcctgaaaggagggttgcgtgtaacagagcagggagaaatgatccgctttaagttcggcttgccacaggtgacgattagtagtctggcaatgtacgccagcgccattttggaggcgaacttattgccaccaccggaaccgaaacctgaatggaagcaaatcatggatacgctttccgatatttcctgtgatatgtatcgtgattacgtccgcgagcagccggaatttgtgccttatttccgttcagcaactcctgaacaggaactggcgaagttaccgttaggctctcgccctgccaaacgccgtccgacaggtggagtagaaagcttgcgcgccattccgtggatttttgcgtggacgcaaaaccgcctgatgcttccggcatggctgggggcaggggctgcattacagcatgtgatagaggctggtcagcaggatactttgtctgaaatgtcccgtgactggccattttttacgacgcgtatcgctatgctggagatggttttcgccaaggctgatttatggctggcagaatattatgaccaacgtctggttgataaaaaactgtggccgctgggtacgaaactgcgtaatcaacttttagccgatatcgagactgttctggccgtttcacgtgatgggcaactgatggcggatctgccgtggatagctgaatccatcgcattgcgtaatgtttatacagacccgctgaatgttttacaggcagagttattacaacgctcccgccagcaggaacagcctgatcctcgtgtcgagctggcgctgatggtaacaatagcaggggttgcggcggggatgcgcaatacaggt

SEQ ID NO: 24162 - DNA, 2433 bp, Xenorhabdus nematophilus
atggttgaactggcaatagcgggggcggaatcgggccgccagttacataaatttggcggtagcagccttgcggacgtgaaatgttataagcgggttgcggatattatggcgaactacagccagccgggtgatttaatggtggtatcggcggcggggagtacgacgaaccagctgattgactggctgaaattgagccagaatgatcgtatttcagcgcatcaggttcagcaggccttacggcgttatcagcaggaattaatccggggactgttgccagaagctgtcgccgaaacactgatcgcagattttgttgctgatttggaaaggctgagtgcattactggataaaccggtgagtgatattacctacgctgaagttgttggtcatggtgaaatatggtctgcccgcctgatggccgcagtgcttgaatctcagggtatttccagcgcatggctggatgcgcgtcagttcttgcgggctgaacgggcagcccagccgcaggttgatgttatcttatcccagcctttattgagccagttattagttgagaattctgataagcgtctggtggtaacaggtttcatatccagtaacaacaaaggagaaaccgtactattagggcgcaatggcagtgactattctgctactcaggttggggcattagcaggtgccaaaaaagtgactatctggagtgatgtggccggagtttacagtgccgacccacgtaaagtcagcgacgcgtgcctgttgccattattgcgtctggatgaagccagtgaactggcgcgtctggctgctcctgtacttcatacccgaacattacagcctgtttcgctcagtgatatcgatttgcaattacgttgcagttaccagcctgaacagggttctacccgtattgaacgggtgctggcatcaggaatgggagcaaaaattgtgaccagccacgatgatgtctgcctgattgagttacaccttttttcggccctcgattttaaacaaacttataaagatatcgactcattgctgaagcgcgcccaaatcaggccgttggcgacagggctgcatactgactgcaatttgattcagctttgttatacctctgaaatagttaacagtgcccttgaagtattacaggatgcctctttgccgggaaaactttccttgcgcgaagggttttctctggtggcgttggtcggggcaggagtatgtaaaaatccgttgcatagccaccgtttttatcagcagcttaaagaccagccggttgagtttatctggcatgctgaagatgatatcagtctggttgctgtactgcgcttgggccagacatctcatctgattcagggactacatcagagtttgttccgggcagaaaaacagatcggtttggttctgtttggaaaaggtaatattggttcacgctggctagagctgtttgcgcgtgaacagaaaaatatctcggcgcgcagtgattttgaattcattctggcaggcattgttgatagtcgccgaagcctgctgaattatcaggggattgatgcaagccgggcattggcattcttcaatgatgaggccaccactcatgcagatgatgaactgtttttgtggatgcgggcacacccttatgatgatttggtcgtacttgatgtgacggcgagtgaggagttggcgggtaactacatcgattttgccagttatggtttccatgtgattagcgctaataaggctgctggtgcctccgacagtaatacttatcgcatgatccgggatgcttttacaaaaacaggccgccactggttatataacgcaactgttggtgcagggttacccattaactattctgtcagggacttgcgggaaagcggcgatacgatcctgtctatcagtgggattttctctggtacattatcgtggctgttcctccagtttgatggcacagttcctttcagcgatctggtggaacaggcatggcaacaagggctaacagagcctgatccccgcattgatctttcaggtcaggatgtgatgcgtaagctagtgattctggctcgtgaggctggctatgagattgagccggatcaggtgcggatagaatcacttgtaccaccagaagccagcgttggctcgattgacgagttttttgaaaacagctctgcgattaatgagcagatgcagaaacggctggaagctgcgcgtgaaatgggcatggtactgcgttatgtggcgcgctttgatgccaaaggtaaggctaaagtaggagtggaagcggtgcgttcagagcatcccttagcttcgttattaccgggggataatgtgttcgccatagaaagccgctggtatcgtgataaccctctggtcattcgtggcccgggcgcagggcgtgatgtcacggccggcgcgattcagtcagatttgaatcgtttatcgcaactttta

SEQ ID NO: 24163 - DNA, 1140 bp, Xenorhabdus nematophilus
aaacaagcaacggctgcagttcaaagtggtattaatgttgacgaacaatatggctgtgttgttcctcccgtctatctttccagtacgtataatttcacaggattcaatgaaccgagagcgcatgactattcccggcgcggtaatccggggcgtgatgttgtccagcaggttctggctgaactggaaggcggtgcaggggctgtgatgaccagcagcgggatgtcagcgattcacttgttatgcacggtgttcttacagcccggagatctgctggtggctccccatgattgctacggcgggagttatcgcctgtttgacagtttaagccgccgtggagcctacaatgttatttttgtggatcagtcggatggtgcagcactgaggcaggctcttgcccaaaagcccaaactggtattgattgagacacccagtaatccgctgctgcggatcgtggatatccggtacatctgtgaactggctcgtgaagccggtgcattaacggtagtcgataacacatttctgagtcccgtcttacagaaaccactggatttgggcgcagatttggttgttcattcctgtacaaaatacctgaatgggcactctgatttaattgctggtgcggtggttgccaaagatcccgctattgccgaggatttggcatggtgggcgaataatatcggcgtaacaggcggggcttttgacagttatctgctgttgcggggaattcgtacattatcagcccgggtacttctacagcaaaataatgcggctgccattgcggaatatctgcaacagcagccacaggtgaaaaaactctattatccggggctgaaagatcatccgggtcatgaaatagcactccggcagcaggccggatttggtgcgatgctgagttttgaacttgctggtgatgagcaaacaatgcgtggctttttatctgcgttaaaattatttactctggccgaatcgctgggtggtgtggaatcattgatttctcatactgcaacgatgacacatgccggtatgtcggcagaagcaaggaaacaggcgggaattacggattcacttcttcgtatctcggtgggaatagaagacagtcaggatttaattgctgatctggatagtgcatttcaggcagcg

SEQ ID NO: 24164 - DNA, 1497 bp, Xenorhabdus nematophilus
actgataaaaaatatatcgttgcgctggatcagggaacaaccagctcaagggcggtgattcttgatcacgatgccaatattgtcagtatttcacaacgtgaatttccgcaaatataccctaaaccaggctgggtggaacatgatccgatggaaatctgggccagccaaagctcaacgctggttgaggtattggcaaaagccgatattcgctcagaccaaattgccagtatcgggatcacgaatcaacgggaaacaacgattgtctgggaaaaagagacaggtaaacccgtttacaatgccattgtatggcaatgtcgccgaaccgcagatatctgtacccgcctgaagaaaaaagaaggtctggaagagtatatccgtcataacactggtctggttatcgacccttatttttccggaacaaaaataaaatggattctggataacgttgagggtgtccgccaacgtgctgaaaatggtgaactgctgtttggtaccgttgatacctggctggtctggaaaatgacacaaggtcgcgtacatattaccgactataccaacgcttcccgcactatgctgtttaacatccatgacctcgactgggatcagaagatccttgatgaactggatattcctcgcgtgatgctgccaaaagttgcggcctcctctgcaatttatggtcagactaatatcggtggtaaaggcggtactcgtattcctattgcaggtatcgcaggcgatcagcaagccgcactgtacggccagctatgtgtccatccgggcatggcaaaaaatacttatggcactggctgcttcctgctgatgaataccggcaccgatgcagtacgctccagccacggtttgctgaccacgatagcctgtggcccacggggagaagtgaattatgctctggaaggtgccgtgtttgtgggaggagcctcaatccagtggctgcgtgatgaactgaaactcatcgctgatgcagcagactccgaatacttcgccacaaaagtacaagacagcaatggcgtttatgttgttccggcctttaccgggcttggtgcgccttattgggacccgtacgcccgtggtgccatttttgggctgacccgcggagcaaacagcaaccacattatccgagcaacgcttgaatcaatcgcttaccagacccgtgacgtactggatgcaatgcaggctgattccggcgcacgtttacaggcgctgcgcgtagacggtggagcggtcgcgaataatttcctgatgcagttccagtctgacatcctcggcactcgtgtagagcgccctgaagtccgtgaaagtactgcattaggtgcggcattccttgctggtctggctgtcggcttctggaaggatcttgatgaagtgaaaagtaaagcgaccatcgaaaaagaattccgccctggcatagaaaccacagagcgtaaccacaaatacaatggctggaaaaaagctgttgcccgtgctcaggaatgggaagac

SEQ ID NO: 24165 - DNA, 765 bp, Xenorhabdus nematophilus
atgcgacatccattagttatgggtaactggaaactcaatggcagtacccacacggttaacgacctgattgcaggcctgcgtaaagaactgagcaacgttgacggctgtggcgtcgctattgcaccaccaactgtttatgtcactctggcaaataatgccctggctggtagccgtatcgctctgggcgcacaagatgtaggcattaacctttccggcgcatatacaggcgaaacatccgcagaaatgctgaaagatgtaggcgcaaaatatatcattatcggtcactccgaacgccgtacttaccacaaagaaagcgacgagttcattgcgaaaaaattcgctatcctgaaagaacaggggcttattccggttctgtgtatcggcgaaactgaacaagaaaacgaagcaggccagacagaagccgtctgcgcgcgccagattgatgccgttctgaacacactgggcgcagaagcgtttaaaaacaccgttattgcttacgaacctgtctgggccatcggcaccggaaaatccgctactcctgcacaagcacaggctgttcacaaattcattcgtgatcacattgctaaacaggatgcggctatcgctgagcaagtcattattcaatacggtggctctgttaacgccagcaacgcagcagaattgtttactcagccagacatcgatggtgctctggttggcggagcatcactgaaagctgatgcatttgccgttatcgtaaaagcagcagctgaagcgaaaaaagcc

SEQ ID NO: 24166 - DNA, 963 bp, Xenorhabdus nematophilus
attaaaagaatcggagtcttaacaagcggtggagatgcaccgggtatgaacgccgctattcgtggagttgttcgtgccgctttaaccgaagggttagaggtttatggtatttatgatggctatctggggctgtatgaaaacaggatgaaaaagctcgaccgctacagtgtttccgacatgattaaccgtggcggcacgtttttaggttccgcacgttttcctgagttcagggatgataaagtgcgtgaaattgctatcgaaaacatgcgtaagaatgaaattgatgcgctggtggtaattggtggtgatggttcttatctgggagcgaaaaaactgactgaggcgggtttcccctgcattggcctgcccggtacgattgataatgatgttgcgggaacagattacacaatcggttattttacagcgctggatacggttgttgaagctattgaccgtctgcgcgatacctcaacctcccacaagcgtatttctattgttgaagtgatgggacgttactgcggtgatttgacgttgtctgcggcaattgcaggtggatgtgagtttatcgtgctgcctgaacgtgaaattccgtttgatcgcgaagaattgttagctgaaattcaagcgggcatccagaaaggcaagcgtcatgccattgttgcgattactgagcatgtctgtgatgttgatgagctggcaaaatatattgaagcggaaacacgccacgaaacgcgggcaacggtattaggtcatattcagcgtggtggtgcgccagtggcttatgaccgtattctggcatcacgcatgggggcgtattctgttcagctgttgctggaagggtgcggcggccgttgtgttggtatccagaacgaaaaacttgtccaccatgacattattgatgcggtgcagaatatgcagcgtatcttcaagaaagattggttagaaacagcgaagaaactttac

SEQ ID NO: 24167 - DNA, 888 bp, Xenorhabdus nematophilus
tttgaagagcaattaagcaattgccagcaacatatcaatgagaagttgatggcaacattttcttcgctcccctttttaggcagcccgttagcaactgctatgcagcacggtgctgtattgggtggaaaacggctgcgtccatttctggtttacgcagtaggtaaaatgcttggactgcccaaagagagccttgatgcgccagccctcgctatagagtgcattcacgcttattctctgatccacgacgatttacccgcaatggacaacgatgatttacgccgaggtcagcctacctgccatataaaatttggtgaaaatcatgccattctggccggagatgctttgcagtcgttagcatttgagatcctggcaaaacacaacatgccaaatatcgcactatctgatcgccttgagatggttgctgaattagcaatatccagtggtattgctggtatgtgcggcgggcagtcactggatttgcaggctgaaggaaaacaaattgatctggcagctctggaaaaaattcaccaacacaagacgggtgcgctaattcgttgtgcagtcaggcttggcgcgtatggcgctggtgcacgtggccgggaagtattacctttactcgatcagtatgcccaagctattggcctcgcgtttcaggttcatgatgatattctggatgtcattggcaatacagaaattatcggcaaacgtcaggggaacgatcagcagcttggtaaaagtacctatcccgccttactgggattagagcaggctcagaaaaaagccaaagatctgcatgaagatgctattgccgctctcacagaactggaaaaacaattctataatactgtgactctaaaacagctggcgggcttcatcattgagagaaac

SEQ ID NO: 24168 - DNA, 1857 bp, Xenorhabdus nematophilus
atgagcattgatatagcgaaatatccaacattggcattggcggaaacccctgaagagcttcgcctgctacctaaagacacgttgccaaagttatgcgatgaactgcgccaatttttgctaaacagtgtcagtcgctccagcggccacttcgcttccggccttggaactatcgaattaaccgtcgcactccattatgtttataagacccccttcgacaatttagtctgggatgtcggtcatcaggcttatccacataaaattctgaccgggcgccgtgaccgtatcaacactatccgccagaaaaatggcctccatcctttcccgtggcggaatgagagtgaatatgacactctttgtgtcggacactcatcaacctcaatcagcgccggtttaggtatggcaattgcggcaaaacatgaagataaaggccgcaaaacagtttgtgtgattggtgatggcgccattaccgcaggtatggcttttgaggccatgaaccatgcaggagatatcgatcccgatatgctcgtcattcttaatgacaatgaaatgtcgatatctgagaacgttggcgcactgaacaaccatctggcacagcttctttccggtaagttatatacgactctgcgcgaaagcggcaaaaaagtcttttccggtctgcctcctatcaaagaattgctgaaaaagactgaagaacacctcaagggtatggttgttcccgggactctattcgaagagcttgggtttaactatatcggccctgttgatggtcatgacgtactggcactaactcagacactgaaaaacatgcgtgaactgaaagggccacaatttctgcatatcatgaccaaaaaaggccgtggatatgctcctgcggaaaaagatcctatcagttggcacgccgttcctaaatttgatccatcaacaggttctctgccaaaaagctcagatacccgcccgacattctcgaaaatttttggtgaatggttatgcgaagaagctgccactgacaaaaaacttatggcgatcacgcccgctatgagagaaggctcaggcatggtgcgtttctcccgtgaatatccagagcaatactttgatgttgccattgctgaacaacatgctgtgacatttgcagcaggtctggccattgggggatataagcctgttgttgcgatttactcgactttcctgcaacgtgcttatgatcagctcatccatgatgtggctatccagaacttacctgtcctgtttgccatcgatcgtggtggaattgtcggtgctgacgggcagactcatcagggtgcctttgatctttcattcctgcgctgtattcccaatatggttattatggcaccaagtgatgaaaatgagtgccgacagatgttgcataccggctaccaatatcaagagggtccagtcgctgtccgttatcctcgcggcgcgggcacaggcgcagagcttcagccactggaaatattacccattggcaaaggcgttatccgccgtcagggagaaaaaattgccattctgaactttggtacgttactgccaaacgcattacaggctgctgaatccctgaatgcaaccgttgttgatatgcgttttgtcaaaccacttgataaagaactggttctggagatggcttcccgacatgatttgctggtaacgctggaagaaaatgccatcatgggcggtgcaggcagtggggttaatgaactactaatgcaaacagggaactcagtttcagtgttaaacctcgggttacctgattactttatacctcagggcacacaggcagaacttcattctgatttagggttagattccgctggcattttaaacgctatcgagaaacgcctt

SEQ ID NO: 24169 - DNA, 987 bp, Xenorhabdus nematophilus
tttcctggccgtcgtatgcgccgtgtacgccgccatgatttttcccgccgtttagtcgctgaaaatcaactcactgttaatgacttaatctatccggtgttcgtgatggaaggtactaatcagcgtcaggaagtgccttccatgccgggagtatatcgtttgacaaccgatcttctgctgaaagaagccgaagagattgcccgattgggtatccctgtcttgtctctgtttccggtcattgaatctgataaaaaatcactggacgcgaaagaagcttataatccggatggtttgattcaacgctctatccgtgcactgaaagatgcagttcctgaattggggttactgaccgatgtggcgctggatccttttacaacacatgggcaggatggggtcattgatcaggatggttatgttatcaacgatattaccaaagagattttggtcaaacaggcgttatctcatgcagaagcaggggctgaaatcgttgcaccaagcgatatgatggatgggcgtattggggcgattcgcgaacaacttgagaatgacgggtatgtaaacacccagattatggcttattctgccaaatatgcttcctgctattacggacccttccgtgatgcgataggctccagcgctaatctgaaaggtggcaacaagatgacctatcagatggatccggcaaacagtgatgaagcattgcaggaaatcgcacaggatctacaggaaggggctgatagcgtgatggtaaaacccgggatgccttatctggatgtgatccgcagagtaaaagatactttcggcgtaccgacatttgcttatcaggtatccggtgaatatgcgatgcatatggctgctattcagaacggttggctgaaagaacaaccagcaattatggagtcgttactctgttttaaacgggcaggggctgatgggatcctgacttactttgccaaacgtgcggcacaatggttgcatgagcaaaag

SEQ ID NO: 24170 - DNA, 1620 bp, Xenorhabdus nematophilus
atgacgcccagtgaaataaagcgcctctattttatcattaaagttttcctcacctatggattggatgagctgatcccaaagatccgtctgacatggccattgcgttttgggcgctatttcctgttctggctgcctaaccgacacaaggataaaccactaggagaacgcttacgtctggcattacaggagcttgggccggtatggattaagcttggtcagatgctgtctacccgccgtgatctctttcctcctgaaattgctgatcaactttccctcttgcaggatcgcgttgtttctttcgatggtgctgttgcgcgtcaatccattgaaaccgcattgggtggtgctctggaaacgtggtttgaagattttgagcagcaacctctggcttctgcctccattgctcaggtacatactgcgcgtttgaaagagaacggaagaaatattgtcattaaagtgatccgccccgatattctgcccgtgataaaggcagatgtccggttaatgtatcgtttagctaatctggttcctttattacccgatggccgtcgtcttcgcccacttgaagtggttcgtgaatatgaaaaaacgttgcttgatgaattgaacctgttgcgggaagctgcaaatgctattcaactgcggcgtaattttgaaaagagtccgatgctttacgtgccggaagtttatcctgattattgccgggaaaacgtactggtgatggagcgtatttatggtattcctgtatccgatgtcgctgcattagaagcacagaataccaatatgaaattacttgctgaacgcggtgttcaaatcttttttacccaggtattccgcgacagcttttttcatgccgatatgcatccgggcaatatctttgtgagccgtgaacgcccggaagaccctacttatatcggcattgattacggtattgtcggttctctgaataaagacgataagcgctatcttgctgaaaactttatagctttctttaatcgagattatcgtaaagttgctgagttgcatgtggattcaggctgggttccggcagacactaatgtagaagattttgagtttgccatcagaacggtatgtgagcctatttttgaaaaaccactggcagatatttcatttggtcatgtgttattgaatcttttcaatacggcccgtcgttttaatatggcagtgcaaccacagctcgttttattgcagaagacactactgtatgttgaaggtttgggacggcaattatacccacagctcgatttatggaaaacagcaaaaccatttctggaagactggctgcatgatcaggttggtattccggctatcatgcgagcgtttaaagaaaaagccccttattgggcggaaaaactgccggaactgcctgaattggtttatggcacactgcaacaacataaacgtttgcaaacgagcattgatcagatatcactacagttaaaacaacaacggcataatcagcagaaacccctttacttacttgggattggtgcaacactgtttatctgtggtggtttgttttttatttctaatctggtccatctggcatcagggttaattggagcaggaatagtatcgtggctactgggctggtttaag

SEQ ID NO: 24171 - DNA, 1344 bp, Xenorhabdus nematophilus
caaaatcgacctgatgagaaacaacgcctagaggatttgatatgcctccgcaaaaattttaaagccagtctgaatgaaatggcggaagcgatttcttgtgatttcggccaccgttctaggcatgagagcataatggcagaagcggtaattgtgttgaatgaaattgatctttgcctgcgctctcttaaaaagtgggctaaacctcaaagatacaaggctggatggcaattatggccggcaaaggctgaaatacgccatgtaccacttggcgttgttggtatcatggcaccgtggaactatccggtgaatttgaccctcataccattaatagccgcgattgccgcaggtaatcatgtttttatcaagccttcagagcatacactgcacaccaatgcctatttagaaaaactactcagcaaaatttttcctgaaaatcgcgtcagtatcgcacaaggtggagcagatcttgcggccgatttttctgccctcccctttgatcacctgttgttcacgggttctaaggcgaatggtaaaaaagtcatggcagctgccgcacaaaaccttacccctgttacgctggagcttggcggaaaatctccggcactggttgctcccgatgccgatctgaaaaaagcggctgcccgcattataacgggcaaactattcaattcaggacaaacctgtatagcaccagattatattttattgtcggaaaacgtcattgagccgtttatcgcagagattaaggaacaagtatcgaaacgctatccccaaccaaataactttccagactatacaagtattatcaatgacaaccagtatcagcgtcttatcaaattacttgaagatgccattactcgtggtcatcaaaccattccacttatgcctctaactgatcaagaacaagcacttaaacagcgtgttttcgctcctacgctagttctgaaccctgacgatagcagcgccattatgcaagaagaaatttttggccccctgataccagtcaaaacctaccgttcttatgatgaagcaatccactatattgcaagtcatgaacgcccattagccttttattgttttagccgaaataacaagtacattgaagcggctttatcgcatatcgtcgcaggtagtatctgcatcaatgacacgctataccaatttgcatgtacaggcttaccctttggtggcgtaggcccaagcggtatggggcaatatcatggttatgaagggtttaaaaccttttccaaggccatgcctattttgcgcaaatacaatccgtcactgacagatctgctacgtccaccttatggtcagtttattaatatggttatccgcattctc

SEQ ID NO: 24172 - DNA, 642 bp, Xenorhabdus nematophilus
atgttacaggtatatcttgttcgtcatggcgaaacagaatggaacttggctcgtcgtattcagggacaatctgacagcccattaactgaaaccggacgacgtcaggcactcttggtagcacaaaaagtaaaatcagagaacatcacacatgttatcactagtgacctcggtcgcacacgccaaaccgcagaaattatcgcacaagcttgcggttgtgaagtgatattagagcctcgtttacgggaaataaacatgggtgttcttgaaaaccgtgatctgaattccctgacccaagaagaagaaacatggcgtaaaagtctcgttgatggcacaccaaatggtcggataccagaaggcgaatccatgagtgagttatccgaacgggtgcgtgccgcgctggaaagttgccgtgatctgccagccggaagccgccctttactagtaagccacgggatggcattagtcagtctggtctgttcaattttaggattaccggccaactccgaacgccgcttacggctgagaaactgttctatctcaagagtcgattatcaggatagcccgtggctggctcctggatggatcgttgaaacagcgggcgatatcacacatctggatatgcccgcgctagatgagctgcaa

SEQ ID NO: 24173 - DNA, 1620 bp, Xenorhabdus nematophilus
ttggctcaatatgtttacagtatgcaccgggttggaaaaattgttcccccgaaaaggcatattctgaaaaatatctctcttagttttttccccggagcaaaaatcggtgttcttggtctgaatggtgccggtaaatcgaccttactgcgtatcatggcgggcattgataaagatattgagggggaagctcgcccacagcctgggattaaaatcggctatttgccacaggagcctaaacttaatcttgagcacactgttcgcgaagcggtagaagaagccgttggcgaagttaaacatgcgctgacacgtcttgatgaagtgtatgctgcatatgctgatcctgatgcagattttgacaagctggcaaaagagcagggtgaactggaagcgattattcagtctcacgatggtcataatctggataatcagcttgagagagcggcagatgctctgcgtttacctgcatgggatgctaaaattgagcacctgtcagggggggaacgtcgccgtgtggcaatttgtcgcctgctgctggaaaaaccagacatgctgctgctggatgaaccaaccaaccaccttgatgcagaatctgtggcgtggctggaacgcttcctgcacgattatgaaggcaccgtcgttgcaattacccatgaccgttatttcctcgataatgtggctggctggattttggaacttgaccgtggtgaaggtattccgtgggaaggtaactactcttcatggctggagcaaaaagatgctcgtctggcgcaggaagctgcttcagaagcggctcgccgtaaatccattgagaaagaactggaatgggttcgtcagaatccaaaagggcgtcaggctaaaggtaaggctcgtttggcccgctttgaagaacttaacaatgttgagtatcaaaagcgtaatgaaaccagtgagttgtttattccaccaggcccacgtctgggagacaaagtactggaagtcagcaacctgaccaaatcttatggtgatcgtgttctgatcgatgacctgagtttttctctgccaaaaggcgcaattgtcgggattattggtccgaatggtgccggtaaatcaactctgttccgtatgttgtcaggtcaggaacagcctgattccggttcaatcgcgctgggtgaaacagtaacactggcctctgttgaccagttccgcgatgccatggatgataagaaaacggtatgggaagaagtttctggtgggcaggatattatgcgcattggtaactttgagatcccaagccgcgcctatgttggccgctttaactttaagggtgtggatcagggcaagcgcgtgggtgaattatccggtggtgagcgtggccgtctgcatctggcaaaacttctacaggttggtggcaacatgttgctgctggatgaaccaaccaatgatctggatatcgaaacactgcgtgcactggaaaatgccctgctggaattccctggctgtgcgatggttatttcccatgaccgctggttccttgaccgcattgcaacgcacattatcgattatcaggatgaaggtaaagtgactttctttgaaggaaactttagcgaatacgaagattacaagaagcgtactctgggtgct

SEQ ID NO: 24174 - DNA, 702 bp, Xenorhabdus nematophilus
gtgggttatcgctctattgatacagccgcgatttatcacaatgaaacaggcgtcggaaaagcattgcgggaaagttgtatcccacgcgaggaagtttttatcacaactaagctgtggaatgatcgccatcaagatgccaaaaccgcactgcaagagagtctggatagattacagctggaatatattgatctctttctaattcactggccggttccccagcaggataagtatgttgaaacatggaaacaatttattgagttaaaagaatcggggctcgcccgcagtatcggggtatgtaactttcatattgaacatttgcagaaactattttcagaaacaggcattgtgcctgctatcaatcaaatcgaactgcatcccctgatgcaacagaggcaactgcattcatggaatgccacacaccacattattactgaatcctggagtccgttatcccgcggtggtaaaggtgtttttgatcatccattagttgaaagtctggcaattaaatatgataaaacacctgctcagattgttatccgctggcacctcgacagtggcatgattgctattcctaaatcagtaacgccttcccgcattaaagaaaactttgatgtttttgatttcaggctggagaaagaggatctgacaattatggccggattggatattggtaaacgccttggccccaatcccgatacttat

SEQ ID NO: 24175 - DNA, 1185 bp, Xenorhabdus nematophilus
gatatgtcagaaaaaaaattggaaaccagactggtggaagtcgggagaaagcgtaaatacacacagggagcggttaatcctattatccagcgcacttcatccgtcattttcaagacggttgatgctatgaggcatgcgataaaaaaccgggctaacggtgaactgttttacgggcgccgtggcactctgacgcattttgcttttcaggaagcaatggctgaactggagggtggagtgggctgtgctttgtatccttcgggtactgccgctattaccaacagcattctggcatttgtagaaacaggtgaccatgttctgctaaccggttcagcttatgaaccgactcaggaattttgcaaaaatatccttaaaaagatgcaaatctctactgattattttgatccccggctcggtgaagagattgccttactcattcagccaaacacaaaagtcatctttcttgaatcccccggctctcttactatggaggttcaggatattcccgctattgtacaggcggcccggcgggttaatcccgatatcgttattatgatcgataatacctgggctgcgggtgttcttttcagggcactggattttggtatcgatatttctattcagtccgcgacaaaatatattatcggccattcagatggcatgctcggtacggcggttgccaatcaacgctgttgggatcaattacgggaaagctcttatttgatggggcagattgctgatcctgatactgtttattctgcaaatcgaggattacatactctggctgtccgcttaaagcaacatgaagaaagcagccttatcattgctaaatggctctcccaacgccccgaagtcgctgaggtttatcaccctgcgctaccttcctgtcccggtcataactatttccaacgcgattttaccggttcctgcgggctgttttcttttatgttgaatgtcagcctgactcccggacagctctctgactatctggataatatgcaatattttaaaatggcattttcctggggaggatttgaatcactcattctgggcatttcccctgagtcactggcagtcctacgtaattataattttccccaaaaaacgggaacgttaattcgtgtgcatatcggactggaagaccctcaggatttaatagatgatctgaatgctggcttctcccgcatt

SEQ ID NO: 24176 - DNA, 1407 bp, Xenorhabdus nematophilus
tttcctgaaacttttctttggggtgcagcaaccagtgcttatcaggttgaaggtgcggcagaaaaatatggtaaaaaattatcccagcaagatattctcaataataaaccagggttagctgattcccatattaccagtgatcattatcatcgctacaaagaagatgttgcattaatgaaagaactgggattaaaagcctatcgtttttctatcgcatggtcgcgtatttttcctgatggcatcgggaaaccgaatgatgaaggcgtacagttttaccataatcttatcgatgaattattagaaaatggtattacaccaattccaacactttatcattatgatatgccaatggctttggtggaaaaatatcatggctggattgacaggcaaagtgtcaatgattttgcctactacgctgaatttgttatcagagaatatggcaagaaagccaaatactggctgacgattaatgaacaaagcattatcgtacaattctggacgaaaaaatgttttatccctgaacagtatctcgataatgaacagattaaatatcagataaatcatcacatgaatctggctcatgccatcgcctgcaaattagtccatcaatgggtgccggaaggtcaggttggtgcagcattgggatattcagccatttatccgctgaccagcaaaccagaagataatctggcggcccagaatgccaatgatctgcgtaattactatttcaccgatatttatttgaaaggggaatataatcaatccgctttgatttacctgaaaaatcaggggctggcacctaatatcgaagacggtgatatggcgttaatcaaagaaggatattctgattttctggctctcaattactattgcagccatgcagcaaccgcagcaccagaaggtgctcagaggcgcatggatggctttaatcctacaggtatcaaagggcaaatggacggttatgagatccagcctgattactatcagatccacaaaaacccacagcttgatactactgattgggattggacgattgatccgcatgggcttgaatatctgctacgcgatttatatacccgttatcaaaagccattaatgatcactgaaaatggctttggtgctgatgatgttctggaatctgatggcactattcatgatagttatcgcattgattatttaaagcagcacctacaggcgattaaacgggcaatggattccggcgttgtcgtactttcctataacccgtggagttttattgatcttctttccaccagcaatggttacaaaaagcggtatggttttgtgtacgtaaaccgcactgatgacgatctcaaagatctcgctcgttataagaaagattcgttttattggtatcagaacgttatccagacacgtggtggttcatta

SEQ ID NO: 24177 - DNA, 735 bp, Xenorhabdus nematophilus
aaagtcacaattatcacgggcggttcccgtggtattggcaaagcaacagcgcttgatctggccaagaaagggcatcatgtttgcattagttatcgttctcgtagagagcgcgcacaggaagttgtggacatgatccaaagcctggggcaatcggcactggctgttcagatggatgtaaccgatgaacagcaggttaccgctctgtttcagaaggcggaaaaggaactggggtatattaccgggctggtgaataatgcgggcattttaaaggctcagactaccattgagcagctaaccgctgagcgtttgaatgagatgtttgccaccaatatcacgggctattttctgtgtgccagagaggcagtcaaaagaatggctttccggcatggggggcagggtggggcgattattaatgtttcatcagcagcggcaaggttgggggctccctatgaatatatcgattatgccgcttcaaaaggggctgtagatacattgaccacggggttatctctggaagttgcggcgcagggaataagggtaaatgcagttcgccccggcttaatttataccgagatgcatgctgatggcggtgaacctgacagggttgacagaattaaagattccctgccgatgaaaagaggcgggcagcctgaagaggtcgcagcagcaattgcatggctgttatctgatgatgcatcgtatgtaacgggtaattttatggatttggcgggagga

SEQ ID NO: 24178 - DNA, 1107 bp, Xenorhabdus nematophilus
atgaaatcacgtgctgccgttgcctttgggccaaacagaccactcgaaattgttgaaattgatgtagcaccaccgaaagccggtgaagtactgatcaaagttagtcataccggtgtttgccatacggatgcttttacgctttcaggtgatgaccccgaaggtttattccctgttgtgctcggacacgaaggcgctggagtcgttattgaagttggtgaaggcgttaccagtgttaaacccggcgatcatgtcattccattatatacagctgaatgtggtcaatgtgatttttgccagtccggtaaaactaacctctgtattgccgttcgcgatactcagggaaaaggtctgatgcctgatgggacaacccgcttttcctacaacggacaacctgtttatcactatatgggatgctccacattcagcgaatataccgttgtagccgaggtttcactggcaaaaatcaacccggaagcaaatcatgaacatgtttgcctgttaggttgtggcgtaacgacaggtatcggtgctgtacataatacggctaaagttcaaccgggagattctgttgctgttttcgggctgggtggtatcgggcttgccgtccttcagggagcacgtcaggccaaagcaggccgtattatcgctattgataccaacccgactaagtttgaattagccagacaatttggtgctacagattgcatcaaccccaacgatcatgacaaacctattcagcaggttattctggatatgacgaaatggggagttgaccatactttcgaatgtattggtaacgtcaacgtcatgcgtgcagcgcttgaaagtgctcatcgtggctggggtcagtcagttattatcggtgttgcaggtgccggacaggagatttctactcgtccattccagcttgttaccggtcggacatggaaaggaacagcctttggcggtgttaaagggcgcagccagctaccgggaatggttgaagatgcaatgaagggtgaaattgagttggaacctttcgtgacacataaaatgccactggaagatattaatgaagcctttgagctgatgcatgaaggtaaatctatccggacggtaattcactac

SEQ ID NO: 24179 - DNA, 969 bp, Xenorhabdus nematophilus
atgaaagcattactgctggaacagcgcgatacattatcagcttctattcagaatattgacacaacccaacttccacccggtgatgtcatcgtcgatattcactggtcaaccctcaattataaagatgcacttgcgatcaccggcaaagggaaaatcatccgcgagtttccgatgattccggggatcgacttttccggcgttgttcgtcactcagaagatccccgttttcatatcggacagcaggttttattaaccggctggggtgtgggtgaaaatcgttggggtggtctggcagaacaggccagagtctcaggtgaatggctgacaccattgcctccgggtttaagtaccagacaagcaatgattatcggcacagccggtttcaccgccatgttatgtattatggcgctggaacagggaggtataacccctgaaagcggcgaaatcgcagtcacaggtgccactggcggagtcggaagcacggcaattactttgctctctctgttgggatattctgtggtcgctatcagcagcaaaccggaaagtcaggaatatttactttctctgggagcaaaagaaattctgccggtttcagacttcagccaacccgctcgcccgctggaaaaacagcgctggtcaggtgttattgatactgtcggtggtacaattctggccaaactgctggctcaggtatcgcataacggcacagtagctgcctgcgggatggcgagtgatatcaatctgcctaccactgtcatgccatttatcctgcgtaatgtccgcttacagggtgttgagtcagcaatagtatcggccgccgatagaccaaagatctgggagcggttacaaaaactgttgccggaatctttttatcaacagaccgcaaacgaaatttcattagatcaggtgatcgaacacgctaataagttggtaaacaatcagtcaacaggcagaacagtagtaaagatc

SEQ ID NO: 24180 - DNA, 438 bp, Xenorhabdus nematophilus
atggcagacaagtttcgcattttactcttgaacggtcccaacctgaatctgttgggaacgcgagagccagagacctacggcaagttaacgcttgatgacatcgtcagcaaactgtcacaagaagctcaccagtcgggtattgaattattccatctgcaatccaatgcagaatctgaactgattgagagaattcatactgcgcgggggaatacagattttattctgattaatcctgcggcattcacgcacaccagcgtagcgttacgcgatgcacttctggcggtggatattccattcattgagatccacctctctaatgtgcatgcccgcgagccattccgccatcattcatatctttctgatattgcagttggcgtgatctgtggtttgggtgctgatggctatagttttgcattacaggcagcggtcaaccgcttg

SEQ ID NO: 24181 - DNA, 1347 bp, Xenorhabdus nematophilus
atgcttgagaaaatagtcatagctaaccgcggtgaaatcgcactgcgtatcctgagagcctgtaaggagctcgggatcaaaactgttgctgtgcactctgcggcagaccgtgatctgaaacacgtcctgctggcagatgaaacggtctgtattggccctgctgcatcagtaaaaagttacctgaatattccggctatcatttctgcggctgaaatcacctgtgcacaggcaatccatccgggttatggattcctgtctgaaaacgctgattttgctgaacaggtggagcgttccggtttcacctttatcggcccgaaagcagaaactatccgcctgatgggtgataaagtttctgccatcagcgccatgaaaaaagccggtgtaccttgcgttcctggttctgacggccctttgggtgatgatactgagaagaacaaatcgatcgcacagcgcatcggttatccggtgatcatcaaggcttccggcggcggcggcgggcgtggtatgcgcgttgtccgcagtgataaagagctggaacagtctattgccatgactcgtgctgaagctaaagctgctttcaataatgacatggtttacatggaaaaattccttgaaaaccctcgtcacgttgaaattcaggtactggctgatggtcagggcaatgctctttatcttgctgaacgtgactgctcgatgcagcgtcgtcaccagaaagttgtggaagaagctcctgcaccaggtatttctgcggaattacgccgcagcatcggtgaacgctgtgccaacgcttgtatggaaatcggctatcgtggagcgggtacgtttgaattcctgtatgagaacggtgaattctatttcattgagatgaatacccgtattcaggttgaacaccctgttaccgaaatgatcactggcgttgatctgatcaaggaacagctacgcattgcttctggcatgccactgtccatcaagcaggaagatattgtcatcaaaggccatgctatcgaatgccgtattaatgccgaagatgcaaaaacgttcttgccaagcccgggaaaaatcacccatttccactctccaggtgggttcggcgtgcgctgggaatcccacatttatgcaggatataccgtaccgccatattatgactccatgatcggtaagctgatcacttatggagaaacccgtgaagtggcgattgcgcgtatgaagaacgcactggcagaactgatcattgatggcatcaaaaccaatatcgatttgcagatgtccatcatgaatgatgaaaacttccagaaaggcggaaccaatatccactatctggagaagaaactgggcttacatgataag

SEQ ID NO: 24182 - DNA, 1605 bp, Xenorhabdus nematophilus
ggcgttactgcgcaggagcttgcggtttatggtattcgtgatatcagcgaagttatctataacccaggctatgaattgttattttctgaagaaactaaatcctctttacagggatatgagaaaggaacattgaccaaccttggcgctgtcgcagtagatactgggatttttacagggcgttctcctaaagataaatacattgtacgtgatgaagtgactcgcgatacagtgtggtgggcagatcagggaaaaggtaagaacgataataaacctctcagtcaggaaacctggtctcatcttaaggggttagttactcagcagctttcaggcaaacgtttgtttgtggtcgatgcgttctgtggggcgaatgcggatactcgcctgaaagtgcgtttcatcacagaagtggcgtggcaggctcattttgtcaaaaacatgtttattcgcccttcggatgaagagctgatcgatttcacgccggacttcattgtgatgaacggtgctaagtgcacgaatccacaatggaaagagcagggcctgaactctgaaaactttgttgcttttaacctgacagaaagaatgcaattgatcggtggtacttggtatggcggtgagatgaaaaagggcatgttctcaatgatgaactacctgctgccactgaaaggtattgcttccatgcattgctccgctaacgtgggtgagcagggtgatgttgctgttttctttggtctttccggtacaggtaaaaccacgctttccactgatccgaaacgtaaactgatcggtgatgatgaacatggctgggatgacgacggcgtatttaactttgaaggtggttgttatgcaaaaaccatcaacctgtcgaaagaagctgaaccagatatttatcacgctattcgccgtgatgccctgctggaaaatgttaccgtgctggcagatggttcggttgatttcaacgatggttctaaaacagaaaatacccgcgtttcctatcctatctaccatattgaaaatatcgttaagccggtatcaaaagccggacacgcaactaaagttattttcctgacggctgatgctttcggtgtattacctcctgtttcccgcctgacgccagaacagactcagtatcacttcctgtctggttttaccgctaaacttgccggaacagagcgtggtgtcactgaaccaacgccgacattctccgcgtgttttggtgcggcattcctgtcgttacatccgacacagtatgctgaagtgctggttaagcgtatgcaggcatccggtgcaaaagcctatttggttaacactggctggaacggcacaggcaaacgaatctctatcaaagatacccgcgcgattattgatgcaatcctaagtggcgatattgaagatgcagataccgtcgaattgccgatttttgacctgactgtcccaacgacattgccgggcgttgatagcggtattcttgatccacgcaatacttatgcagataaatcggagtgggatgttaaagccaaagatctggctgagcgtttcattaataacttcgacaaatataccgataccgccgctggcgctgcattggtaaaagctgggccgaagttg

SEQ ID NO: 24183 - DNA, 1983 bp, Xenorhabdus nematophilus
actcgtaaaacccttgctaatgctatccgcttcttgagcatggatgctgtgcagaaagcaaaatcagggcatcctggtgcaccgatgggaatggctgacattgctgaagttctgtggcgcgactatctgaaccataaccctgtcaatcctcactgggctgatcgtgaccgttttgtattgtccaatggccacggttctatgctgatttacagcttgttgcacctgactggttacgatgtttccatcgacgatctgaaaaatttccgtcaactgcattccaaaaccccgggtcaccctgaatatggctatacagcgggtgtagaaacaacaaccggcccactggggcagggtattgctaatgcagttggtttcgcaatcgcagaacgcacactggcagcacaatttaaccgtccgggccacgatatcgtcgatcaccatacttatgtattcatgggcgacggttgtatgatggaaggcatttcccatgaagtttgctctttggcgggtacgctgaagctgggcaagctgattgctttctatgatgacaacggcatctctattgatggtgaagttgaaggctggttcactgatgatactgctgcccgctttgaagcatatggctggcatgttattcgtggtgtagatggccatgattctgacgcaattacagcagcaatcgaagaagcacgtaaagaaacaggcaaaccatctctgttaatgtgcaaaactgtcattggttttggttcgccaaacaaagctggtaaagaagagtgtcacggtgcgccattgggagatgctgaaatcgaagcaacccgcaaagcactgggctgggaacaccctgcttttgaaattcctcaggatatttatgctggctgggatgcgaaagaagccggtaaagcaaaagaaagtgcatgggatgcaaaatttgccgcttatgctgaagcatatcctgaactggcagcagaattcagccgccgtaccagcggtgaactgccagaaaactgggaagctgaatccaaggcatttattgaaaacctgcaacagaatccagcttctattgccagccgtaaagcgtcacaaaatgctctggaagcatttggtaaggttctgcctgaattcatgggtggttctgctgatctggcaccaagtaacctgactatgtggtctggctccaagcctctgaacgaagttcaggacggtaactacattcattacggtgttcgtgaattcggtatgtctgccatcatgaacggtatcgccctgcatggtggttttgtgccttatggtgcgacattcctgatgtttgttgagtatgcccgtaacgcagtacgtatggctgcgctgatgaaaatccgtagcatctttgtatatacccatgactctatcggtctaggtgaagatggcccgacccatcagcctgttgagcagattgccagcttgcgtgtcacaccaaatatgagcacatggcgtccatgtgatcaggtggaatctgcggttgcatggaaatatgcgattgagcgtaaggatggcccgacttctctgatcttctcccgccagaatctggcacagcaggaacgtaccgctgagcagctggcaaacattgagaaaggtgcttacgttctgaaagattgcgcaggtcagcctgaattaatcctgatcgcgactggctcagaagttgaactggcagtgaaagccgctgatcaactgagtgcagaaggccgtaaaatccgcgttgtttccatgccatctactgatgcattcgacaaacaggatgcagcatatcgtgaagctgtacttcctgccgctgtttccgcgcgtgttgtggttgaagcaggcattgctgattactggttcaaatatgttggtatcaacggtgctatcgtcggtatgaacagctttggtgaatcagcaccggctgacgcactgttcaaagagtttggttttacggttgaaaatgtcgttgcgaaagcggcagcactgctg

SEQ ID NO: 24184 - DNA, 1032 bp, Xenorhabdus nematophilus
atgacaatcagggtagcgattaacgggtttgggagaataggccgcagtgtcctgcgtgcgctctacgaatccgggcgtcgggctgaaattgaagttatcgccatcaatgagctggctgatgcggaaggtgtcgctcacttattgaaatatgattccagccatgggcgttttgcatggaatgtgcgcctgaacaagataggtttgaataatacagtcttgcatgtgggagatgacagtatccggctgtttcatcaacccgatatttcggatttaccgtggaaagaactgggtattgatatcgtactcgattgtaccggtaagtatggtgaacgcatcgatggggaagcccatcttgccagtggtgctaaaaaagtactgtttgcccatccgggaggaaatgatctggatgcgactgtggtatacggtgtgaatcatgaactgttgtctgcggaagattgcatagtttctaatgcatcctgtacgacaaattgcattattccgattattaaagtgttggatgatgcgttcaatattgaatcaggaacggtgacaacaatccacgcatccatgaatgatcaacccgtgattgatgcctatcacagtgacctgcgtcgaacccgggcagccagccagtcgattatacctgtcgatactaaactggccgcggggatcactcgtatcttccccaaattcagtaaccggtttgaagctatttctgtacgggttcctaccatcaacgtcacagcgattgatttgagtgttacagtcagtgctgccgttaatgtcagtgaggtaaaccagctactgcaaaaatcagcagtgagttcgtttcgtggtatagtggatttcaccgatttgccgttggtctcaacggattttaaccacgaccctcacagcgccatcgtggatggcacacaaacaagagtgagcggaaaccacctgattaaaacacttgtttggtgtgataatgagtggggctttgccaatcgtatgcttgacacaacactggcaatggcttctaaaggtttcaaa

SEQ ID NO: 24185 - DNA, 1161 bp, Xenorhabdus nematophilus
atgtctgtaattaagatgactgatttagatctggcgggtaaacgagttctgatccgggctgatctgaatgtgcctgtaaaagatggcaaagttacctcagatgcacgtattcgtgcgtctttgccgacgatcgaggctgcgctgagtcagggagccaaagtcatggttacttctcacctgggacgcccaactgagggagagtacaacgaagagttttcactacaacctgtcgttgattacctgaaagcagcactttcttctcctgtccgtctggaaaaaaattatctgaatggcgttgaagtggcggaaggcgaattagttgttctggagaacgttcgctttaacaaaggtgagaaaaaagacgacgaaacattatcaaaacagtatgccgcattgtgtgatgtttatgtcatggatgcctttggtacagcccatcgtgctcaggcttcaactcacggcgttgctaaatttgcgccaattgcctgtgcaggtccattgttatccggtgaactggaagctttggggaaagcattgcataaccctgctcgtccaatggtcgcgattgtgggtggctctaaagtttctactaaactgactgttcttgattcactgtccaaaattgctgatcagcttatagttggtggtggaattgccaatacttttgttgctgctgaaggccacaatgttggtcgctccctgtacgaagatgatctgatcccggaagcgaaaaaactgctggaatgttgtgatattcctgtacctactgatgttcgtgttgcgacagagttttctgaaacggctgaagctacattgaaatcaaccagtgaaattaaagatgaagagcagatcctcgatttgggtgatgcttctgctgaacgtctggctgaaatcctgcaaggtgcaaaaaccattctctggaatggcccggttggtgtatttgaattcccgaatttccgcaaaggaaccgaaattattgcccgtgcaattgcagagagtgatgctttctcaattgcaggtggcggtgatactttagcggcaatcgatctttttgagattgctgacaaaatctcttacatctctacaggtggtggtgctttccttgagtttgttgaaggcaaaaaactacccgctgttgtgatgctggaagaacgtgctaacagt

SEQ ID NO: 24186 - DNA, 1074 bp, Xenorhabdus nematophilus
atgtctaaaatttttgatttcgtaaaaccgggtgtcatcactggtgatgatgttcaaaaagtctttgccatcgcaaaagaacataattttgccttaccggcagtgaactgtgtcggtactgattctatcaatgctgtgttagaaacagcggcaaaagtacgtgctccggtaatcatccagttttccaatggcggtgcagcatttgtagcaggtaagggcctgaaggctgaaggtcagcaggcggcgattctgggcgctatttctggtgcttatcatgtgcatcaaatggcagagcattatggtgtgccggtgatcctgcatactgaccactgcgcacgcaaattactgccgtggattgatggtctgttagaagcgggtgaaaaacactatgctcagacaggcaaacctctgttctcttcccacatgattgatctgtcagaagagtctctggaagaaaatatcgagatttgtagccagtatctggcgcgtatggcgaaaattgacatgacgctggaaatcgaattgggttgtactggtggtgaagaagatggtgtcgataacagtcatctggatagctcctccttgtatactcagccagaagatgtagcttatgcgtatgaaaaactgaacgcgattagcccacgttttaccattgcggcatctttcggtaacgttcacggtgtatacaaaccgggtaacgttaaactgacgccaaaaattctgcgtaattctcaggactatgtttcagagaaattcaacctgccacacaatagtctggattttgttttccacggtggttctggttctaccgcagaagagattcaggaagctgtcagctacggcgtagttaaaatgaatattgacaccgatacccaatgggcgacctgggaaggtattctgaactactacaagaagaatgaaggctatctgcaaggtcaattgggtaacccagagggcgcggataaacctaataagaaattctatgatccacgtgtgtggctgcgtgctggtcaggtttcaatggaagttcgtctggaacaggctttcaaagaactgaatgcggttgatgtgctg

SEQ ID NO: 24187 - DNA, 1344 bp, Xenorhabdus nematophilus
atgagcagctcacctgaagccatacagaaacatgatgcaccagactattcacataaaaacctcacggcacagcagcaaagtgttatcaaaaaattatttcgccgcctgatcctgtttctgtttgtcctgttcatcttttcttttctggatcgtatcaatattggttttgccggtttaacgatgggaaaagatctgggtcttacatcgaccatgttcgggttagctgcaacactgttttatgtgacttatgtggcttttggtattcccagtaatatcatgctgggcattgtaggagccagacgctggattgccacgattatggtgctgtggggaattgcttccaccgcaacaatgtttgcgaccggtcccaccagcctgtatatcctgcgtatgctggtcgggattgcagaagccggttttctgcccggtattctggtctatctgacatattggtttccggcttattaccgtgcccgtgctaatgccctgtttatgattgctatgcctgtcacaatggcatttggttcactggcatccggttatattctggaaatggacggcatctgggatctgcgtggctggcagtggctgttttttctggaaggcttcccctctgttctgctgggtattgtcgtctggttttatctggatgattcaccagagaaagcaaaatggctgacaaatgaagataaaaaatgcctacaggaaatgatagagaacgataaagtttctttagcacacgctgaaccttcacacgcaaaaaccagcctgtggcgtgaaatttttaccccgattgtcctgatgtacaccttcgcttatttctgcctgaccaatacgctgagcgccattaatatctggacgccacaaattatgcagagtttcaatcagggaagcagtcacaccgttattggcctgctaacagctatacctcagttctgtactattttggggatgatctactggagccgtcggtcagaccgcctgcaagaacgaaaaatgcacacagctctgccttttttgtttgcggctgcgggctggatcctgacgtcactgacaggcaacagcatgatacagcttttaggcatcatcatggcatcaaccggctcgtttactgcgatggcagtattctggacgacgcccgatcaatccatcagtctgcgagcacgtgctattgggatcgcggtgatcaatgcgacgggtaatgtgggttcggctgtcagccctttattgatcgggtggctgaaagatcagaccggcaattttaactctggtctctattttgtcgccgggctgctggtgatcggggcactaatggttctgctgatcccaatgaaacacgcaaga

SEQ ID NO: 24188 - DNA, 1434 bp, Xenorhabdus nematophilus
ttacacgattccctgttattgcgtcagcagggttacattgacgggaaatggcttgatgcagacaataaagccacctttgctgtgaccaaccctgctactggtgacatcatcgccaatgtcagtgatatgggggcagcagaaactcatcgtgcgattaaagctgccgaaaaagcgcttcctgcatggcgcgacctgacagccaaaaaacgtagccagatactcaggcagtggttcaatctggtcatcgataaccagaaaacactggccgaactgctgagtatcgagcaagggaagtcccatgcagaggcgatgggtgaaattgcttatggtgcaagttttatcgaatggtttgcagaagaaggcaaacgcatttacggtgaaactatcccttcccccatgccgggttgccgcacatccaccatcaagcaacccatcggagtggttgcagccattacgccgtggaatttccctaatgccatgattacccgaaaagtcagcccggcactggccgcaggttgtactgtcgtcctgaagccggccgcagaaaccccgctttccgcactggctctggttgttctggctgagcaagcgggagttccagcgggtgtctttaatattgtcaccggaatggatgccaaagcgattggggaagccctgacttcaagccctatcgtacgcaaactctcttttaccggatcgacacgagtgggtaaattgctcatggcacaaagcgccgatacggtgaaaaaactctctcttgaattaggtggcaatgcaccttttattgtttttgatgatgccgacttagatgccgcagttaaaggtgcaatggcagcgaaattccgtaacagcggtcagacttgtgtctgcgcaaaccggatcctggttcaggaaaacatttacgaggcatttgctgagcgtctggctcaggcagccagagaactgcatgttggaccagccagtgatagctcctcacagcagggccctctgattaatcaggctgcgatagataaagttcaggcgcatgttagtgatgccgtttcccgtggtgcaaggcttctgaccggaggaaaatcccataaactgggtggcctgttctttgagccaaccgtactggctgatattgatgaaacaatgcaagtcgcccatgaagaaacattcggccctctggctgccctgttcaaattccgggatgaagaagaggccattcgcattgccaacagcacagagtacgggctggctgcctacttttattcccgcgatatcggcaggatttaccgtgtagcagaagcgctggaaagcggcatggtcggcattaacgaagggctgatttccaacgaagctgttccgttcgggggcataaaacagtctggtctggggcgtgaggggtcgcgctacggcatagaagattatctggaagtgaaatacctctgt

SEQ ID NO: 24189 - DNA, 1464 bp, Xenorhabdus nematophilus
atgaccacaattaatcattggatcaacggtaaaaacgttggcagcagtacctattttgaaacagtcaatcccgcaaccggtgaggtattggcagaagtcgcttctggcggaaaagaagaaattgatcaggcggtggctgccgcaaaagacgcttttcctaaatgggcaaataccccaatgaaagaacgcgctcgcctgatgcggcgtttaggagaattaatcgaccagaatgtacctgaaattgcggcaatggaaaccagcgatacgggcttgccaattcatcagacaaaaaatgtccttatcccacgcgcttcccacaatttcgatttctttgcggaaacttgtcagcagatgaacggacgcacttatcccgtcgatgacaagatgctgaattatacccttatccagcctgtaggcgtctgcgcactaatttccccgtggaatgtgccgttcatgactgccacatggaaagttgccccctgtctggctctgggaaacaccgcagtcctgaaaatgtccgagctttcaccactgaccgctaaccgtctgggagaactggctctggaagccggtatccccgcaggagtactgaatgtggtacagggatatggcaatactgcgggtgatgcactggtaaaacatcatgatgtccgtgccgtttcttttaccggcgggacagctaccggtcgcctgattatgcagaactcagggctgaaaaaatactccatggaactgggcggcaaatcgccggtactgatttttgaagatgccgatattgaacgtgcgttagatgctgccctgttcaccattttttccctcaatggcgaacgctgtacagcaggctcccgtattttcattcaggaaagcatttatcctgaatttgtgaagcgttttgcagaacgtgccagccgcctgcgcgtcggtgatccacaggatctgaatactcaggtcggcagcctgatcagccaccagcactgggagaaagtttccggttatatccaactgggtattgaagaaggcgcaacgctgttaaccggagggccggataaaccggcagacctgcctgatcacctgaaaaatggtcacttcctgcgaccaaccgtcctcgccgatgtagataaccggatgcgtgtggcacaggaagaaattttcggcccggtcgcctgtctgctgccattcaagagtgaagaagacggtcttcgtatggctaacgatgtggaatatggtctggcatcttatatctggactcaggatgtgagcaaagtcctgcgtctggcacagggaattgaagccggcatggtcttcgtcaattcccagaacgtacgcgatctgcgccagccatttggtggtgtaaaagcctccggtgtaggacgggaaggcggagaatatagctttgaagtttttgctgaagtgaaaaatgtttgtatttcaatgggaaatcatcccattcctcgctggggactt

SEQ ID NO: 24190 - DNA, 1344 bp, Xenorhabdus nematophilus
tcgcagtatattgttgcaaaattcggtggtaccagtgtggcaaactttgatgccatgaataactgtgctgatattattctggcaaacagagatgttcgcgtagtcgttttatcagcttccgcaggtataaccaatttgctggtcacattagcttccggctgtaatagtgataaacgggagaagtgcctgaaacagatccgagacattcaatacgccattatcgggcgactgaatgaatcagatgtgattaaagatgagattgaccgtctgttggataacattgctacattgtcagaagcggcttcgctcgccacatctgacgccttgactgatgagttagtcagccacggtgaagtcatgtccaccctgttgtttgttgaattattacgtcagcgcaatgcggatgtcgaatggtttgatatccgccggataatgcgtaccaatgaccaattcggacaggcagagcctgataccacccagctcaatattctggccgagcaacatttgcagccacgcctgaataatacaattgttattactcagggttttatcggcaaagaagaaaaagggcgtacaacaacattagggcgtggcggcagtgattataccgccgcattgcttggtgaagcgctggggctaaagcgtgtggatatctggaccgatgttccgggaatttacacaacagacccccgtgttgtcccaacagctacgcgtattgataaaattgcttttgatgaagcggctgagatggcaacatttggtgccaaaatcctccatccggcaacattgctgcctgccgtccgctgtggtattccagttttcgttggttcaagtaaacaaccacaggcaggtggtacacttgtttgcgacagaacggcaaccccaccccgcttccgggcactggcactacgtcgcaaacagactttattaactctgcatagcctgaaaatgctgcatgcaagaggctttctggcagaaatttttatcctgctttcacgccataatatttcggtggatctgattactacctcagaagtcagtgtcgcgttaacactggatacaacaggctccaccagcacgaacggtagtttgctgactaatgccctactgacagagctttcaacattgtgtcgtgtcgaggttgaagaagatttggcactggtggcgattatcggtaataagctgtcacaggccagaggattaggaaaagagatctttggtccgctggaatccttcaatatccgtatgatcagctatggtgcaagtagccataatgtctgcctgcttgtacccgggcaagacgctgaagaagtggttcaaacccttcataagaatttgtttgaa

SEQ ID NO: 24191 - DNA, 1644 bp, Xenorhabdus nematophilus
atgaaaaacatcaaccctagccagaccgaagcctggaaagcattgcagcaacattttgagcagataaaagatactcacctgcgagatctgtttgaacaggacaaggcgcgttttgcgacattctctgccacatttgacgatcagatgctggtggattattccaaaaaccgtattaccgcagaaacactggagaaattacaggctctggcgaaagaaactgatttatccggggctattcatagcatgttttccggtgaaaagattaaccgtactgaagatcgcgctgtattgcatattgctttgcgtaaccgcagtaactctccgattaaggttgatgaggaagatgttatgccgcaggtcaatgcggtactggcaaaaatgaaatcattcagtgagcgcattattagtggggagtggaaaggttataccggtaaagctattactgatgtggtaaacatcggcattggtggttcagatcttggcccatatatggtgacagaggcactgaaagcctataagaaccaccttaatatgcactttgtatccaatgtggatggcactcatatcgcggaaacactgaagtctctggatccggaaaccacgctgttcctgattgcatcgaagacttttaccacgcaggaaacgatgactaacgcacattctgcccgtgattggttcttgcaaagtgcagttgatgaagtacatgttgccaaacattttgcggcactttcaacgaatgaacaggaagtcagcaagttcggtattgatccgcaaaacatgtttgagttctgggactgggtcggcggccgttattctctttggtctgcgattggtttatccattgtcctgtccattggatatgataatttcgagcaattgctgaatggtgcccatgctatggataagcactttgcacaaactgctcctgaacagaatattccggttattctggcgctgattggcatctggtataacaatttctttggcgcagaaactgaagcgattctgccttatgatcaatatatgcatcgttttgctgcttacttccagcagggaaatatggaatcaaacggtaaatatattgatcgtaatggaagccctgtggattatcagaccgggccgattatctggggggagccgggcactaatggtcagcatgctttctaccagcttatccatcagggaacgaaactgatcccatgtgattttattgctccggcaatcagccacaatccaatcggcgatcatcacagtaaattattatctaacttctttgcacagactgaagcgctggcttttggtaaaactcaggctcaggtagaagccgaatttgttgctgccggaaagaatgtacaggatgtggcaaatgttgtgccattcaaagtgtttgagggtaatcgtccgactaactcaattctgttacgtgaaattacaccatttagtatgggcgcattaattgccatgtatgagcataaaatctttgctcagggcgcaattctgaatattttctcatttgaccagtggggcgttgaattgggaaaacaattggcaaatcgtatcctgcctgaactccacgattcagaaagcgtaaatagccatgacagctctacaaacgggctgattaatcgtttcaaagaatggcgt

SEQ ID NO: 24192 - DNA, 2451 bp, Xenorhabdus nematophilus
atgaaaaagccccaacttgataaagccgaattccaggctgcgctgacccggcagttgcagcgctttggccttgatttagcacagggagtaacaacacatcagtggtggcaaacgatcagtgccactcttttggaattactgcctgcttatcgccaaaacaatcaccaccaaaacaatcaccatcaaattgataatcttccgccgaccgatggctcaaaaggcaagcaacggcatgtaaactatatttcaatggagttcctgatcggtcgtttaacgggtaacaacctgctgaatcttggctggtatgatgatgttcaggcgtatttagccgaatatggtgtggcattaagtgatgtgctggaagaagaaactgatcctgccttgggcaatggcggtttaggccgtctggcggcttgttttcttgattcaatggcgaccattaatcaaccggcaatcggctacggtcttaattatcagtatgggctgttccggcaatccttcgagcaagggttacaaattgaaactccggatgactgggagcgcaatacctatccatggttttaccgcaatatacaactgaatgttgatgttagtttcggcggtgaaatggtcacaacaaccgacggaggtgaaatctggcgaccggcttttaccctgaccggggaagcgtgggatcttcctgtcgttggttataagaatggtgttatacagccgctgcgcctgtggcaagcaacatatgataatccctttgatttatcactgttcaatgatggtcagttccttcatgcggaacagcagggtatagaagccaccagcctgaccaaagttctttatccgaatgataaccatcgggctggaaaacgcctccgcctgatgcagcaatattttcagtgtgcctgtgctgtggctgatattctgcgtcgcccccagctggctggtcgcaaaatacaggagctgccgcaatacgaagtgatacagctcaacgatactcaccccacaatcgctattcctgaaatgatgcgcctgctgattgatgatctccaactagattgggatactgcatggagcattaccgggcaaaccttcgcttatactaatcacaccctgttaccggaaggtttggaacgttgggatgaacatctcatcatcgaattactgccgcgccaccatcgtattattcaggaaataaacaatcgttttcgtaaaacggtagaaaaaaactggccgggtaaccaacaaatatgggaaaaactggcagtcatccatgataatcaggtgagaatggctaatctttgtgttgtagcctgctttgcgattaacggtgttgccgcattgcattcatctttgattgtgacggatctcttccctgaatatcaccaattgtggcctcaaaaattccataacgttaccaatggcgttacaccacgtcgctggttaaaacagtgtaatccagcactctcttcactaattgatcagacattaggccatgaatggctcagcgatattactgaactaaaaagactcgaaccctacgctgctgatgctgcttttcgtgaggcttatcgcaccgtcaaacagaacaataaaatccgcctttccaactacatcaataaaacaatggggctgaagctagaccctcatgccattttcgacgtacagatcaaacggttgcatgagtacaaacgccaacatttaaacctgctgcatatcctctcactttatcgacagattcaggaaaatccggcactggatatttacccgcgtgtttttctgtttggtgcgaaagcggctcccggctactatctggcaaaaaatattatttcagccatcaaccacgcagccgaaaaaatcaaccatgatccgatcgtacgcgatcgcataaaaatcgccttcattcctgattacaatgtttcaaaagctgaattgatgatcccggcagccgatgtatcagaacaaatctccacagcaggaaaagaagcctccggtacaggtaacatgaaacttgccttgaacggagcactaactattgggactctggatggtgcaaatgtcgaaattgccgaacaggttggcaacgacaacatttttatcttcggacatacagtggaagaaacaaaaaccttactgagagagggttatgatcccaaaaacattctccaacaaaataagcaattacaacaaataatggattccctctccagcggtgagttcagtcacggagataaacaggcatttgatttaatgctgcacagcctgattgatggtggtgacccttatttagtattagctgattttgcttcttactgtgccgcgcatcagcagattgatgaactctaccgtaataccccgcactggacacgaagcacgatccttaatactgcccgtatgggaacattcagttccgacagaactattcaggattatcaacaacgtatctggcaggttaagcag

SEQ ID NO: 24193 - DNA, 1131 bp, Xenorhabdus nematophilus
tatttaatcattgatggggaaaaacatattgatgcggcatcgggcacatttaatttgccacttggttacactaaccacaggctcgccgaaaaattaaagcaacagattgatagatgcacacatttgagttcggcgtatacccgggaaatgtcccagtatattttaactaagttggttaaatacacacctaaaggcatagatcgcatgtggttacgcgatgtttccggctctggtgctgttgaatgtgcaattcgtattgctcaaaaggcgacgggacgttctggcatcgtctctttctttcttgcgcatcacggtcaatcgcttgcaacggcgcaggtttccggtaatgcgttcaggcttaaaaattttcatatcaatattgaaggctccataaaaatccccgctccggtcagtgtgatggctgaatctcaggaggaaaccccacaatatatcgatttggaacagttcattcagttgggctcaagcgacaatattgcatgtctgattattgaaccgattcaggggaacggtgggaatattgtttttccggtggagttctatcgtaaaatcagggaaatctgccatcagcacggcatcattatcattgccgatgaagttcagacagggttcgggcgtacgggcactttctttgcttcgacgggttatgccaaagagctggagccagatattatcgtttttgccaaaggtgctggtggcattggcattccaaccggtggtgtgctgatgcgcagttcactggatgtgctggaatcatttgagcattccagtacttccggcgctaatccgttgtctttggtcgctcttaacgaaatcatcaatattattgaagatgaacatattttagataatgtcatccagaacgaaacttttctgcgtgatggtttgctggatttgcagcataaatattctgaaattacgggtgttaggggcgttggctatatgtttggttttgatacgccaacacctgaatttgcagcacaggcaatcgcgacagcctcccgtcataaactgatcttgcggggatcccgttatggtaagggacgagcgcttaaggtacgtcctcctttaatttgtacacaggaacacttagctgaaattctccataagctg

SEQ ID NO: 24194 - DNA, 918 bp, Xenorhabdus nematophilus
gtggtggttgatatcgcagtctgtgggatatgcggaactgatgtaggcattatcaccgggttttatcctgtcgcagtaccggggacgacgttgggtcatgaaactacaggtattgttgcgcaggttggcagtggtgtgacctgctttcaggctggtgatcgcgttgtcattaacccaacatattcttgtgggcattgcagaatgtgcctgaccggcagcccgaatcactgtgaaaagaaattgggaacagaagccggtgtctcctatgacggtgcgtttgctgagcaatatctggcaaaagagagctcgctgattaaactggagcctcatgtcagtatggaagcggcttcattaactgagccgttaagctgcacactgacaggcgtggataaactggggatcacccatactaatattcgtgctgtggtcgctggtgcggggcctatggggatgctgtacctttgggcattgcatgaacggggagttaacgcgttcatcattgagaaaaacccatatcgtatgcagtttgccagccagaatttacctgtgggatgccggttatatgctgattttgacgaagcactgatacaggaattcggagataaatctacattgatagacttatgtgtagatactaccgggcaactgactgagtatattttcgaccacttggcacccggtggtaagttgctgaatgtagctttgaaagataaacatgccagtctcgatatcttaaaaatcgcagataaaagcctttctgttattggttcgattgattccctgaacaacagttttgaacgggcttacgtcatgatccgtgatggagtgatccctgtagatcgtctggtcagtcaggtttttgattttgacgattaccagcaggcatttcttactgtcggatgtgatattgcagctaaa

SEQ ID NO: 24195 - DNA, 615 bp, Xenorhabdus nematophilus
atcatttttgatatcgatggggtcattgttgatagtgagcagctgcattttgatgtgctgcgtgagctggcacctgatcacacgcacgagattaggcctcagcagttgataggcttgagtctggcgcaaacattgagttctattggggttccgttacaggcacagaaaagtattaccgacaggattatatcgacttatcaggataaattatctccgcactacctacggtcaggtgttactgatctgatatcagccttacagcaaaatgagattgtttttggattcgtttcgactgccccacgagaagtgtgtttgctcaatcttgggttgttgaatctaagggaagagccagcgttgatttctggtgacgatgttaaacaaaccaaaccttttcctgatccttatctggcgatgctgaaattgaaagctatggatgtcaggcagacgctggtgattgaagatactgatttgggtattttggcggcaaaacaagccggtattccttggatatatgcctggcctcatgctttgtcaggagcagaaaaatatgaacagtccacagggatcattagagagctggtggatattccccaaatattcggtttactcaatgaa

SEQ ID NO: 24196 - DNA, 2025 bp, Xenorhabdus nematophilus
aatcctttcttctataccagcgtactccccttccaggctcctccgtttgataaaataaaagaaacagattactcacctgcaatcacagccggcattaaacagaagctggaagaagtggagaagatcgccaataatcccgccccacctgactttgaaaatacctttatcgcactggagaaaaccggcacgacgctggatcgggtaacaaacgtattttgggcgatgacctcagccaatacgactgacgggctgcaaaaactcagtgaagaaatgtcaccaaaactggcggcaatgaatgatgagattatgctgaacagtaaactgttcaaccgcatcaaaaccatttaccagcagcgtgaaacactgaatctggactcagaatcgctccgtctggtagaagtcatttataagcaattcgaattagcgggtgccaatttatctgatgccgacaaaataaaaatgaaagcattaaatcaggaagcggcaaccctgcgtactcaatttaccaacaaattgttagcagcaaccaaagatggcgctctgacgattaaggataaaactctgctggccgggctatccgatggcgaaatggctgcggctgcacaggctgccagtgagcgtaagctggataatcaatggctgttcgtattacagaacacgacccagcaaccggttctgcaagatctgaaagatcgcgatacacgtaaagcgttattcgaagcatcgtggaaccgggctgaaaaaggggatgataacgacacccgccaaacgctgtcccgattggcgaaaatccgtgctgaacaggctaagctgctgggtttcaaagattacgcatcatggaagctgcaaagccagatggcaaaaacaccggaagtcgcattgaagtttttacgtgatattgtccctgctgcaactgcacgcgctgaacgtgaagcaaaagatattcaggccgtgattgaccagcaaaaaggcggcttcaaagtggaagcatgggattggccgttctatgccgaacaggtacgcaaggcaaggtatgatttggacgagtcccagattaagccctatttcgaactgaataacgtcctgaataacggcgtgttctacgccgccaacctgctatatggcattacctttaaagagcgcaaagacattccggtttatcatcccgatgtccacgtgtatgaagttttcgataaggacgggcaacaactggcgttgttctattccgattactttaagcgtgacaataaagccggtggcgcctggatgagtaattttgtcgatcagtccagactcttcggaaccaaaccggtaatttataacgttgccaactttaccaaaccagctccgggccagccagctttgttatcgtatgatgatgtgatcacaatattccatgaatttggacatgcgttacacggcatgtttgccgatcaggaatacccgacgctgtcaggaaccagtactgcccgtgactttgtggagttcccgtcacaaattaatgaatactgggcccgtgatcccaaggtatttgcgaattacgccagacattaccaaaccggtgaagtcatgccgcaggcactgatggataaaatcaatcaggcggataagtttaacaaaggttatcaaatgaccgagttactgtcagccgcactactggatatgcactggcatatgctggccgcagataagccgcagcaggacgtgaataaatttgaagccgcatctttgcaagaagataagatccatctcaactacgtgccgccacgctaccgttccagttacttcaaacacatttggggcggtggttatgctgccggttattatgcctatctgtggacagaaatgctggcggacgatgcgtttgcatggtttaccgagcatggcggtctgacaagagaaaatggtcagatcttccgcgataagatattgtcacgcggtaatagtacagatttggaaaaactgtatatagactggcgaggtaagccaccaagtactgaatctatgctgaaaaaccggggtctt

SEQ ID NO: 24197 - DNA, 1059 bp, Xenorhabdus nematophilus
atgaatgagttgaaaaacgaccgttatctgcgtgccttattacgtcagccagttgatatcactccggtatggatgatgcggcaggcaggacgatatttacctgaatataaagcaacacggcaggaggcgggggatttcatctcgttgtgcaaaaatactgaactggcctgtgaagtgactcttcagcctttgcgacgttttcctctggatgcggccattctgttttccgatattctgaccattcctgatgcaatgggattagggctgtattttgaagccggtgaaggcccgcgttttcagtcgccaatccttaaccatgccgatgtagcaaagttacctgttcctgatccggagatggagctgggttatgtcatggatgctgtccgtgcaatacgcaaggcactggcagggcaggttcctctgattggtttttccggcagcccgtggacactggcaacctatatggtcgaaggcggaagcagtaaggcgtttactaagattaaagccatgatgtatgctgagccgacgacacttcatctgttgctggataaattggctgatagcgttattctatatctgaatgctcagattaaagcaggcgcacaatctgtcatgattttcgatacgtggggcggtgttttgtcccagcgcgattatcaggagttttccctgcgatatatgcataagattgtcgatgggctgatccgcgagcatgaaggccgccgagtacctgtcaccctatttacaaaagggggagggcaatggcttgaggcgatggctgcaactggctgtgatgcgcttgggctggactggacaacgaatattgctgatgctcgtcgtcgtgtcggagataaagtcgccctacaggggaatatggacccatctatgctgtatgctcagccagcacggattgaacaggaagtttcgaccatcctgcaagactttggtacaggtaatgggcatgttttcaatctggggcatggtattcatcaggacgttccgccagagcatgcaggggcttttgtcgaagcagtgcaccgattatcagcgaaataccat

SEQ ID NO: 24198 - DNA, 885 bp, Xenorhabdus nematophilus
caagttaagacttttttcctctcattacaggatgaaatctgtaaacaacttgaacgtctggatgatcattcccatttcatcgaagagtgctggcaacgggaggaaggcggtggcggacgcagccgtgtcttaaaatcaggtaaggtttttgagcaggcaggtgtgaatttttcccatgtaaccggagattccctgccttcgtcagcaacagctcaccgccctgaactggcgggtcgcagctatcaggcaatgggggtttcccttgttattcatccccaaaatccttatgttccgaccagtcacgccaatgtacgcttttttgttgccgaaaaagaaggtgagccccccatctggtggtttggtggcgggtttgatctcactccctattatggctttaaagaggatgccgttcactggcacaccgttgccagtacgttatgccagccatttggtgaggatatttatcccatatataaaaaatggtgtgatgattatttcttcattaagcatcgtaatgagcctcgcggtattggcgggctgttttatgatgatttaaatagccccgattttgatacttgcttcaatttcacacaagctgtgggtaatggtttcctttcagcttatctacctattgttgaaagaagaaaagatatcggctggggagagcgggaaaggcaattccaattgtatcgccgtggtcgctatgttgaatttaatttagtctgggatagaggaacattattcggcctgcaaagtggcggacgaacagaatctatactgatgtccatgcctcctttagttcgctgggagtataattattcccctgagccaaattctcccgaagaagagctctatacatcatttctgataaaaaaagattggata

SEQ ID NO: 24199 - DNA, 603 bp, Xenorhabdus nematophilus
gtcggttcgatctttgcggtgagtcaggtccaggcggacggcgacaccaatgttctacgcaaggggcgagagtatctctgcgccggctatgccatctatggcccctcgacgctcttcgttatcacattcggcctcggcgtggtcggcttcacgctggatccgtctgacgggcaattcaaactgaccaacgcgcgcatgcgcgtgccgacggaaacgaccgagtttgccgtgaattcgtcgcgccagcgtttctgggatgagccgatccgacgctatgtcgacgaatgccttgcgggatcggcagggccgcgcggacaggacttcaacatgcgctggaccgcctcgatggtggccgacgtccatcgcattctgacccgcggaggggtgtttctctatccggcggacgagtccaatcgccgcgccggcggcaagctgcgcctgatgtatgaagccaatcccatggcgttcctcgtcgaggcggccggcggtgcagcatccaccggaaccgaagacatccttcgcatccaaccacaggctcatcatcagcgcgtgtcggtgttgctcggctcgagcaacgaaatccaacgcctggtgcaatttcac

SEQ ID NO: 24200 - DNA, 1647 bp, Deinococcus radiodurans
atggctaaacagctcgtgtttgatgaatccgcccgccgcagcctggaacgcggcgtcaatgccgtcgccaacgccgtcaaggtgaccctggggccccgtggccgcaacgtggtcatcgagaagaagttcggcagccccaccatcaccaaggacggcgtgaccgtcgccaaggaagtggagctggaggacaagctggagaacatcggcgcccagctgctcaaggaagtcgccagcaagaccaacgacatcacgggtgacggcaccaccaccgccaccgtgctgggccaggccattgtgaaagaaggtctgcgtaacgtggccgccggcgccaaccccctcgccctgaagcgcggcatcgacaaggccgtggctgtggccatcgaggaaatcaagaagctggccgtgtcggtcgaggacagcgaagccatcaagaaggtcgcgggcatttcggccaacgacgaaactgtcggccaggaaatcgcttctgcgatggacaaggtcggcaaggaaggcgtcatcaccatcgaagagtccaagggcttcgacaccgaagtggacgtggtggaagggatgcagttcgacaagggctttatcaacccctacttcatcaccaaccccgagaagatggaagccgtcctcgaagacgcctacatcctgatcaacgaaaagaagatcagcaacctcaaggacatgctcccggtgctggaaaaggtcgcccagacgggccgccccctgctgattatcgccgaggacgtggaaggcgaagccctcgccaccctggtggtcaacaagctgcgcggcaccctgaacatcgctgcggtcaaggcccccggcttcggtgaccgccgcaaggaaatgctgcgcgacatcgcggccgtgaccggcggcgaagtggtcagcgaagacctcggccacaagctggaaaatgtcggcatggaaatgctgggccgcgccgcgcgcatccgcatcaccaaggacgaaaccaccatcgtggacggcaagggtgagcaggcccagatcgacgcccgcgtcaacgccatcaagggcgaactcgacagcaccgactccgactacgcccgcgagaagctccaggagcgcctcgccaagctcagcggcggcgtcgccgtcatccgcgtgggtgccgcgaccgaaaccgaactcaaggaaaagaagcaccgctacgaggacgccctgtccaccgcccgctcggctgtggaagaaggcatcgtggcaggcggcggcaccaccctgctgcgcgtgatccccgccgtccgcaaggccgccgagagcctgaccggcgacgaagcgaccggcgcacgcatcctgattcgcgcgctggaagaacccgcccgccagatcgccgcgaacgccggtgaagaaggcagtgtcatcgtgaatgcagtggtgggcagcgacaaggcccgttacggcttcaacgccgcgaccggcgagtacgtggaggacatggtggccgccgggatcgtggaccccgccaaggtgacccgcaccgcgctgcagaacgccgcgagcatcggcgccctgatcctgaccaccgaagccatcgtcagcgacaagcccgagaaggctgcgcctgcgatgcctcagggtggcggcgacatgggcggcatgggcggcatggacttctaa

SEQ ID NO: 24201 - DNA, 1167 bp, Deinococcus radiodurans
atgacctctcctttccgcctctccgcccgcgcccagagcctcaagccgtctgcgacagtggcggtcacgtcccgcgccctggaactccagcgtcagggcctggacgtgatttccatgagcgtgggcgagccggatttcgacacgccgccacatgtcaaggccgccggcatcgccgccatcgaggaaggcaagaccaaatacaccccggtcagcggcattcccgaactgcgcgaggccatcagcgccaagtttcggcgcgaaaacggcctggactacgcgccgaacgccgtgacggtaacgagcggcggtaaacaggcgctgttcaacgcctttttcgcgttgctgaaccccggcgacgaggtgctgattcccgcgccccactgggtcagctaccccgaaatggtcgcgctgaccggcgcggtgccggtaaccgtacccactacgccgcagcagggctttcaactcgacccggacgccctcgccgccgccatcacgccgcgcacccgcatggtgattctcaacagccccggcaacccgacgggcgcggtgtttccgccggaaaccttgcgggcggtggccgacctcgccacgcagcacggcttgatgatcgtcaccgacgaaatctacgagcacctcgtctacgacgccgagcaggtcagcatcggcacctacgcgccggagcacaccctgaccatcaatggcgcgagcaaagcgtatgccatgaccggctggcgcatcggctacgcgggcgggccgcgcgaggtgattgccgccatgaacgcgctgcaatcgcaaagcaccagcaacgccagcagcgtcagccagtacgccgccctcgccgcgctggaacagcacgaggaaaccatgcgcttcatcgacagggcccgcaccgcctaccgcgaacggcgcgaccgcatcgtggcgggcctcaacgcgctggggttgcccacgcccacgccgcaaggggccttttacgtgatggccgacacccgcgccattcacaccgacgaactcgaagccgcccgcatcattctggatgaggcgcaggtcgccgtcgtgcccggcaccgatttcgccgcgccgggacaggtgcgcctgagctacgcgaccagcatggacaacatcgaggaagtgctgcggcggctggaaggggtcgtgcggcgctaa

SEQ ID NO: 24202 - DNA, 1005 bp, Deinococcus radiodurans
atgacccaacctgacatggcctaccccaaccccgccggcatcaagcgcgtggccgtcctgacgagcggcggcgacgcgcccggcatgaacgccgccattcgcgccgtggtccgcacgggtgcccagcagggcatcgaagtcgtcggcgtgcgccggggcttttccggcctgcaccggggcgaagtgcagcttctgggcccgcgcgacgtggcgaacaccattcagcgcggcggcaccattctgctcaccgcccgcagccacacctggcgctcgccggaaggccgggccaaaggggcggcggtgctgcgcgagtggggcgtggacggcttggtggtcatcggcggcgacggctcctttcacggcgggtactttttgcaagaggaacacggcatcccggtcatcggcgtgccgggcaccatcgacaacgacctgtacggcactgaccacaccatcgggtacttcacggcagtggaaacggcgctcgaagcggtggacaagctacgcgacacgggcgcgagccacgagcgcatcttcgtcatcgaggtgatgggccgccacgccgggcacatcgcgctcgacgtggcggtggcgggcggcgccgaggaagtctttattcccgaagacaaaaaacccatcggcgacgtggtgaacatcgtcaaggacagcattgccaagggcaagcggggcagcatcatcatcgtggccgagggctatgacggcggcgccgaggcggtcgcgcaggccattcacgccggcaccggcctggaaacccgcgtcagcatcctggggcacatccagcgtggcggcaccccggtcagctcggaccgcatcctggcgagccgactgggcgaagccgccgtctacgccctgatggacggcaaaaagggcgtgatggtggggcgcatcggcgggggcatcgcctacacgccgctgcacgaaacctgggaaaagcgcaaggacgtgagccgcgacctttaccgctgcgccaagatgttgagcatttaa

SEQ ID NO: 24203 - DNA, 1227 bp, Deinococcus radiodurans
atgagcaagtttgctgtgcgtaagttctacacctcggaatcggtgtccgaagggcaccccgacaagctctcggacttcatttccgacagcatcctcgacgagtttctgcgtcaggagccgaccagccgcgtggcagtcgaaaccctcgtcacgaccggcatggccgtggtggccggcgaagtccgcgcccacaccgcgcacgtggacatccagaaaaccgtgcgcgaggcggtgcagcgtgtcggctatacccgcgccaactacggcttcgacgccgagtacagcgcggtgctcgttgctattcacgagcagtcgcccgagattgccagcggggtggaccactccgaggaatggcgcgagatgagcgaagccgagcgccagaagcccgaaaacgcctacagcatggtgggcgcgggcgaccagggcctgatgttcggctacgccaccgacgagacgcccgagctgatgccgctgccgatcagcctcgcgcacggcctgacccgcaggctcgccgaactgcgtaaggacggcaccctgccctacctgcgccccgacgccaaagcgcaggtgacggtggtccgcaacggcgagccacacagcgccactgagacggcggtggacaccatcgtcatttcgacccagcactccgacgacgtgacccaggagcagattcgtgccgacatgctggagcatgtgattccggcagtcattcccgccgagctgctcaacgagcagacccgctacttcatcaaccccagcgggcgcttcgtcatcggggggccgcacggcgacaccggcctgaccgggcgcaaaatcatcgtggatacctacggcggcgcggtgccgcacggcggcggggccttttccggcaaagacccgacgaaggtagaccgctcggcggcctactacgcccggtacgtcgccaaaaacatcgtcgcggcggggctggcgcggcgggcactcgtcgaaatcgcctacgcgattggccgcgcccaccccgtttcgctgcgggtggacacctacggcaccggcacggtgagcgatgagaagctcgacgagctcatcgccgcgcacttcgacgcccgcccgcaggcgatcatcgcgcagctcgacctgcaacgccccatctacgcgcagaccgccgcctacggccacttcgggcgccccgagtttccctgggagcagaccgaccgggcgcaggcgctgaaggaagcggcgcagggctga

SEQ ID NO: 24204 - DNA, 1383 bp, Deinococcus radiodurans
ttgcaggtcaggagacgcggaaaaatcggtcatcgttccgtattgtctcacggcctgtgcgcccggcgcgccccgaccctctacactccgttcatgtcggactccgttctccgggcgcttacggcggcgctggaagccgaccccgctgacaccggggtgcgcgaacatctggtgcgtctgctgctcgacgccggtcagggcgagcaggcgctggcgctcgtgcgggtctggctggcggcggaccccacccggcaagttgccctgggcctcgcggtgcgggcggcggacctcgcgggcgactcgcaggcggcggcctcgtaccagacgatgctcaacgcgctctaccagctcgaacagggccagtcggcgcccgcaccggcgcggcagcccgtgcccaccgtcagcgaaaacggccccccaccacgcaacgacgctcccgaatactgggtggacccggacgaggcgcccgcccaacagcagccgtatcccaccggcaccgacttttcctcgcgctggcagcccctcgcgggcgacgtgtcgctgaaagacgtggtgggcatgaccgacctcaaagagcggctggaacgctcgctgctcggcccgctgcgtcaccccgaactcgcccagctgtacggcaagaagtcgggcggcggcatgctgctctacggcccgccggggtgcggcaaaacctttctggcgcgggcggtggcaggcgaactcggggccagctttctggaagtcacggtggccgacgtgctcgacatgtggctgggcaacgccgagcgcaacgtgcgcgacctgttcgcctcggcgcgggcacacgctccctgcgtggtgtttttcgacgaggtggacgcgctggggcgcgggcggcagctcacccggcattcctcacactcggtcacgcagaccttgctgcgcgaactcgacggtctgggcgggcgcgaaggcgtgttcgtgctggcggcgaccaacgccccctgggacgtggacaccgcgctcaagcgccccggacggctgggggccacgctgctggtgccgccacccgacctcgccgcccgcgaggcgatgttcaccgagttcatgcgtgggcgccctgccgaacggctcgaccccgcgtggctcgcgcggcagaccgacaacttcagcggcgccgacatccggcaactgtgcgaggaggcctccgagcgcgcgctggcggtggccctcaagcgcggcgggatgcagccggtgcggatgcaggacttcaaagacgccctgaaaacggcggccccctccacccgcgagtggctgatgcaggcgagaaaccacgtggtgtacgccaacgagggcggcagttacgacgaactcgccgcgctgctcaaggaaaagaggttgctgtga

SEQ ID NO: 24205 - DNA, 906 bp, Deinococcus radiodurans
atgaacatctcgattctggggattccgatggacctcggcgcgggccgccggggcgtggacatggggccgtccgcgctgcgtaatgcccacctcgcccacaccctgcgcgacctcgggcatgacgtgaccgacctcggcgacatcgaagtggcgctgcccgaaaccctcgacaagcacgaaacgggcgggctggtctttttcgagcccatcctcgacgcctgccgcaccgccgccgagcgggtcatggcgctgccaggcggcacctttcccctcacgctgggcggcgaccactcggtgagcatgggcaccgtgaccggcaacggcctgcgcgggcgcccgcagcgcaccggggtgatttgggtggacgcccacaccgactacaacacccccgaaagcagcccgagcggcaacattcacgggatgccggtggcgcacctcaccggacgcggcgacgagcggctgacccggctgggcgggctggtgacaggcgagtgggggattcgcccggaagacgtggtgatgatcggcatccgcagcgtggacgcccgcgagcgcgagctgctgcgcgaggcgggcatcaaggcctacaccatgaaggacgtggaccagctcggcatcacccggattcacgaggaaacgcaggagcggctgaacgacgtggagcgcctgcacgtctccttcgacgccgacgcgctcgaccccggcgtgtgccccggcgtaggcaccccggtgcccggcggcctgagctaccgcgaggggcacctcttgatggagctgctctccgaatcgggccgcgtgaccagcatggacatcgtggaggtcaatccgattctggacacccgcaaccagaccgccgaagtgatggtgggcatggcggcgagcctgctggggcagcggattttgtaa

SEQ ID NO: 24206 - DNA, 1296 bp, Deinococcus radiodurans
atgaaaagaccctcgttggcggttcagattctgatcggcctcgtgctgggcgtgatcgtcggggccgtgttttacggcaatccgacggtggtgagctggctgcaaccgctgggcgacatctttattcggctgatcaagatgatcgtggtgcccatcgtcctgagcaccctgatcgtgggcgtggcgggcgtgggcgacatgaaaaagctcggcaagctcggcggcctgaccctgatctatttcgaggtggttacgacgggcgccattctgttcggcctgctgatgggtaacctctttcagcccggcgcgggggtgaacctgggcgacctcaccaagaccgacatcaccaagtacaccgagggtgcccaggccgcgaccagccacagctttgccgacacgttcgtcaacatcgtgccgacgaacgtggtggacgccttcgcacgcggcgacatgctcgccatcatcttcttcgcggtgtttttcgggctcggactgggcgcgctcggtgaacgcggcaagccgctgctgaacatctttcagctcgtggccgacaccatgttctgggtcaccaaccagatcatgaaactcgcgcccatcggcgtttttgccctgattggcgtcaccgtcagtaaattcggcgtgcagagcctcattccgctcggcaagctggtgctggtggtgtacggggccatgctcgccttcgtgctggtcattctgggcggggtcgcgcggctcgcgggcaccagcatcttcacgctcattcaggtgctgcgcgaggaactgacgctggcctactcgacggcgagcagcgaatcggtgctgccgcgcctcatgcagaagatggaggcattcggctgtccgcgctacatcaccagtttcgtcattcccaccgggtactcgttcaaccttgacggcagcacgctctaccagaccatcgccgccctgttcatcgcgcagctctacggcatccacatgccgctcgaaaagcaactgctgctggtcgtcacgctgatgctgacctccaagggcatcgcgggcgtgccgggcgtgagcttcgtggtgctgctcgccaccctgggcacggtgggaattccggtggagggcctcgccttcatcgccggcatcgaccgcattctggacatggcgcgcaccgccgtgaacgtggtcggcaacagtctcgccgccgtcgtcatgagccgcttcgagggcgagttcgacgacgccaagtcccggcagtacgtggccgacatgaaagcaggcaccctgccgccgcttagcgaggcgacggggcactga

SEQ ID NO: 24207 - DNA, 3075 bp, Deinococcus radiodurans
atgcctaagcgtactgatctccagaccatcctgattctcggcagcggccccatccagattgggcaggcagccgagttcgactattccggcacccaggcgctcaaggcgctgaaaaacgagggctaccgcgtcattctggtcaattccaacccggcgaccatcatgaccgacccggaactggccgacgcgacgtatctggagccgctgacgcctgagttcgtggagaagatcatcgagaaggagaagccggacgcgattctgcccacgctgggcgggcagacggcgctgaacctggcgatggaactgcacgagcgcggcagcctcgaaaagtacggcgtggaactcatcggcgcgggcgtggaggccatcaagaagggcgaagaccgcgaactgttccaggccgccatgaaaaaaatcggcgtggaaaccgcacgcggcaagatggtgcactccatggaagaagccgtggagtaccagaaggaaatcggcctgcccatcgtcatccggcccagctttaccctcggcggcacgggcggcggcatcgcgcacacctacgaggagttcctggcgattacggaaggcggcctgcgcgacagccccgtgacctccgtgctgctggaagaaagcatcctgggctggaaggaatacgagctggaagtgatgcgcgacacggcggacacggtgattatcatcaccagcatcgagaacttcgacccgatgggcgtgcacacgggcgactccatcaccgtggcccccgcgcagacgctcagcgacgtggaataccagcggctgcgcgaccagtccctcgccatcatccgtgaaatcggcgtggcgacgggcggcagcaatatccagttcgcggtgaaccccgacaacgggcgcgtgatcgtgatcgagatgaacccgcgcgtgagccgttcctcggcgctggcgagcaaggccaccggcttcccgattgccaagatcgccgcgctgctggcggtggggtaccacctcgacgagctgcccaacgacatcacccgcgtgaccccggccagcttcgagccgagcatcgactacgtggtgaccaagattccgcgtttcgccttcgagaagttccccggcacgcccgacgggctgggcacgcagatgcgcagcgtgggcgaggtcatggcgattggccgcaccttcaaggagtcgctgcaaaaggcgctgcgctcgaccgaaggcgacatccggggcgtgtacgccgagatggacgaggctggactgcgggcgctgctgtaccccaacccgcgccgcatcgaggccgtcatcgagctgctgcgccggggcgagagcgtggagagcctcttcgacgcgaccaagatcgaccgctggttcctctcgcagctcaaggaaatcatggacgccgagaaggaaatcctcgacctcggccccatcgcggaatggaagtacgaactctggcgcgaggtcaagcggctgggcttttccgatgcgcggattggcgaaatcgtgggtctgtctgagttggaagtccgcgacctccgcaaaaaagccaaggccacgcccgtctacaagacggtggacacctgcgccgccgagttcgaggcgcacacgccgtaccactacagcacctacgagtgggaagacgaggtggcccccaccgacaaacccaaagtggtcattctgggcagcggccccaaccgcatcgggcagggggtggaattcgactacgccaccgtccacgccgtctgggcgcttcaggaagcggggtacgagacgatcatggtcaactccaaccccgagacggtcagcaccgactacgacaccgccgaccgcctgtacttcgagccgctgaccttcgaggacgtgatgaacatcgttgagcacgagaagcccgtgggcgtgatcgtgcaactcggcgggcagacgcccctcaaactcgctaagaaactggcggatgcgggcgcaccgatcatcggcacgtcccccgaaaccattcacgaggccgaagaccgtgccagtttcaacgccctgtgcgaacgcctgggcctgccgcagccgaggggcaaagtggcgcagacgcccgcccaggcgcgggaactcgccgccgaactcggcttcccgctgatggcgcggcccagttacgtcctcggcgggcgggccatgcgcaccgtgcgcagcatggatgaactgaccacctatctggacgaggtgtacgccgccgtggaagggcagcccagcatcctgctcgaccagtttctggaaggcgcactggaactcgacgtggacaccctctgcgacggggaacgtgcggtggtcgcgggcatcatggaacacgtcgaggccgccggggtgcacagcggggacagcgcgtgcatcctcccgcccgtcacgctggacgcgggtgtactggagcgcgtgaaggccgacacggagcgcctcgcgctggaactgggcgtgcggggcctgatgaacgtgcagtgggccgtgaaagacggcaccgcgtacatcctggaagccaacccccgcgccagccgcaccgtgccgttcgtgtccaaggccgtgaaccacccgctcgccaagagtgccgcccgcattgccgccgggcagacgctggagcagattggcctgctggaaacgcccacgccgcgcatgtactcggtgaaggaagttcacctgccgttcctgaagttcaaggacgtgctgcccgtgctggggccggaaatgaaaagcaccggcgaaagcatgggcatcgacagtgacccgtacctggcgttctaccgggcgcaactcggcgcgaaaaactacctgccgttggaaggaactgccctgctgatcggggacgggctggacgaagtcgccggaacgctggaaggcgcgggtctgaaggtcattcgggagcaggatggcgacgaactccccgacctgctcattgatgtcacgggttcacccctgctgcgaaccgcgctggaacgcggcgtgccgattgtcagcacgaaagaaggcgcagaatggacagcgcgagcagtggcggaagctaagaaagctgggatgttgggggttcggagcttgcaggagtgggtgaagtaa

SEQ ID NO: 24208 - DNA, 1209 bp, Deinococcus radiodurans
atgagcaaggaaaaaatcgtactcgcgtacagcggcggcttagacacctccatcatcctcaagtggctccagaccgagcgcaactacgacgtggtgtgcttcaccgccgacctcgggcagggcgacgaggtggaagaagcccgtgtcaaggcgttgaacaccggcgcggtggcggcctacgcccttgacctgcgcgaagaattcgtgcgcgactacgtgtttccgatgatgcgctcctcggcgctgtacgagggctactacctgctcggcacgtccatcgcccggcccctgattgccaagaagatggtcgagattgccgagaaggagggcgcggtcgccatttcgcacggcgcgaccggcaagggcaacgatcaggtgcgcttcgagatgagcgcctacgccctcaagcccgacatcgtgaccgtggccccctggcgtgactgggactttcagggccgcgccgacctcgaagcctttgcccgcgagcacggcattccggtgcccaccaccaagaaagacccctggagcatggacgccaacatgctgcacatctcctatgagggcggcccgctcgaagacccctggactgagccgcccacccacatgttcaagctgacggtgaaccccgaggacgcgccgagcgaggccgaatacgtcgaaatcgagtacgtgaacggcgacccggtgagcatcaacggtgaacagctctcgcccgccgcgctgctgacgaaggcgaacgaaatcgccgggcgtcacggcgtgggccgcatcgacctcgtggagaaccgcttcgtgggcatgaagtcgcgcggcgtgtacgaaacgcccggcggcacgctgctgtaccacgcccgccgcgccgtggaaagcctgaccctcgaccgcgaagtgctgcatcagcgcgacgccctggggccgaagtacgccgaactggtctataacggcttctggttcgcccccgagcgcgaagccttgcaggtctactttgaccatgtggccaaaagcgtgacgggcaccgctcgcctgaagttgtacaagggcaactgcatcgtggcaggccgcaaggccgagcgcagcctctacgacaaggacctcgtgagcttcgaggcgggcggtgactacaaccagcacgacgccggagccttcatcaagctcaactcgctgcggatgcgggtgcaaaagcgcgtggaggataaagggaagaagtaa

SEQ ID NO: 24209 - DNA, 1467 bp, Deinococcus radiodurans
ttgttttacgcattccctgaacctagccccgaacttcggcgaggactttttatgaccaaccaaaaacaggaaactaaactctggggcgggcgtttcgccgaaaagaccgccgaactcgtggaactgttcaacgcctcggtcggttttgaccagcgcctcgccgagcaggacattcgcggttcgctggcgcatgtggcgatgctgggggggcagggcatcctgactgccgaggaagtctcccaaatcaccgacggcctgaacggtgtgctggctgacatccgcgccgggaacttcgagtggcgtctggaccgcgaggacgttcacatgaacgtggaagccgccctgcgcgaccgcatcggcccggtggcgggcaagctgcacaccgctcgctcgcgcaacgatcaggtggcggtggatttccggctgttcaccaaggaagccgcgctcgacctcgccgaacagacccgtgccctgcgccgcgtgatgctggccgaggccgaaaagcacctccagaacgaggtcattctgcccggctacacccacctgcaagtggcgcagcccatcctgctggcgcactggttcatggcttacgtggcgatgctggagcgcgacgagggccgtttccgcgacgccgccgagcggatggacgagtcgccgctgggcagctcggcgctggcaggtacgccctggccgctcgaccggcacgcgaccgccgaggcgctgggctttgcgcggcccaccgccaacagtctcgacggcgtgggcagccgcgacttcgcgttggagttcctgagcgcctgtgccatcctgtcggcacacctctcgcgcctctctgaagaactgatcttgtattccaccttcgagttcggcttcatcaccctgcccgactcgcacaccaccgggtccagcatcatgccgcagaagaaaaaccccgacgtgtccgaactggcacgcggcaaggcggggcgcgtcttcggcaatctgatggcgctgctgacggtggtcaaaggtacgccgctcgcctacaacaaggacttgcaggaggacaaggaaggcgtgttcgactcctacgacacgctgagcatcgtcctgcgcctgtatgccgagatgctgcccaagaccgtctggcacgccgacgtgaccaaagcggcggcggcgcgtggctattccaccgccaccgacgtggccgattacctcgcccggcagggtgttcccttccgcgaggcgcacgaggtcgtgggcgggctggtcgggctggcctcgcgctcggaccggcaactgtgggaactgaccgacgccgaactgaaagccgcccacccgctgctcagcgcggaagtggcgcagaaactcaccgtcgaggaaagtgtccgcagccgccagagctacgggggcacggcgcccgagcgggtgcgagaagcggtggaggcggcgaaagaaaagctgcgccaggaaacgggccagccttaa

SEQ ID NO: 24210 - DNA, 1185 bp, Deinococcus radiodurans
atgattcgcaaagaacgcgccattctggctctggaagacggcaccgtgtaccgtggctacgcttttgggtaccgcggcgagaccgtcggtgaagtggtgttcaacacctccatgaccggctaccaggaaatcatgaccgatccctcgtacaacgggcagatcgtgaccatcacttacccgcacgtcggcaactacggcgtcgccatctacgacatggagagcaacaagccgtatgtgcgcggcttcatctcgcgcgagttcagcggcgagtactccaactaccgcgcccagcagtcgctcgaagcgtttatgcagcagtacggcgtcgtgtctatccagggcatcgacacccgcgccctggtgcggcgcctgcgctcgggtggtgtggtcaagggcgtgattgcccaccgcagcttcacccaccccgaagacccctacggcgagttcacccccgccgaggagcagatctacgtgcagcgggcgcgtgaccatcaggacatcgacgggtttgatatgaccaaggaagtcaccaccgcgctgccctacgccttccctacgctgcgccagggcaagcgcgtggtgctgatggatttcggcatcaagcacaccatcatcgagcggctggccgaagtcggcatcgaacccatcgtggtcccggcgcacaccaccccggcgcagatcatggcgctgcaaccgcacggcctgttcctcagcaacggccccggcgaccccgccccgctggaatacgcccacaagactgcctgggaaatgatgggactgctccccaccttcggcatctgcctgggccaccagattctgggcctcgcggcgggcggacagaccttcaagatgaagttcgggcaccggggcggcaaccagccggtcaagaacctgctcaccggcaatgtagagatcaccagccagaaccacggctacgctgtagatctagacagcattcccaacggcgctttcgtcgccactcacgtgaacctcaacgacgggacgctcgaaggcatggcccacagccgttatccggtgttcagtgtgcagtaccaccccgaggcttcgcctggtcctcatgacagccgctaccttttcgaccgcttcatcgaggagattgacgccttcgacggaggcaacggtacccccattattaaggccaatcctgggcgtttgggggtttga

SEQ ID NO: 24211 - DNA, 744 bp, Deinococcus radiodurans
atgaccgaccaacccgacctgttcggccttgcgccggatgcgcccaggcccatcattccggccaacttgcctgaagactggcaagaggcgctgctgcccgagttctccgcgccctatttccatgaattgaccgactttctgcgccaggaacgcaaggagtacaccatctacccgcccgcccccgacgtgttcaatgccctgcgctacacgccgctcggagaggtcaaggtgctgattctcggccaggacccctaccacggccccaatcaggcgcatggcctgagcttttccgtccggcccggcgtgcgcgtgccgccgagcctgcgcaacatctacaaggaactcaccgaggacatccccggcttcgtggcgcccaagcacgggtatctgcgttcatgggccgagcagggcgtcttgctgctcaatgccgtgctcacggtgcgggcggggcaggccaacagccaccagggcaaaggctgggaacacttcaccgacgcggtgatcaaggccgtcaacgccaaagaggagcgcgtcgtctttatcctctggggcagctacgcccgcaagaaaaagaagctgattaccggcaaaaaccacgtcgtcatcgagtcggggcatccctcgccgctcagcgaacagtatttcttcggcacccggcccttttccaagaccaatgaggcgctggaaaaagccgggcgcgggccggtggagtggcagttgccggccacggtgacggaggaatga

SEQ ID NO: 24212 - DNA, 1749 bp, Deinococcus radiodurans
atgacgcaacagaagcaaggcgtcgtgcagagcatcgccggcccggcagtcatcgccaagggcatgtacggtgccaagatgtacgacatcgtgcgcgtgggccaggagcgcctcgtgggcgaaatcattcgcctcgacggcgacaccgccttcgtccaggtgtacgaagacaccgccggtctgaccgtgggtgagcccgtcgagaccaccggcctgcccctctcggtcgaactcgggccggggatgctcaacggcatctacgacggcattcagcgcccgctcgacaagatccgtgaagcctccggtaacttcatcgcgcgtggcatcgaagtttcctcgctcaaccgcgagcagaagtgggactttacccccagcgtgcaggcgggcgacacggtcacgggcagcgggattctcggcaccgtgccggaattctcctttacccacaagattctcgtgccgccggaagtgcagggccgcctgcgttcggtcgcgccggccgggcagtacaccatcgacgacaccatcgccgaactcgaagacggcaccaagctgcgcctggcacactactggccggtgcgtgcgccgcgtccggtgcagaagaagctcgatcccagcctgcccttcctgaccgggatgcgcatcctcgacgtgatgttcccgctggtgatgggcggcgcggcggcgattcctgggccgttcggctcgggcaagaccgtgacgcagcagtcggtcgccaagtacggcaacgccgacatcgtggtgtacgtgggctgcggcgagcgcggcaacgaaatgaccgacgtgctggtggaattccccgaactggaagaccccaagaccggcggcccgctgatgcaccgcaccatcctgatcgccaacacctccaacatgccggtggcggcgcgtgaagcctcggtgtacaccggcgtgacgttggccgagtacttccgcgaccagggctacagcgtctcgctgatggccgacagcacctcccgctgggccgaagcgctgcgcgaaatttcctcgcgcctcgaagaaatgcccgccgaagaaggctacccgccctacctcggcgccaagctggcggcgttctacgagcgcgccggtgcggtgaagaccctcgccggcgaagacggcgcagtgtcggtcatcggcgccgtgtcgcccgcaggcggcgacatgtccgaacccgtgacccaggccaccctgcgaatcaccggcgccttctggcgtctggacgcgggcctcgcccgtcgccgtcacttcccggcgatcaactggaacggctcgtactcgctgtttactcccattctggacaagtggtaccgcgagaacgtcggccccgacttccccgaactgcgccagcgcatcggctcgctgctgcaacaggaagcggcgctgcaagaagtcgtgcagctcgtcggccccgacgccctgcaagacaacgagcgcctcatcattgaaacgggccgcatgctgcgccaggacttcctccagcaaaacggcttcgacccggtggacgcttcggcctccatgcccaaaaactacgggctgatgaagatgttcctcaagttctacgacgaagccgaggcggccctgcgtaacggcctgaccatcgacgaaatcattcaaaacccggttatcgagaagctcgcccgcgcccgctacacccctgaaaacgaattcatggcgtacggcgaaggcgtgatggacgagctcgaccagaccttcaaggcggtgaaagcgtga

SEQ ID NO: 24213 - DNA, 1416 bp, Deinococcus radiodurans
gtgacccttctccagaaggaatacaacgatgtcgcgtacatctccggcccgctgctgttcgtgaacgccgcgagcgacctgcccaacggcgccatcgtgaacatcaaggacggcaacggcaagctgcgcggcggacgcgtcatcagcgtgtctgaccagaacgccgtgattcaggtgttcgaagaaacccgtggcctcgacctcgccaccgccagcgtcagcctggtggaagacgtggcgcgcctcggcgtgagcaaggaaatgatcggtcgccgcttcgacggcctgggccgccccatcgacgggctgcctgccgtggtggccgaacagcgcctgagtgtggacggccagccgatgaaccccgccgcccgcgccaagcccgaggagttcattcagaccggcatcagcaccatcgacgtgcagaccagcctgattcgtgggcagaagctcccgatcttctccggctcgggcctcccgcacaacgaactcgccgcccagatcgcccgtcaggcgaaggtgcccggtcacgaaggcgacttcgccgtggtgttcgcggcgatgggcctgacccagcgcgaagtgagcttctttacccaggagttcgagcgcaccggcgcgctggcccgctcggtcctcttcctgaacaaggccgacgaccccgcggtggagcgtctgctgaccccccgcatggcgctgaccaccgccgagtacctggccttcgagcacggctaccacgtgctggtgatcctgaccgacctgacgaactactgcgaagcgctgcgtgaaattggcggcgcgcgcgaagaaatccccggtcgtcgtggcttccccggttacatgtacaccgacctcgcgtcgctgtacgagcgcgccggtgtggtggaaggcaagcccggctcggtcacccaggtgccgatcctgtcgatgcccgacgacgacatcactcaccccatccccgacctgaccggctacatcaccgaagggcagatcgtggtcgaccgcaccctgaactccaagggcgtgttccccccgatcaacccgctgcccagcctctcgcgtctgcaaggcaacggcatcgggaagggcaagacccgcgccgaccacaagaacgtggccgaccagctcttcgccgcctacgccaacggcctcgacctgcgcaagctcgtggcaatcaccggtgaagacgcgctgaccgagaccgacaagctgtacctgaagttctccgatgatttcgaaaactacttcatcggccagggcgaccaggaccgcagcatcgacgactcgctgaccgtcgcctggggcattctgtccaaactgccgcagagccagctcacccgtctgtccaaggactccatcgacaagtactacggcaccaagatggacgaaatgtggaagggcggacgcagcagcatctaa

SEQ ID NO: 24214 - DNA, 675 bp, Deinococcus radiodurans
atggcaggacaaatcagccccacccgctccgcgctgctcgccagcaaggccagcctcaagaccgccaacggcggcgccgacctgctcaagcgcaagcgtgacgccctgatcggcgaattctttgcactcgtcaaggacgcgctcgccgcccgtgagcagctctcgagcgtgagcaaaggcgcgtataccagcctcttcggcgccaaagcctgggacagccccgaggccgtcgagagcctgagcctcgccgggaccggcgactacgccgtggacatgcagatcgagagcatctacggcgtgaaggtgcccaagatcaacatccccgagcgcgccgcccaggcggacttcagcccgatcaacgtcggcgcccgcaccattcaggcgtcgaacgacttcggcggggtgctcgaagccatcgtgaaggtggcggccaccgaaaccaagctgcgccgcatcggcgaggagatcaaaaagacctcgcgccgcgtgaacgcacttgaacaggtggttatccccggcattcacgacgacatccgcttcattcgcagcgtgctcgaccagcgcgaacgcgaagccggctacacccagaagaagatcaaggccaagatcgagggcaagaacaaagaagcccgcgaagccgccgccgcgaccagccacggcagcgccgccgactga

SEQ ID NO: 24215 - DNA, 1974 bp, Deinococcus radiodurans
ttgaccgcgctgcccttttcccccacactggcttgcaaatccaaaggcaacgcttgccccctccggcacgacctcccagcgcgactttgcgcggcaggccgtgccggagcttcgttttgccccctcatccaaggagttcttatgtaccccaccgccaccctgagtgcccagcacgaccacacccccggttacaccgaacgcctcggtgcgctcctcggcgggcacgtccgcgtgcggctgcggaccaccctgccggtcctgggcgtgcggctcaaagtcgtgcagatcggtgaaatcgagactcttcccgcccgcgaggtgacgggcttgcagggcgaaggccgctggttcgaggccgacctgccgctgcacgaggcccgcgtgcgctacgcctggcacctcgacctgcctggcgaccacctcaacctgacccggctggggctgcaccacgcgcgccggggctttcgctcgtggtttcagtacctcgcgggctatcaggcgcccgagtgggcctggaagtcggtcttttatcagattttccccgaccgctttcgcaacggtgattccacgaacgacgtgcagaccggcgaatacttgtacgaaggccgcccggtggaaaaggtggagtggacgcacccggttgacgcctggggcgatattcacgggcactacggcggcgacctcgcgggcatcacgcaggcggtgccgtatttgcaggcgctcggcgtgaccgggctgtggctcacgccgattttcacctcgccgagcaaccaccgctacgacatcaccgattaccgcgccattgacccccacctcggcggggacgccgcgtgggacgcgctggtgcaggcgacggacgcggcgggcatccgcatcgtccttgacggggtgttcaaccatatgggcaacgaaaacgcgctgtttcaggccgcgctcgctgccgaggacgcccccgagcgggccatgttcacctggcgcgatacgccgggcaagccgccctaccactcctttttcgacgtggcgacgctgcccaaaatcgactacgccaacgagcgggcggtggaggagtttttcagcggcgagcgcagtgtggtccggcactggctgcggcgcggcgcggcgggctggcggctggacgtggcgcacatgctcggcaagggcggcaccgaggaagacaatctggcgctgcaccgcgtgctcaaggcggcggcgcggcaggaaaaggccgacgcctacgtgttcggcgagcgcttctacgaccccgaactcgcgctcgacgggcagggcgaagacggcgcgatgaactaccacggttttggcctcccggtgatgcagtggctggcgggcgcgacctatttcaacgaaccgagccgcctggacggcactgaactcgccgaaattctctgggatgcgtaccacgcgctgccaccgcaggccgcgctgaacatgttcaacctgctcgaatcgcacgacatcgggcgggcgctgtggcggctggggggcgaccgcaccaagtaccgcgccgcactcacgctgctgctcgcctacgcgggcgtgccgtgcctgtactacgggagcgaaatcggcctctcgcagtcgcgcgacggcaacatgccgtggtgccgcgagccgatgccctgggacgaggcgaggtgggacatggagctgctcgcccatgtcaaagctctggtgaaggttcgccgcgagacgcccgtgttgcacaccggggcccttcagttcatccacgccgagccggacgccctcgccttcctgcgcgaagtgaccgggccggacggcgcggcggagcgggtggtcgccctcgccagccgccgggccggggcacatccggtgaccttcaccctcccggcgggcgagtggcaagacgccctgagcggcgagcggctcggcgggggagaggtcacgctggacgcggcgggcgggcagttgctgctcagtttgcctctcagtcgctga

SEQ ID NO: 24216 - DNA, 912 bp, Deinococcus radiodurans
atgacctctctgcccctgatcgtgagcgcgggcgaagcgctgaccgacctcgtgaccgccgggggcaacacctggcacgcccaccccggcggcgcgggctggaacgtggcccgcgcctgcgcccgcctgggagtgccgagcgccttcgcgggcgcggtggggcaggacaacttcggagacgacctgcaccgcgagtcgctggaagcgggcctcgacccccgctttttgcagcgcgtacccgcccccactctgatggcggtggtgtacagcacccggcccccgcagtaccgctttctgggtgaaaacagcgccgacctgcacttcgaccccacccggctccccggcggctggctcggcgccgcccgctggctgcacgtaggcggcatcagcctcgcccgctggccgctcgccgacacgctgctcggggtcatcgaggcggcgcgggcggcaggcgtccgcatcagtttcgaccccaacgcccgcattgcccaccgtcaccccgactacccggctgtgttcgccgccgtgaccaagcgggccgacctcctcaagttcagtgatgaggacctcgcctttttcttccccggcgcgagcgaggcgcaggcgttgcaggaattgcgcgggctcaatccgcgctgccccattgtggtcacgcgcggggcggcgggggcgagcctgtaccacagcgccgggcgggtggacctgcccacggtgccggtggaggttgccgacacggtgggcgcgggcgacagtctgtgtgccggactattggtgagcgccaccgagcgccccgacgccctgtggactgagcacctgcgcttcgggctgggggccgcctccgtgacctgcgctcatgccggggcgtacgcgccgacgcgggaggaagtggcggcactgagcagtgggaaatga

SEQ ID NO: 24217 - DNA, 756 bp, Deinococcus radiodurans
atgtcaagcgaatcgagttctcctctggtggtcgtgacgggcgcggcgcgcggcatcgggcgggccattgccgagctgtacgtggagcgcgggcacccggtgctcggcgtggacctcagcctgccgcctgtactgcggggccagcgccgcgtcaaggcggacatcgccaccgccgctggccgcgcccgcatcctcaaggcggcgcgcgaacacggcgaggtcagcgtgctggtcaacaacgccgcctatcaggacgcgcacggcagtgtgctggaggtcagcgaacgcggctgggcccgtaccctgaacgtcaatctgaccgcgccgctgctgctcacgcgcgagcttatcgagttgcttccgtccggcagcgcggtagtcaacgtcgccagcgtgcagggcctcttcgccgagcagggcaacgccgcctacaacgcctccaagggcggcctcgttaacctgacccgcgccatgtgcctcgacctcgcgccgcgcggcctgcgggtgaacgcggtggctcccggcgcgattgccaccgaggccgtcttgcaggcgattgccgggagcggggaccccgagcagacccggcgcgactacgaagacctgcacgcgctgcgccgcctgggcaccccgcgtgaggtcgcgcaactggtgtatttcctcggcagccccgaggcgagcttcctgaccggggccattgtgccggtagacggcggcatgacggccagtttcatgatggcggggcggcctgtttaa

SEQ ID NO: 24218 - DNA, 798 bp, Deinococcus radiodurans
atgctgcggggcgtgctcgccaaacgcatcgttccctgcctggatgtccaaaatggccgcgtggtcaaaaacgtgcgctttttcgaggatcaccgcgacgcgggcgacccgctggtgctcgcgcaggcctacgaggcgcaacaggccgacgaactcgtcttctacgacatcaccgcaacgcacgagggccggtcactcatgctggacgtggccgcccgcgtggccgagcaggtgatgatgccgctcaccgtgggcggcggagtgggtgccctctccgattttcgtcaactgctgctcgccggggccgacaaaatcagcgtgaacagcggcgcggtaaagcggcccgaacttatccgcgaggcgagcgaccactacggggcgcagtgcgtgatgctcagcatcgacgccaagcgccgccctggtgggcagggctggaccgtccatatcggcggcgggcgggtggacactggcctggacctgctggcgtgggcgcggcgcggccaggaactcggggcgggtgagctgtgcctgaacgtgatggacgccgacggcacccgcgccggcttcgacctggaagcgacccgcgccgtggcccgcgaggtggacctgccggtcatcgcgtccgggggcgcgggcaaggtgcaggacttttacgacgtactgaccgctggcgaggccgacgccgcgctcgctgccagcgtctttcatttcggcgaactgacggtgccgcaggtcaagacctccctcgccgcgcagggcgtgccggtgcggcccgagtggcggggcgctaccgaataa

SEQ ID NO: 24219 - DNA, 657 bp, Deinococcus radiodurans
atgaccgacctgtccgaactcaactttgaccccagcggcctgattcccgtcgtcacccaggacgcccgcagcggcgcggtgctgatgcaggcttacgccgaccgcgccgccgtggagcgcaccctggacacccgcgaggcgacctattacagccgttcacgcggggaacagtgggtcaagggtcagaccagcggccacacccagcgcgtggtgagcgtgcacgtagactgcgacggcgacagcctgctctaccgggtggaacagaccggcccggcgtgtcacaccggggaatattcgtgcttttaccgccccctgttggaagacgatgcaccggacaccggactcgacggcacgctggagcgcgtgtacgcgaccatcactgagcgcctcgccaccctgccggagggcagttacgtggcgcggctgcacgcggggggtctcgaccgggtgctgaaaaaaatcagcgaggaagcgggcgaagtcctgctcgccgccaagaacgccgaccgcgccgaactcgccaccgagaccgccgacctgctgtttcacacgctgttcgccctcgccgaggtgggcgtctctcccgccgacgtggccgccgtgctgcaagggcgcgagggcaaaagcgggctgaaggggccgaaggaagtgggctga

SEQ ID NO: 24220 - DNA, 1317 bp, Deinococcus radiodurans
gtgtttgtactcgctctgctcgccaaaaagctgtgccatctttttgtcaaatgctctacgtcataccggcgcctttctgcgaaggggcgccgcttttttgactctcgcggcggagcctgtttgctcaagccgccgcgccggggccgccaatcccgctacagtcgccctatgaggtacctgaccgccggagaatcgcacgggccacagctcacggccattatcgaggggctgcccgcgcagttgccgctgggcaaggccgacatcgacccctggctgagaaaacggcagggcggctacggacgcgggcgacgcatggtcatcgaaaccgacgaggccgagcttctgagcggcgtccgtgcgggccgcaccaccggcgcccccgtcaccctcgccattcagaacaaggaccaccgcaactggactgaaatcatgtcgcctgagccgggaggcgagccgcgcaagaaggcgctgaccgacgcccgccccggccacgccgacctgaccggcggcatcaagtaccgtcacaaggacctgcgcgacgtgctcgaacgcgcctcggcgcgcgaaacggcggcgcgggtggcggtaggcagcattgccctcaagctgctttctgaactcggcatcgagggggccaactatgtcttcaaccttgctggcattgaaacgcggcaggccttctcctgggacgcactcgacgccatcgaggactccgacctgcgcacccccgatgccgacgccgccgcgcagatgcgcgagcgcatcgaccaggccaagaaggacggcgacaccctgggcggcatcctcgaagtgcgcttccggggcctaccggtcggtctgggcagttttgtccactacgaccgcaagctcgatggcaaaatcgcccaggcgtgcctcagcgtgcaggcgatgaagggcgtggaaatcgggcgggccttcgagaacgccgtgaaacccggcagcggtgttcacgacgccattcactaccgcgaaggcacctacgcccgcgacaccaacggggcgggcggcctcgaagccgggatgaccaacggcgaagaactcatcgtgcgggtcgccatgaagcccatcgccaccctgatgaagccgctgcccaccgtgaatgtcgtgacccacgaagcgtctgacgcggcccgcgagcgcagcgacacgaccgccgtgcccgccgccggggtcatcttgcagtgcgtcatcggttgggtgctggccgaggcgatcaccgagaagttcggcggcgataccctgcccgagcttcaggagcgtctcgcggcggcgcggcgttacgcagccgaatactga

SEQ ID NO: 24221 - DNA, 1053 bp, Deinococcus radiodurans
gtgcgacgagttgaggtcggcggcgcggcgccttacgccgtggaggtcggccctggcctgctgacccgtctcgcggtgcctgaaacgcctagcgccctgattcatcccgccgacctacccgccgcgtgggtcgagcaggcgcaggcgagcttgcagccccatctgacggtgaccgtgcccgcccgcgacgagtgcaagacgctggaagttttcgcggacgtgctctcgcagctcgcgcaggcgggcctgccccgcagcggcgcggtggtgggcctcggcggcggcgcggcgaccgacctcgcgggttttgttgcggcaagttacctgcgcggcgtggctttctacaccgcgccgaccacgctgctcggcatggtggacgcggcggtgggcggcaaaacaggcgtcaacctccccgaaggcaaaaacctcgtcggtgccttctggccgccccgcgccgtgtggtgcgacacggctacgcttaccacgctgccggacgccgtgttccgtgagggggccgccgaagccttcaagcacgggttgatggctgaccccagcctgctcgaccgggtggtgtcgcccgactttcggcccggcggcgctctgctcgaagacaccctggccgatgcaattgctgtcaaggccggggtcgtcacccgcgacctgaccgagcagggcgagcgggctttcctcaacttcgggcacacgctggcgcacgcgctcgaagccgtgacccatcaggccatcccccacggcgaggcggtggcctacgggatgcactacgccgctcgcctcagccacgcgctcggcggcgccgacctgaccgcccacacccgcgcttttctgcgctggcaacggccccggcgcctgccgccgctcactttcgacgcgctcgcgcccttcattgcccgtgacaagaaggccgacagcgcgggcgtgcgcttcgtgctcctgcgtgacctcgcccagccttacctcgcccgcgtgcccgacgacgtgctgcgccgcgagttcgacggttggcaagcagacctagcggagctttttcctctttag

SEQ ID NO: 24222 - DNA, 432 bp, Deinococcus radiodurans
atgctgctcattctcaacggtcccaacctcaaccgcctgggcctgcgcgaaccgggggtttacggctcgcagaccctcgaagacctggagcgccagtgcgaggcctggggcgccgaactggaaatgagcgtcacctgccgccagagcaactacgagggccagctcctcgaatgggtgcaggacgccgaggagcagggctttaccggcctcgtcatcaaccccggcgcgctgacccactacagctacgccctgcgcgacgcgattgcggggcagcgactcccggtggtcgaggtccacatcagcaacgtggacgcccgcgaggagttccggcaccagtcggtcacggcggcggtgtgccggggcaaaatcagcggcctgggcttcagcggctaccggctggcgatggagtatctggcagaagtgctcgagtga

SEQ ID NO: 24223 - DNA, 1398 bp, Deinococcus radiodurans
gtgggactgggactgagcaagtctcagcctgagtgtccccaggcaagcccaagcaaaagctcagccaagctggacgcccccaccgccgcagcccctacactgggcagcatgacgggcaacgaacagaatccgagcaagtggctcgccgccgaaaagaagtacgacagcggcgtctacaacaagcacgacgtggtgatggtgcgcgggcagggcgcgacggtgtgggacgagaatggccgctcgtacatcgactgcgtggtcggctacggcgtggcgacgctcggccacagccaccccgatgtggtcaaggccgtgcaggagcaggcgggcaagctgatggtgatgccccagaccgtgcccaacgacaagcgggccgaatttctgcaagaactcgtcggcgtgctgccgcagggcctggaccgcgtgtttctgtgcaactccggcaccgaggcgatggaagcggccaagaagttcgccatcaccgcgacgggccgctcgcgcttcgtgagcatgaagcggggattttcgggccgcagcctgggcgcgctgtcctttacctgggagccgaagtaccgcgagccgttcggcgacgccgtggacaacaagagcgtggacttcgtgacctacggcaacctcgacgaactgcgggccgccgtgaccgagcagaccgccgccgtcatcatggaacccgtgcagggcgagggcggcgtgcgcccggcgagcgccgagtttattcaggaggcccgtcgcatcacccgtgaaaagggcgccctgctgattctcgacgaaattcagaccggcttttgccgcaccggcaagatgttcgcctgcgagcacttcggcgtaatcccggacggcatgaccctcgccaaggccatcgcgggcggcacccccaccgccgcttttgccatgatgagcgaagtcgctgaccggatgccggcgggcggacacggcaccaccttcggcggcaacccgctgagcatggccgccggcgtcgcctcgctgcgcgccatgaagcgcgaagggctggccgagcaggcccgcgaaaagggcgcgtacatgatggacaaactgcgcgccattcagtcccccaaaatccgcgaggtgcgcggcctgggcctgatgattggcgtggaactcaaggaaaagagcgccccctacatccacgcgatggagcacgacgagggcgtgctgtgcctcgccgccacgccgctcgtcgtgcgcttcctgcccccggcggtcatcagcaaggagcagattgaccaggtggtcgccgccttcgagcgcgtgctgaacaatgtcaacccccgcgaggagaggcaagccgaactgcgcgcccagcagagcgaaatgggccagcaacaggtcagccagggcgagagcgtccagaccgagtaa

SEQ ID NO: 24224 - DNA, 1572 bp, Deinococcus radiodurans
atgattaaagttcaggactaccgcccccagcctttcaccgacttcaccaaagaagaaaacgtccaggcgtaccaggccgccctcgccaaagttcggaaagaactccttggcaagcactacccgctgattatcgacgggcaggaagtggacaccgaagggaaaattcagagcatcaacccctgcgacacctccgaagtggtgggcaccaccgccaaagcgaccataggtgacgccgaaaacgctctacaaggcgcctggaaagctttcgagagctggaagaagtgggacatggacgcccgcgcccgcattctgctgaaggccgccgccatcctcaagcgccgccgcctggaagcctgcgccctgatgagcatcgaagtgggcaagaactacgctgaggccgacgtggaagtggccgaagcgattgactttctggagtactacgcccgcagcgccatgaagtacgcgggctttggcagcagcgaaacgacgtggtttgaaggcgaggaaaacggcctgatgagcattccgctgggcgtgggcgtcagcatcagcccctggaacttcccctgcgccattttcgtgggcatggcggcggcgcccatcgtggcgggcaactgcgtcgtggtgaaacccgccgaggatgcgggcctgatcgccgggttcatggtggacatcctgcgcgaggccgggctgccggccggcgtgctgcaattcctgcccggcgtgggcaaggaagtgggcgaatacctgaccacgcacgccaaaacccgcttcatcaccttcaccggcagccgtgcggtgggcctgcacatcaacgaggtggcggccaaagtgcagccgggccagaagtggatcaagcgcgtgatcatggaactcggcggcaaagacggcctgatcgtggacgaaaccgccgacatcgaaaacgccattaccgccgccacgcagggcgcgttcggcttcaacggccagaagtgcagcgccatgagccgcctgatcgtggtggacagcgtgtacgacgaagtggtcaacggcttcgtggaacgggctaaagccctcaagatggggacgggcgaggaaaacgccaacgtgaccgccgtcgtgaaccagatgagcttcaacaagatcaagggctatctggaactggcccccagcgaaggcaaagtgctgctgggcggcgaggccacgggcgaagcgaacggcaagcagggctactacattcagccgaccatcgtgggcgacgtagaccggaactcccgtctggcgcaggaagaaatcttcgggccagtggtcgccgtgctgcgggccaaagactggcaagacgcgctcgacatcgccaactccaccgagtacgggctgacggggggcgtgtgcagcaactcccgcgagcggctggagcaggcccgcgccgagtttgaagtgggcaacctgtacttcaaccgcaagatcaccggcgccatcgtgggcgtgcagcccttcggcggctacaacatgagcggcacggacagtaaggcgggcggcccggattacctgagcaacttcatgcagctcaagacggtgacggaacgctggtga

SEQ ID NO: 24225 - DNA, 801 bp, Deinococcus radiodurans
gtgtcaaggcgcgtgggcgggcggcccaggggctcaaccccagaccgctacacttgccgcatgacttcccacagtgctctctttcggctggacggcaaacgcgccctggtgacgggcggcagcaaaggcatcggcctggcggcggcgcggcagctacgcgaactgggggccgaggtgacgctcgcggcgcggggcgaggaaacgctgcgccgggccgccgaggacattggcgcggcgtgggtggtggccgacgtgagcacacccgaaggggtgaaggtcgccgcagacgccgccgggcaggtggacattctggtgagcaacgcgggcgggccgcccccctcgctgccgagcgaagtcaccgaggccgcgtgggagcagggctttcagaccaccttcctcagcaccgcccggctggtggacgccgtgctgccgggaatgcgcgagcggcgctgggggcgcatcatcgccatcaccagcctgaccgtcgggcggcccagcttgaccctccccgtgagcaacgcgctgcgggccgccgtgaccaaccacctgcggacgctggcgctcgaagtcgccgccgatggcgtcacctgcaacaccgtcgcccctggctacaccgccaccgagcgactgcaaaagctgcacgccgaccccgccgaggccgacaaactgcgggccaagattccggcgcggcgcttcggtgagccggatgaagtggcctccgcgattgcctttctggcgacgaacgaggcggcgtatatcaccggacaggaactgctggtggacgggggctggagcatttga

SEQ ID NO: 24226 - DNA, 591 bp, Deinococcus radiodurans
gtgagtaccatcaacttcgctgcccgtgagatcaactgcaaaatcgtgtactacggccccggtatgtgcggcaaaaccaccaatctcaagcatgtgttcggcaaagtacccggccacctgcgcggcgagatggtgtcgctggcgaccgaggacgaacgcacgctctttttcgactttctgccccttgacctcggcacggtgcagggcttcaagacccgctttcacctctacaccgtgccgggacaggtcttttacaacgccagccgcaagctgattttgcgcggcgtagacggcatcattttcgtagccgactcggcaccgggccgcctgcgtgccaacgccgagagcatgcgtaacctgcgcgagaacctcgccgaacacggcatcgacatcaacgacgtgccgattgtgattcagatcaacaagcgcgacctgcccgatgccctgcccgccgacatgatccgcgccgtcatcgacccccagaggcggtacccgacctacgaggccgtcgcttccaagggcacgggcgtgttcgagacgctcaaggccaccagccgcctggtgctggaaaagctgtcgcgcaaccgctga

SEQ ID NO: 24227 - DNA, 1647 bp, Deinococcus radiodurans
atgacatctgcacttcctcgccctgctccttcgccctatgcccgccgcaagacggccctcgtcatcggcgcgggcttcggcggcctcgcgctcggcattcggctgcaaagcctaggcttcgacaccaccattctggaacggctcgatggaccggggggtcgcgcctaccagaagcgcacgccggacgggtatgtgttcgacatggggccgaccgtgctgacggtgccgcatttcatcgaggaactgttcgcgctggagcgggaccgcgctggcctggacgcgcccgactacccacccgaggtgctgagcggcgagcgggtcaaggagggcgtgagcggcggcccccacaccagccggtacgtgacgctggtgccgattttgcccttctaccgcatcgtctttcatgacggcacgtatttcgactacgacggcgacccggagagcacccggcgccagattgccgaactcgcgccgggcgacctcgcgggctatgagcgctttcacgccgacgccgaggcgattttccggcggggctttctggaactcggctacacccatttcggcgacgtgccgacgatgctgcgggtggtgcccgacctgctgaagctcgacgcggtgcgcaccctcttttcgttcacgtctaaatacttccagtcggacaaactgcggcaggtcttttccttcgagacgctgctcgtcggcggcaatccgctgagcgtgcccgccatctacgcgatgattcacttcgtcgagaagacctggggcatccactacgcgatgggcggcaccggggcgctggtgcgcgggctggtgcagaaatttgaggagctcggcggagccatccgctacggcgccggcgtagacgaggtgctggtggacggcaatctacccggcaaacgcacagcgcgcggtgtgcggctggagagcggcgaagagctgcgggccgacctggtggcgagcaacggcgactgggcgaacacctacctcaagcgcgtgcgtccctcggcgcggctggtcaattcggacctgcgggtgaaggccgccagcgaaagcatgagcctgctcgtcgtctatttcggctttcgcggcggcgacgatctgccgctcaagcaccacaacatcctgctggggccgcgctacgaggcgctgctgagcgagattttcgggaccaagcggctcggcgaggatttcagccagtacctgcatgtgcccacgctgaccgaccccgcgctggcccccgccgggcaccacgccgcctacacgctggtgccggtgccccacaacggcagcggcatcgactgggacgtggaagggccaaagctggccgaagctgccctggccgacatcgaacggcgcggcctgattccggggctgcgtgagcgcctgacccacttcgagttcatcacgcccgactacttcgcgggcacgctcgacagctacctcggcaacgccttcgggccggagccacggcttgtccagagcgcttttttccgcccgcacaaccgcagcgaggacctgcacaacttctacctcgtcggcgcgggcgcgcagccgggcgccgggacgccgagcgtgatgatgtcggccaagatgacggcccgcctgatcgccgaggacttcgggattcacgcggacatccggcgctga

SEQ ID NO: 24228 - DNA, 900 bp, Deinococcus radiodurans
atgcagacctcttccgaacctgccgcttccgaaaccgccgcgctgctcggcaaaccgctggccgatcgggtcatgcgcggcgtgcgcgccgacctgaaagcctgggcgcaactggacccaccctttgagccgcaactggtgagcgtgctggcctctgacgacgaggcctcgcaggtctacgtgcagagcaaggcgaagcgcgccaagaagctgggggtggcgttccgggtggtggacctcggcgcggcggccacgcaggaggcgttggaacagaccctgcgcgagctgtccgccgaccccgccgtgcacggcatcgtgctggagctgccgctggccgctgggctggacgccgacgccgcgctgctgcacattgcggcgcgcaaggatatcgaggggctgagcccggccaacctcgccctgatcgccgccggacgcgaacccgaggcgctgttgccgcccacgccgcgctcggtgcgctttctgctgcggcacgcgctgggcgacgacctgcgcggcttgcgggtggcggtcatcgggccggggcgcacggtgggccgcccgctgctgtttatgctgaacaataagggcgcgacggtaacgctgtgcaacgagcacacccgcgacctcgcggcggtgctggctgcgcaggacgcggtggtggtcgcagtaggcaaggcagggctgctgcggcccgagcaggtgcagccggagcacgtcgtcattgacgccggcatcaacgtgcaggaaagcggtgacatggtgggcgacgctctacccgagctgccggtgcgcgcccagaccccggtgccgggcggcgtggggccgctgacctcggcgctgatgtaccagaatctggtgcgcggcgtgaagttgcagcgcggggagccagtggatgactga

SEQ ID NO: 24229 - DNA, 1722 bp, Deinococcus radiodurans
gtggccttcccgtgcggtcaggcggggaacaagataacaaggccgggccaatgtgtcaacgggggcagggcacgctcagccccgtctaagtttcgccttgaccccttacccgcctccgcgctactttttgaggagctcccgcagcaggagccacccacttcagagcgcccgagagacctggctcgacgacggcgcggcaaccggaccccatcacgtcacggtgccaaggccagccccctgggcgtgtcaacgatgagccgccgggcgggaccaagcgggaaggccacgcggatgacgatattcaagtgtcccttctcgattcacagcaggcagggggagtgccgtgactggcgcccccgaacctgcttcccccgaggagccgccaccatgaccgataccaaacagccgcagcctctgcacttcgagaccttgcaggtgcacgccggacaacgccccgaccccgtgaccggagcgcagcaaacgcccatctacgccaccaactcctacgtgttcgagtcgcccgagcacgccgccgacctcttcgggctgcggcaattcggcaacatctacagccgcatcatgaaccccaccaacgacgtgttcgagcagcgggtggccgccctcgaagggggcgtgggggcgctgtcggtgtcgagcgggcacgcggggcagctcgtgacattgctcacgctggcgcaggcgggagacaacatcgtctcgtcgcccaacctgtacggcggcaccgtcaaccagttccgcgtcacgctcaagcggctcggcatcgaggtgcggtttaccagcaaagacgagcgccccgaggaattcgccgcgctgatcgacgagcgcacgcgggccgtatatctggaaaccatcggcaacccggcgctgaacattcccgatttcgagggcgtggcgaaagtcgcgcacgagcacggcgtcgcggtggtcgtggacaacaccttcggggccggcggatactactgccagccgctgcggcacggcgccaacatcgtgctgcactcggcgagcaagtggatcggcgggcacggcaacggcatcggcggggtcatcgtggacggcgggaacttcgactggggcagcgggcggtatccgctgatgaccgagccctcgccgagttatcacgggctgaagttctgggagacgttcggggaaggcaacgggctggggctgccgaacatcgccttcatcacccgcgcccgcaccgaggggctgcgcgacctgggaacgaccctggcgccgcagcaggcgtggcagtttctgcaaggccttgaaaccctgagcctgcgcgccgagcgccacgccgagaacaccctggcgctggcgcactggctcatcagccacccggacgtgaagcaggtcacttaccccggcctgagcaaccacccccactacgaccgggcgcagacctacttgccgcgcggggcgggcgcggtgctcaccttcgagctgcgcgggggccgggcggcgggcgaagcgtttattcgctcggtcaagctcgcgcagcacgtcgccaacgtgggcgacacccgcacgctggtcattcatccggcgagcaccacccacagccagctcgacgaggtgacgcagacgaacgccggggtcacgccgggcctcatccgggtgtcggtgggcatcgagcacgtagacgacatccgcgaggacttcgcgcaggccctggcgagcgctggggagcgggcgtga

SEQ ID NO: 24230 - DNA, 4641 bp, Deinococcus radiodurans
atgaaagacttcaacaaagtccgcatcgccatcgccagcccggagaagatccgcgaatggtcgttcggcgaggtcgaaaagcctgaaaccatcaactaccgcaccctgaagcccgagcgcgaaggtctgttcgacgagcgcatctttgggccgatcaaggactacgagtgcgcctgcggcaagtacaagcgccagcgatacgagggtaaggtctgcgagcgctgcggcgtcgaagtgacctccagcaaggtgcgccgctaccgcatgggtcacatcgacctcgcgacccctgccgcgcacatctggtacgtcaaggacagccccagcaagatcggcaccctgctcgacctgagcgccgggcaactcgaaaaggtgctgtacttcagctcctttatcgtgaccaagcctttcaacgcgcagaaagacgggcggcccctcaagcgcggcgaactgctgagcgacgacgagtaccgcgaactgcgctttgggcggcaggaaacctacaccatccccaacagcgtcgaagacgtggaaatccgcgacggcgagtacgtcacccgtggacagattctgggcggcaacgtggtgtccaagatggacggcctcgcgcagtaccgtttcccccgccgcgccgtgattgcttacagcgaaggcgtggaagccagcctgccgctgcccgccgatacgttggtcgagcaggaaaccttccgcgccggtgaaatcctggccgaactcgaacaggacgtgcagatcaccgcgccggtggccggcaccgtgttcatgcacgacctcggcgaagactcggtgatgatcgaactgcgcgaaggcgtggaagcgaacgacagcgacgaggaagaagccgccgaccccattcgcggtgaagtgctggcccgcgtgtacgtgccccacggcatgaacgtgcaggtggccgaaggcgaagtcatcgaagccggcgcgcttctggccgacgccagcgaaggcgcccgcctgcgcgtgagccgtgacagcaacctcagcggcgtgaccttccccaagaagaagggcgacgtgaccgtgaccgcgcactggacccgccgggtggagtaccccatcgaccccaccatgcacgtgctcgtcggtgacggcagcgaagtaacgaagggccagcgcgtgatcggcgcgattgacaaggaagaagaagtcatcgcggaagccgacggcgtcatcaccctgcaccagcccgccagcattctggtgagcaaggccaaggtctacgcctacgacgacgagccgctggtggtcaacggtgaccgtgtggaacccggcgacgaactcgccgacgacggcaacctgcgcagcgaaatctcgggccgcatcgaactcgacctcgtgcgtaagcaggtgcgcgtcatcgagtcctacgacttcgaagccaagatgggcgccgaagccgtcaaggaactgctcgacgaactcaacctcgacgaactcgaaaccgagctcaacgagcagatgaaggacaacagccgccacaagcgcgccaaggcccgcaagcggctggaagtcacccgctccttcaaggcgagcggcaacaacccctcgtggatgattctcggcaccgtgccggtgatgccaccagacctgcgcccgatggtgcaggtggacggcgggcgctttgcgacttccgacctcaacgacctgtaccgccgcctgatcaaccgcaacaaccgcctcaagaagctgatgagccagggtgcgcccgacatgatcatccgcaacgaaaagcgcatgttgcaagaagcggtggacgccctgatcgacaacggtcgccgcggcagccccgtgaccaaccccggcagtgaccgcagcctgcgctcgctgaccgacctgctcggcggcaagcagggccgcttccgccagaacctgctcggcaagcgtgtggactactcgggccgctcggtcatcgtggtcggcccgcagctcaagctgcaccagtgtggggtgcccaagcgcatggcgctcgaactcttcaagcccttcttgttcaaggtgctcgaagagaagggcgaagtcaccaacatcaagcaggcccgcaagatgctcgaacgctaccgcgacacccgcgacagcgtgtgggacgccctcgaagaagtgatcgaggacaaggtcgtgctgctcaaccgcgcgccgacgctgcaccgtctgggcattcaggcgttcgagccggtgctggtcgaaggccagagcatccagctgcacccgctcgtctgtgaagcctttaacgccgacttcgacggcgaccagatggcgattcacgtcccgctctcggcgcaggcgcaggccgaagcccgcattcagatgctggcctcgcacaacctgctctcccccgccaacggcgagccgaacgtcaagcccagccgcgacatcatcctcggcatcttcaccctgacccagctgcggcgcgacaaccttggcgcgggcaccgagtacgccagcgaagccgacgcgctcgcggccttcgacgaaggcaagctcagcctcaacagcccggtcatggtcaacggcgttgagaccagccccggtcgcctgcgctacaccttctccaaccccgacgaagcgctccacgccgtcgaacagggcgagatcgaccaccaggaccacgtgcggattcgtctgaacggtcaggtgtacgaaaccagcgccgggcgcgtgcagttccgccgcatggtgcaagaagcgctgggcgctcagggcggcctgatcgacaccctggtcgacctcgaaaccacctacgagaaggacgccctcaaggacatggtcatggcgtgcttcaagcacctcggcattgaagcgaccgccgggctgctcgacggcctcaaggaaggcggcttcaagctgtcgaccacctcgggcatcaccatcggcatcgacgacatcgtgctgccgcccaacaagggtgaactgctggccgaagccgaccagatgctcgccgagatcgagcagaacttcgagttcggcttcatgaccgaggaagagcgctacaagcaggtcgtgcagctgtggaacaacaccaccgacgccgtgaaggacgccgtgttcgagaacttctcgaagaactaccccttcaacccgctgtggatcatgagccagtcgggggcgcgcgggaacccgcagcagattcgtcagcttgctgggatgcgcggcctgatggcccgcccggacggctcgaccatcgaagtgccgattcgcgccagcttccgcgaaggcctgaccgtgctggagtacttcatctccacccacggcgcccgtaagggtggggccgacaccgcgctgcgtaccgccgactcgggctacctgacccgcaagctggtggacgtggcccacgaagtcgtcgtgcgtgacgtggactgcggcagcaccgactccaccgtgatgccgctgggtgcgaccgacgagcgcaccggcgaatggcgcagccgcaagggcagcgaaatcgaaaccagcatctatggccgcaccctgaccgccgacgttgagttcagcgacgggcgcgtgattcccgaaggcgaaatgctctcgatggaagatgtgaaggcgattgccaaggacgccaagcacatcggcgaagtgtttgtccgcacgccactcaactgccgcgtcaaggcgggcgtgtgccagaagtgctacggctacgacctctcgcaagccaagcccgtgagcatgggcgaagcggtgggcgtggtggccgccgaatccatcggcgaacccggcacgcagctcaccatgcgcaccttccacaccggcgggatcgcgggcggcggcgacatcacgatgggtctgccccgcgtgatcgagctgttcgaagcgcgcaagcccaagacccaggccgtggtcgccgaccgcgatggcgtgatccgcattgaagaggaagaagagcgttacctcgtgcgtatcgaagccgacgacgagcagtactcctccaagaccgccaccaaggtgccccgcgtgctgcgcatgacggtcaaggacggcgagcgcgtagaagccgggcagccgatcacccgcggcgcggtcaacccgcacgacctgctgatgtacaaggacaccgacgccgcccagcgctacctggtggaagaagtgcagcgcgtgtaccgctcgcagggcgtgaaggtccacgacaagcacatcgaagtgatcgtgcgccagatgctgcgctgggtcgaagtgactgacggcggcgacaccacgctgctcgaagggcagaccgtggagcactgggaagtcgatcaggccaacgaggcgctggcagaaggccagacccccgcgagctggaagccggtgctgctcggcatcaccaagagcagcctgaccaccaagtcgtggctctccgccgcctccttccagcacaccacccacgtgctgaccgaagcctccatgcgcggccaggtcgacgacctgatcggcctgaaggaaaacgtcatcctcggcaagctgattccggcgggcaccggcctgctgacggtccgcgaaatgcaggtggccgacgaccgcaccctcgagaagtacggcgaaggcagcacctcctccgacgccgtgaccggcgggcagcggtacgacgacacccgccccggcagcagcatcaaccccggctacggcgactga

SEQ ID NO: 24231 - DNA, 3540 bp, Deinococcus radiodurans
ttgcgcttttggacctggacgagagccgcagccccgagatttccagcgtgcgaggtgtgcatgaccctgagtaagactcccccccgcatcgagcggttcggtgacatcaccgaagtgattccgctccccaacctgaccgaagtgcaggtcaactctttcaaagcctttttgcaagacgacaaggcccccgaccagcgcgaagacgtggggttgcaaagtgctttccgcgaggtctttcccatcgacgagtccgaaaagggccgctcgacgggcatggtgctcgactttatcgagtatcgcctcggtgaacccgagtacagccccgaggagtgccgcgaaaaagacctgacgtatgaagcgcccctctacgtcaagctcgaactgattcacaaagacactggcgtcatcaagggcttcaagcccgacagcccgcccgaaagctgggtcttcctcggcaacctgccgctcatgaccttcgacggctcgttcatcatcaacggcgccgaccgcgtggtcatctcgcagatccaccgctcgccgggcgtgtacttcacgagctcctacaagggcatcaagaagcagtacaccgccgccatcattcccatgcccaagcgtggcccctggatcgaactcgagttcgcgggtgacgtgctggaaatgaaggtcaacaagcgcaagttccccgtctcgctgctgctgcgcgtgctgggcatggacgacgcttcgattcgtgcgctgttcaccgagttcacgcccgaagtcgaacccggcgaagacaagagcgcgggcatgggcgccgacgaagccctgctgcgcctgtttaccgtgctgcgccccggcgacccacccaagcgcgacaaggcgattcagtacctcttcgggctgctcgccgacccgcgccgctacgacctgggcgaaccgggccgcttcaagatgaacaccaagctgggcgtgcagcgtcaggaacgcaccctgctgaagttcgaagacggcaaattcagcgacgccgggctggtggacaccatccgttacctgatggcgctgcaacagggcctcgaaactgtgccgatggtggacgaagacggcgtggtgaccgacgtgcccgttgccgaagacgacatcgaccacctcggcaaccgccgcgtgcgcaccgtgggcgaactgctcgccgaccagctgcgcgtgggcatgggccgcatggcgcgtggcgtgcgtgagcgcatgctgctcggcaaccccgacgccgcgacccccaccaaactggtcaacaaccgccccatcgtggcagcgatgcgcgagttctttggccgctcgcagctctcgcagttcaaggaccagaccaacccgctctccgatctgcgccacaagcgccgcatctccgcgctggggccgggcggtctgacccgcgagcgcgccggcttcgacgtgcgcgacgtgcaccgcacccactacgggcgcatctgcccgatcgaaacgcccgaaggcgccaacatcggtctgatttcctcgctgtcgagctacgccaaagtcaacgacctcggcttcatcatggcgccctaccgcaaggtggaggacggcaaggtgaccaatcaggtcgagtacatgaccgccgatatcgaggaccgttacaccatcgcgcaggcgaacagcccgctcaacgaagacaacaccttcgccgacgagcgcgtgctggcccgccgcaagggtgacccgctgctctacacgcccgacgaagtcgattacatggacgtgtcgcccaagcagatcgtgtccatcaacacctcgctgattcccttcctggagcacgacgacgccaaccgcgcgctgatgggttcgaacatgcagtcgcaagccgtgccgcttgtgcgtgccgactcccccgccgtgggcaccggcgtcgagcgccgcgtggtgaccgactcgggcaccagcgtcgtgagcgacgtgaatggccgcgtgagctacgtggacgcccgcgccattcaggtgacgctgagcgaagaccaccgcgaactcaacatgaacgcgggcaacgtccgcacctttgagctgatccgctttacccgctccaaccagggcaccaacctcgaccagcaccccatcgtgagcgtgggtgacgaggtcaaggtcggccaggtcatcgccgacggcccggcgtccgagcgcgggcggctggcgctggggcagaacatcaccatcgccatcatgcccttcgacggcttcaacttcgaagacgccatctgcatcaacgaagacctcgtgcgtcaggacttttacacctcagtccacatcgagaaggacgagatcgaagcccgcgacaccaagctggggccggaaaagatcacccgcgatattccgggcctgtccgaagccgcgctgcgtgacctcgacgaagacggcatcgtgcgcgtgggcgccgaagtcaagcccggcgacatcctggtcggcaagacctccttcaagggcgagtccgaacccacccccgaagagcggctgctgcgctcgatcttcggtgagaaggcccgtgaagtgaaagacacctcgctgcgcgtgcagtcgggtcagggcggcatcgtcgtcaagaccgtgcgcttccgccgcggcgacgaaggcgtggacctcaagcccggcgtgcgcgagatggtgcgcgtgtacgtggcccagaagcgtcagcttcaggtgggcgacaaggtggcgaaccgccacggcaacaagggcgtcgtgtccaagattgtgcgccccgaagacatgccttacctcgaagacggcacccccgtcgacatcgtgttcaacccgctgggtgtgccttcgcgcatgaacctcgggcagattctcgaaacccacctcggtgaagtcgcgcgcctgaccggccagaagttcgagaccccggtgttcgactcggtgaccgaagcgaccatcaaggaaatgctcgaagtggccgcagccgaacgtctccaggccagaaaagacgacggcttcgaactcgacaagcgtgagcaggaagtgctcgaccgcgccggcaagctcggtgtgatcgacgcccccggcgacgactacgagaagggccagatgcagctcgcccgcaccggcaagagcatcctgtacgacggacgcaccggcgagccgatcagcggccccgtggtggtcggcatcatgtacgtgatgaagctctaccacatggtggaagacaagctgcacgcccgctccaccggcccctactcgctcattacccagcagccgctcggcggcaaggcgcagttcggcggccagcgcttcggcgaaatggaagtgtgggccctcgaagcctacggcgcggcgcacgtgctccaggaaatgctcaccatcaagtccgacgacatcgacggccgcgacgccgcttaccagagcatcgtcaagggcgaagaagtctcgggcagcaccatccccgagtccttcaaggtgctggtcaaggaactccactcgctcggtctggacgtcgaggtgctcgaccacggcgacaaggccgtggacatctttgaagggatgatgcccaagcgctaa

SEQ ID NO: 24232 - DNA, 1179 bp, Deinococcus radiodurans
atggacaactcagcacgtttccgcacgcgggccgttcacgccgggcatggtctcgacccggcgaccggggcgcacgccatgccgatctatgccacgtccaccttcgggtatggcgacgcggcgcgcgggcagcggctctttgccggagaggaacagggccacttctattcgcgcctgagcaaccccaccgtgcgggccttcgaggaaaagctcgccagcctggaaggaacagaggacgccctcgcctttgccagcggcatgggagcagcgagcgccattttgttgacgctgctgcggagcggcgatgaggtggcttttctcgccccgctgtacggcggcaccgaggggctgctgcaagacatgctgcccaagttcggcatccgggtgtgggaggccaaagacccggcggacctgcgcgggcggctgaccgaccggacgcggctggtgtggctggaaacgccgagcaaccccaccctgcgcctgaccgacctgcgcgaagtggccgacctcgcccacggcgccggggcgcggctggtggtggacaacaccttcagcaccccgtacctgacgcggcctgctgagttcggggccgacctcgtgatgcactcggccaccaagtacctcggtgggcacggcgacgtgattgggggcgtagtcgccggggacgccgccaccctgctcgacctgcggttgcacgggctgcggcatgtcggggccagcctcgggccgttcgaggcgtacctgttgctgcgcggcatgaagacgttgccgctgcggatggaggcccactgcgcgggggcgcaccttatcgccgagcgattggcggcgcggggcgacctgaaggtgtactaccccggcttgcctgagcaccccggccacgacctcgcccggcggcaaatgtcggggcgcttcggcggcatcgtcagcctggatctcggggattttgcggccgcgcagcagtttctggacgcgctacagctctttacgcaggcggtcagcctcggcgacgtggagagcctgagcagccacccggcgagcaccacccaccaactgctcggcgaggaagtgctgaacgcgcacggcatcgtgccggggctggtgcggttgtcggtggggattgaggaccccgaagacctctgggcggacatcgagcaggcgctgaggcaggcgcggcgctga

SEQ ID NO: 24233 - DNA, 1146 bp, Deinococcus radiodurans
atggatttcaatttgcctgatgacctgcgcgaagtgcaggcgaccatccgtgacttcatgctgacccgcgtggaggaccgcgcccaagaaatcgagcacaccaacagcgttccgcccgaactcatcaaggaagccgccgacctcggcctctttgggctgagcattcccgaggagtacggcggcgtgggcctgagcagtctgggccgctgcgccgtgtacgaggcgatggggcaggggcacatgggctttggcggcatgatttcggcgcacgccagcattggtacgagcgggctggtcaagctcggcaacgaggagcaaaagcagcgtttcttgccgcgcatggcggcgggcgagtgcatcgcgggctttgcgattaccgagccgagcagcggcagcgacgcgggcaacatccgcaccaaggccgtcaagaaaggcgacgtgtacgtgctcaacggcaccaagcactacatctccaacgcgccgattgctgggctgctcaccgtcatcgccatcaccgatccggcgcagggctcgcgcggcatgagcgccttcctcgtcgaaccgcagagcacccccggcgtgagcatcggcaagatcgacgagaagatgggccagaagggcgcactctccgccgaagtcatcttcgaggacgccgagattcccgccgccaacctgctggggccggaaaaccggggctaccgcgaggcgctcggcatcctgacgaacgggcgcgtgggcatcgccgcccgctcgaccggagccatgcagcgcctgctcgacctgtcggtggcgcacgcccagacccgcgagcagttcggcaagccgattgccgagttccaggcggtgcagttcatgctggccgagatggaagtcgccatccagaccagccgggtgctgtggcaaaaggtcgcctggatggtggaccagggccaggatgtcaagcgcatggcgagcgtcgccaagtaccacgccaccgagatgctctcgcaggtggccgacaaggccgtgcaggtcgcgggcggcatgggctacgtcaaggacgctcctttcgagcgcttctaccgcgaccagcgcctgctgcgcatctacgaaggcaccagcgaaatccagaaggtcatcatcgccgccgaactgctcaggcgctga

SEQ ID NO: 24234 - DNA, 963 bp, Deinococcus radiodurans
gtgcccgacgctgccttcgagacccggatgcgcgaggtgctgcgctcggacgtggaattcatcgccatcatcggggaagacctcgtcacggcgggcggcaaacgggtgcgcccgctggtcacgctgctcgcggcgcaggccctgggtgccggccccgacgcgctggccacgtctcacagctgggacgaactgctgcgcctgagcgtgtgcgtggaactgctgcactcggccagcctgctgcacgacgacctgatcgacgactccgacaaacgccggggtcaggaaacggccttccggcgcttcggcaacgtggtcagcgtgatgagcggcgacttcatgctggcgcggcttctcggcgaactctcggggatgcccggcagcccggcgctcacccgcgccttcgggcaggcggcgagcgtgatttgcgagggcgaagtcttgcagtttcaggtcgcgtcctacgccgattattccttcgagaactactttcaggtcattcacggcaagacggcggcgctgctcgaactcgcggcgcaggccccggccatgctgctcggtgccgacgacagcgcccgcgacgcgctctcgactttcgggcgcgagtacggcatggcctttcaaatgcaagacgacctgctcgacctgctcggcgaggaggcgcaaatcggcaagccggtgggcggcgacctgcgtgagggcaaggcgacctacccggtgctgtgcctgctcggcggcccgcacgacgccgaggtgcgcgccatcctcgaacgccgcgccggggaagacggcgacgtggcgcggatgattgcgctggcccgtcaggagcgcaccgacgactgcacccgcgaggagattcgccgccgcgcccgcctcgccatcgctgcgctggacgcgctgccgccctcaccggcccgcacggcgctggccgcgctggccgaacgcgaactgaaccgcacccattga

SEQ ID NO: 24235 - DNA, 795 bp, Deinococcus radiodurans
atgacccagatccagactcccgttacttcctccagcgtcgttcagagcggcgcgaccccgctggctccggcggacgtgccgatgctgccactgaaagtcaaggtcctgcgcttcaaccccgagcaggacaagaagggccgctgggtgacctacgacatcgaggcgcagcccggcgaccgcctggtggacgtgctcaacgaaatcaagtggtaccacgagcccagcctcaccttccgccgctcgtgccagcacggcatctgcggctcggacgcaatgatgatcaacgggcgcaaccgccttgcctgcaagaccctggtgcgcgacctcgtgaagggctcgggcggcgagatcaccgtcgagccgattcgtggcctcaaggtcgagcgtgacctgctcgtggacatggagccctttttcgatgcgtaccgggcgatcatgccctacttcatcaacgaagacccggccccggcgggcgagcgcctccagagcgaagcgcaggccgagcgcatggcgcactccagcaactgcatcctgtgcgcgtgctgcaccacgtcctgccccatcttctgggtgaacggctcgtacctcgggcctgccgccatcgtgcaggcgcaccgcttcatcttcgacagccgcgaccaggccacccagcagcggctgaacatcatgaaccagaacaccggcgtgtggcgctgccgcaccgcctacaactgcaccgaagcgtgcccgcgtgaaattccgatcacctcgctgatcgaggaagtcaagcgcgcggtgatgttccagcaggcctga

SEQ ID NO: 24236 - DNA, 1752 bp, Deinococcus radiodurans
atgcatcatcgttatgacgtgatcgtcgtaggggcaggcggcgccgggctgatgtcggcgctgtacgcggccaagggcggcgtctccgtcgcctgcatttccaagctctatcccacgcgctcgcacactggcgcggcgcagggcgggatcggcgcggcgctcggcaacatccaggaagaccactgggaatggcacatgttcgataccatcaaggggggcgattacctgaccgaccaggacgccgccgaggtgttcagtaaggacatcatcgaagtggtctacgagctcgagcacatgggcctgcccttctcgcgcacgcccgaaggcaaaatcgcgcagcgcaagttcggcggccacacccgcgacttcggcaaggccgccgtggagcgctcgtgctacgccaaggaccgcaccggccacatgatccttcagaccctgtaccaacagaacgtgaaggccgggacactgtttttcaacgagttccacgtcaccgacctgattatcgaagacgggcgctgccgcggcgtggttgcctatgacctcgcgaccggcgagctgcacaccttccatgccaaggccgtgattctggcggcgggcggctacgggcgcgtgttcaagatcacctccaacgccctgacgctgaccggcgacctgatgagcatctactaccgcaagggcctgcccctgcaggacatggagttctaccagttccaccccaccgggctggccaaactgggcattctggtcacggaaggcattcgcggcgaaggcggcatcctacgcaactccaacggcgaacgcttcatggaacgctacgcgccgaccatcaaggacctcgcgccgcgtgacatcgtggcccgttccatgaccaccgaaatccgcgaagggcgcggcgtgggcaaagacaaggacgcgatccatatcgacctgacccacctgccgcgcgaagtgatcgagggcaagctcgccgagatcaccgacctcgcgcgcacttacctgggccaggacccggtcaaggacctcgtgatggtgcagccgaccgcgcactacgcgatgggcgggattcccaccgacctcaacgggctgtgcctcagcgacggcaacggcggctctatcgaggggctgtacgcggcgggcgagcaggcctgcgtgtcgctgcacggcgccaaccgcctgggcaccaacagcctgggtgacctcgtggtgttcggtcgccgcgccgggcgctacgccgccgagtacgccaagcaggtcgagtacgccgagatgcccgaaaacgccgaggccgaaagccggcgcgtgttcgacgatctgcgcgcggccagcggcaaggacaacgccgccgccatccgcaaggagctgcaggaaacgatgatgcgcaacgtgggcatcttccgcaacggccccgacatggccaagcaggtcgagatcatcaaggaactcaagacccgctacaagaacgtcggcgtgtcggacaccaacgcccgctacaactccgaactggtggaggcgctcgaactcgggttcatgctcgactgcgccgaagcgatggcgagcagcgccgtgaaccgcaccgagtcacgcggggcccacgaccgcgaggacttccatcagcgcgacgacgtgaactggctcaagcacaccatggcctaccgggacatgaacaaccccggcaacgtgctgatcggctacaaggacgtggccctcaagggcttcacgcgctccttcgagcccaagccccgcgtctactga

SEQ ID NO: 24237 - DNA, 1251 bp, Deinococcus radiodurans
gtgcacctgagaaatgccgccgaccaagcgccatcactgccatttgcccagtgccaacgtcaactccccttgcccctctggggtaaggggctgggggatggggcaaaaagctcaagcctgggcttcaatgccatacacagctcccgcccacgctccctagacccacccccccaccaacccccgccacccactacactcctccccatgagcaccgagaaaaagaccgtcgccatcgtgggcggcagcggctacgcgggcggcgaattcctgcgcctcgccctgggccacccccacctcgaagtgacgcaggtgaccagcgaacgcagcgccaaactccccgtgagcatggtgcaccccaacctgcgtggggcgaccaacctcaagttccgcaaggccgccgaactcgaagaggccgacatcatcgtgctggcgctgccgcacaactcggcggcgaagcggattaccgaattcgaggcgaaggggaaggtcatcgtggacctctccgccgactttcgcctgaaagatcccgaggtctacgagcgcttctacggcgagccgcacccagcccccgagcagctcgggcagtgggtctacggcaaccccgaacttcaccgcgaggacctgcggggtgccacccgcatcgcctgcgcgggctgctttgccacgtcggtgattctggcgctctacccgctgctgaggctcggagcgctcgcccccaaggacatcatcgccaccgggctggtcggctcaagcgcggcgggcgcgagtgcctccgaatcgtcgcaccaccccgagcgggcgggcagcttacgcgtctacaagcccgtcggccaccgccacaccgccgaggcgcagcaggagcttcccggcaagtttccgctgcacctcaccgccatttccaccccccgcgtgcgcggcatcctgaccaccattcaggcgtgggtgcccgacggctggtccgacaaggacgtgtggagcgcctaccgcgaggtctacggccaggagccgtttatccgcatcgtcaaggtcgccaagggcattcaccgttaccccgaccccatgctgctcgacggcaccaacttctgcgacatcggcttcgagatggacgtggacaccgggcgcgtggtgctgatgtcggccatcgacaacctcgtcaagggcacggcggggcacgccattcagtcgctcaatgtcgcgcagggctgggacgaacgcgccgggctgggcttcctggggctgcacccgacctga

SEQ ID NO: 24238 - DNA, 1590 bp, Deinococcus radiodurans
atgagcggcacagaattcattgtcgtcggcgccgggtcgggcggctgcgcggcggcggcgcggctgcgggaggccgggcggcgggtgcacctgctcgaagcgggcggccccgacacccacccccacatccagattccggtggcgttcgggcggctgttcggcagcgaggtggactgggcgtaccagaccgagccgcaagcggaactgaacgggcggcggctgttctggccgcgcggcaaggtgctgggcggcagcagctccatcaacgccatgatctacattcgcgggcaccgcgccgactacgacggctgggcagcggcgggcaaccggggctggagctacgacgaggtgctgccgtacttcaaacgcagcgaggacttcgaggacggccccgacgcctttcacggcgcgggcggcccgctgcatgtggagcatcgccgctacacccaccccatctgcgacgcgctgaccgacggctttgccgaactcggttatccacgcaacgacgacttcaacgcggcgcagcaagaaggcttcgggcgctatcaggtcaccatgaagggcggcgagcgccattccacggcagcggcctacctgcggcctgcgctggcgctggaggggccgggcgagttgcaggtcacgaccggcgcccacgtcacccgcctgctgctgcgcgggggccgggcggtgggggtcgcctaccgcgacgaagcgggcgcggaacacgaactgcacgcggaaggcggcgtcatcctgacggcgggcgccgtgacgagtccgcacctgctgctgctctcgggcatcggcccggcggacgaactgcgagcagcgggcgtggaggtgcagtgcgacctaccgggtgtggggcagaacctgcaagaccatctgattgtcccggtggtgttcgaaaccgacacgccgggcctgcgcagccccctgcgcgaaccgcacctcagcgagtacgagcaggaacggcgcggcctgctggtgagcaacgtggccgagacgggcggcttcctgcggacctcgccggacctcgccgccccggacctgcaatttcaccacggcgcagcgctcttcctggaatttggcaagccgctggcgcgtgggcaccacttcacgctgctgcccacgctgctgcaaccgcacagccggggccagattcggctggcgagcgccgacccgctggcgcggcctctcatcgagccgaattacctttcggactcgcgtgacctcgacgtgctgctgcgcggcatcgaactggcgcgggaagtggcggatacggcggcgctcacctcttaccgccgggccgagttcctgccgggcgcgggggccacagaccgcgccgccctgaccgagcatgtgcgcgagcacgccatgaccatctaccacccggtcggcacctgccgcatgggccacgacgacttcgcggtggtgggcgacgacctgcgggtgcgcggcgtggacggcctgtggattgccgacgcgagcgtaatgcccaccgttccgcgcggcaacacgaacgccccgaccatcatggtggcggaaaaggccgccgacctgattctggggcgggcggcgccggtctga

SEQ ID NO: 24239 - DNA, 1473 bp, Deinococcus radiodurans
gtgttggaagcggttcctgcggcactatctcggagtctaaccacagccgtgacttctcttttcggaggccttatgaccactgctcaacccgatgctcaacccggcgcccagccgattgccgacctgggcctcaagcccggccaactgcacctcaaccctggtgtggacgacctctacgcccacgccattcgcctcggtgaaggagtgcaggccgccactggcccgctgaccgtacggaccaacaagacgggccgcagccccaaagaccgcttcatcgtcgaagacgaccagacccgggaaaccgtgtggtgggaaggcttcaaccagccgatcagcgccgaagtctttgaccgactgctggacaagatggtgaagtacgccgagggccgggaactgtttgtgcagcaggtcttcgccggcaccgatgccgagcaccgcatccccgtgcggatgatcaccgaaatggcgtaccactcgctgtttatccgcaacatgttcgtgcgccccaccgccgaggaactccagaacttccaggccgagtggacggtgctcaacatcccgtcgttcaaggccgacccggcggtggacggcacccgcaccgacacctttatcctggtcaacttcagcaagaagatgatcatcgcgggcggcacccagtacgccggcgagaacaagaagggcatcttcggcgtcctgaactacctgctgcccgccaagggcatcatgccgatgcattgctcggccaacgtgggcgaggacggcgacgtggcgctgttcttcggcctgagcggcaccggcaagaccaccctgagcgccgaccccggccgcaagttgatcggtgatgacgagcacggctggaccgacaccggcgtcttcaacttcgagggcggctgctacgccaaggtcatcaacctgagcgccgaggccgagcccgctatttaccagaccacccgcaactacggcaccgtgctggaaaacgtggtgctcgacgagagcggcacccccgacctcgacgacggctcgctgactgaaaacacccgcagcgcctaccccatcgagcagatcgccaacatccagcccggcagcgtgggcggcattcccaagaacgtggtgttcctgaccgccgacgcgttcggcgtgttgcccccgctttcgcgcctgacccccgagcagatgatgtaccagttcatctcgggcttcaccgccaagattcctggcaccgaagaaggcgtgactgaccccaccccgaccttcagcacctgcttcggcgcgcccttcatgccccgtcaccccggcgaatatgcccggctcctggcgcagaaggtcgaagaaagcggcgcgaaggtgtggctcgtcaacaccggctggaccggcggcaagtacggcgaaggccaccgcatgagcttgaacctcacacgactaaagtcgcgtgattctcacttcgcagaccattgcccgccgaagcaggtctga

SEQ ID NO: 24240 - DNA, 1179 bp, Deinococcus radiodurans
  unsure (1)..(1179): unsure at all n locations
atgactgaagtcacgagtgtgcgcccctcaagcatcaagaacgccgccgtcaacctgccctacggcggcggcaagggcggcatccgcattgacccgcgcaagtacagccagggcgaactcgagcgcgtcacccgccgctacaccaccgaaatcggcctgattatcgggccggaaaaggacatccccgcgcccgacgtgaacactggcccgcagacgatggcctggatgatggacacctactccatgaacgtgggccgcaccgcgacgggcgtggtgaccggcaagccggtgtcgctcggtggctcgctgggccgcgccgacgccaccggacgcggcgtgttcgtgaccggcgccgaggcgatgaaaaagctcgggatgccgctcgaaggcgcccgcatcgctgtgcagggcttcggcaatgtgggtgaggccgccgcccgcatcttccaccagcacggcgccaagatcgttgccattcaggacgtgaccggcaccattcacagcgcggcgggcatcgaccccggcaaggcgctcgcgcacctgcggcagaccggcaagatcaccgggctcgaaggcagcgaggaaatgcagaaggacgacttctggagcgtggactgcgacgtgctgattccggcggcgctcgaaaagcagatcaccctgcaaaacgccgacaagatcagggcgcggctcgtcgtcgagggcgccaacggccccaccattcccgccgccgacgacctgctggcgcaaaagggcgtgaccgtggtgcccgacgtgctcgccaacgcgggcggcgtgagcgtgtcgtacttcgagtgggtgcaggacttctccagcttcttctggaccgaagatgaaatcaacgagcgcctcgaccgcatcatgcgcgaagccttccagagcctctgggacgtgaaggaacagcacggcgtaacgctgcggacggcggtgtacatcgtcgcctgtacccgcgtcctcgaagcgcgggcgtgcgcgggctgtatccgtaaatccacacgcgaaaagggccgcttcctcgacggggcggccctttttgttggttgctggggtgcgttcaggacattcgacagaaaaagacaccctccncccytgttcgcaaggccctctcccatcaaggtaaagggtcaaagacagaacagatcattctgtcaaatgctctaa

SEQ ID NO: 24241 - DNA, 1131 bp, Deinococcus radiodurans
gtgtcgggcggcttccctacactgctgcctatgacccagcaacgcagcatcgacgacctccgcgccgaggtggaccagatcaaccgcgacctgctcgcgctgatttcgcgccggggtgaagtggtggcgcaaatcggccacgccaagagcgccgagggccgccccaaccactacgaccccgcccgcgaggagcagcagctcaaggaactcgagaagatcaaccccggtcccttccccaccgctacggtcaagggcattttcaaggagattttccgggcgagcctcgcgctcgaggagagcaacgacaagaagcagctgctcgtctcgcgcaaggtcaagcgcgaagacaccgtgctcgatatcgacggcgtgcgaatcggtgggggcgaggcgcccatcgtcatcgccgggccctgctccatcgagtccgaggagcagatggagcagaccgccgctttcttgcagggcaagggcgtcaagattctgcgcggcggcgcctacaagccgcgcaccagcccctacggctttcagggcatgggcgtggacggcctgattctgggcagccgggtcgccaaggagcacgggcaactgttcgtgaccgaggtgatggacacccgcgacgtggacgtggtgagcgagtacgccgacatcctgcaaatcggcgcgcgcaacatgcacaactttgccctgctgcgcgaggtgggccgcgcccggcgcccggtgctgctcaagcgtgggctgtcggccaccattgaggaatggctctacgccgccgaatacatcctctcggaaggcaacaacgaagtcattctgtgcgagcgcggcatccgtacctacgagaagtggacccgcaacacgctcgacctctcggcggtggccctcgccaagcaggaaacccacctgccggtcatcgtggacgtgacccacgctgccgggcgccgcgacctgctgattccgctcgccaaggccgccatcgcggtgggcgccgacggcatccacgttgaagtgcaccccaaccccgccaccgcgctcagcgacaacgagcagcaactcgacttcgccggctacgagaagttcctcgaaggcgtgggcagcctgctgcaagccccggcggtgccggccacggcctga

SEQ ID NO: 24242 - DNA, 1569 bp, Deinococcus radiodurans
atgactcaaggttctgttgtcgatccccgtccggcccaggtgcgggccgccctcgccccccaggaatgggacgtcatcgtcgtggggggcggcgcgtccggtctgggcagcgccgtcgaagcggccacgcgcggccacagcgtgctgctgctcgaaggtcacgactacgccaagggcaccagcagccgctcgaccaagctggtgcatggcggcgtgcgttacctcgcccagggcaacgtgtcgctggtgcgcgaggcgctgcacgaacgcggcctgctgcgcaagaacgccccgcacctcgtgcgtgacctcggcttcgtggtgcccgcctacgactggtgggccgcgcccttctacggcatcggcctgaagatgtacgacgtgctggcgggcaagctcaacctgggcagctcgacttacctggaccgcgacaaggtgctgtcgcgcgtctccacctacaaggaaaagggcctgcgcggcggcatcctctacttcgacggtcagttcgacgacgcccgccttgccgtgaccctgctgcgcaccctcgaagatttcggcggcgtggccctgaactacgccccggtcatcggcctgatcaaggacggcgaacaggtgcgcggcgtgcgcttccgtgacgaggaaagtgggcaggaacacgaggcccgcgccaaaatcgtggtcaacgcgaccggcgtgtgggtggacgacatccgccgcatggaagaccccaccgtcaagccgatgctctcgccgagccagggcgtgcacgtcgtcgtcgagaagaagttcctgccgggcgacagcgccatcatgattccccgcaccgacgacgggcgcgtgctgttcgcggtgccctggcatgaccacgtggtcatcggcaccaccgacaccccggtgccgcaggccgacttcgagccgcacgcactggaagaagaagtcgagttcatcctgcgcaccgctgggcgctacatggaccccgcgcctggccgcgccgacgtgctgagcgtctacgccgggctgcgtccgctggtcaagaacgagaagtccgacggcgccggctccacggcggccctctcgcgtgaccacgtcattcgcatttccaagggcaacctgatcaccctgaccggcggcaagtggaccacctaccgccgcatgggcgaagacaccatcaaccgcgccgaaaaactcggcgggctgcccgagcgcctgaccatcacccccggcctgcacctgcacggctggagcgaggatgagcgccctgaccactggaaggtctatggcaacgacgccgagcgcgtgcagcagctccccggcgccgacgcacagctccaccccgacctgccttatagcgaggccgaactgcgctgggccgtgcgccacgaaagtgcccgcaccgtcgaggacgtgctggcccgccgcacccgctcgatcctgctcggcgcccgcgccagcatggaagcggccccccgcgccgccgccatcctcgctgaggaactgggcaaggacgccgcgtggcaagcgcagcaggtcgaagcgtaccggcaagtcgccagcggctacgtgctgtaa

SEQ ID NO: 24243 - DNA, 1968 bp, Deinococcus radiodurans
atgacccgccgcgcccccgttcgccgcttctccggacgctggagcagccgaagtggttcctggaaagccggcctgctgaccctgcatctgctgacgctgcctgtactggtgcagggcacggcggcggcgaccacagcgcatgtcacggccagcgccaacgcaccgaccacgcctgccccgcagccgccgacctggaccccgaacaaaggcaacccccggctgatgccggaaaactacaccgtcaaccgctttttcgccgacctgcaagccggcaaggtggagcgggtcaaactcgacggtgcgggcaacacccaggtctttttcaaagaaccggcaggcggccccaacccgcgctggctgctgctcccgcccgacgccgccaccctggcccggctgcgcggcagcggcgtcaccatgcaggtcacgccgggcggctcgcgcttcgcatggctggggcaagcgctcccgctggtgctgaccgcgttgattctggcggtgctgtggcgctcgctcagaggcaacggcggaggcggcgccagctcgtttgccaagtcgaaagcggcgattatcagcgaggggcaaattaagctcaccttcgcggacgtggccggctgcgatgaggccaagcaggacctgcaagaagtcgtggacttcctccgccagccggagaaataccatcaactcggggcacggattccacatggggttcttttggtgggcccgcctgggtcggggaaaactttgctcgcgaaggctgtcgcgggggaagccaaagttccctacttctccatctccggctccgacttcgtggaaatgttcgtcggggtcggtgccgcccgcgtccgtgacctgttcgagcaagcccgcaaatcttctccttgcatcgtcttcattgacgaaattgacgcggtgggccgcaaacgcggtatgaacatacaaggtggcaatgacgagcgcgaacagacgctcaaccaattgcttgtcgaaatggacggcttcgggagcgggcaggatgtcattatccttgcggcgacgaacagacctgatgttctggatgccgccttgctcaggcccggacgatttgaccgacaagtcgtggtggacgcgccggacgtgcgaggacgggagcagattctgcggattcactcgcgcaagaaaccgctcgacgtgtcggtggacctcggggtgattgcccgtcggacggcgggaatggtgggggccgacctcgaaaacctgctgaatgaggcggcattgctggccgcccgtgaaggtcgcaaccgcattacggggcgcgatgtagacgaagcgcgcgaccgggtgctgatgggaccagaacgccgcagcatggtcgtgcgtgaggctgaccgcaaagtcaccgcctaccatgaggttgggcacgcgctcgcggctcagctgctccccaacgcccaccgggtggccaagttgacggtggtgccgcgtggccgggccgccgggtacatgctgcccgatgccgacgaccgactgcacgtcacccgcgccgcgctggaggacatgatcgcggtggcgctcgccgggcgggccgccgaggaagtggtctacggcgaggtgacgacgggcgcccagaacgactttcagcaggcgacaggactcgcacggcgcatggtcaccgagtgggggatgtccgggcgcatcggcaaggtggcgctggcgtcggatgagggcaattacctcggcggcgggccgcagccgttgccgaccagcgagcacacatcacaggtggtggacgaggaagttcgcgccctgatcgacgccgcttatgcccgcgtgctggcgctgctgcgcgagtatctgccgcaggtgcatcagatcgtgacggtcctgatgcagcgtgagacgctgagcggcgaggagtttgccaccctgctcgcaggaggcagcctggaaccgctgcctcctgtaggacaagtcgcgctggctccggcctaa

SEQ ID NO: 24244 - DNA, 1365 bp, Deinococcus radiodurans
atggaccccgccgccctcgccgccctgcaaacccgctttggagaacagctttcgacggcccacgccgtgcgtgaggcgcacgcccgcgacgagagccgcatggattaccacctgcccgacgccgtgctgcatgttcagagtgagcaagacgtggtggacgcgctgcgtatagcgggtgaatatctattccccatcgtgccgttttcggtgggcagcagcctggaagggcaggtcatcccggtacgcgggggactgacgctgaacctgctcgggatgaaccgcgtccttgccatcgaaccgggcggctttcaggcgacggtgcagccaggcgtgacctaccccgaactcaaccggcaggcgcggagacacggcctcttttttccggtggaccccggcgcagaggcgagtctgggcggcatggcgtccaccaacgcgagcggcaccggcgcggtgaaatacggcaccactcgcgacaacgtgctggaaatgcgggtggcgctgcccggtgggcgcgtcgtccgggtgggcagcaaggcccgcaagacgagcgccgggtacgacctcaaaaatctcttcatcggcgcggagggcacgctgggcgtcatcaccgagctgacggtgaggctctggccgctgcccgccgaggtggtggtgctgcgctgcaacttcgggacggtggccgaagcggcggcctgcgcggtgacggtcatgggcgcggcgctgcaacccgagcggctcgaactcatcgacgagcacgagattcacgcggtgaacgtgcaactcgagcgcgactaccccgagcggcccacgctgtggatcgaactcgcctcccccagccgcgccgccctggaagaatcgctctctgtgtgcagtgacctgtgccgcgacgcgggcgggcaggacctcgccgtcgccacgagcgccgaggaacgcgccgccgtgtgggaggcccgccacaaggcgtattcctcgatggtggcgatgtatccgggccacgtcaacctcagcaccgacgtgtgcgtgccgctgcaccgcctgcccgcagtcgtggcggccacccgcgccaagtgcgacgagcgcggcctgaatgccagctttgtgggacacgtcggcgacggcaatttccacgtcctgttccacgcggcccccgacgaccgggcgacctgggacgccatccacgccacctacgacgagatgatgacgctgacccttgcggcgggcggcacctgttcgggcgaacacggcatcgggctgcacaagcagaagtatctggcgcaggagcgcgccgacacgctggaactgatgcgcgaggtcaaggcgctgttcgacccgcaggggctgctcaatccagggaagattttttaa

SEQ ID NO: 24245 - DNA, 2628 bp, Deinococcus radiodurans
ttgacaataggacactcaagtttcagaatgagggcagttaaaccatgcccccactctggaggttttcctttgaatcctgaacgctttaccgaggcgagtgccgtcgccatcaatgcggcgcagcaactcgcgcaagagaaccacaaccaaaacctgacgcacttccatgtgctgcgaaccctgctcgacaacgacaccgcttcccgcgccctgacgctggcgggcggcgacctgaacacggccagagccgcgctggacgccgaaatcgccaagctgcccaaagtgcagggcagcgacggccagctttacctcgacccggcgctcaaccgcgcgtttcagaaggccgacacgctcgccgcgcaactcggcgacagtttcgtggccgccgatacgctgctgctggcgctgcggggcgagtaccggggccggggcctgcccgacgaagtgagcctgaaccgcgccgtgaccgagcagcgcaaggggaaaaccgtgaccaacaaaaccagtgaacagcaattcgacgcgctgaacaaatacggcaccgacctgacccagcgcgcccgcgacggcaaattcgacccggtgatcggccgcgacgaggagatccgccgcgtcatgcagattctgctgcgccgcagcaaaaacaaccccgtcctgatcggcgaacccggcgtgggcaagaccgccatcgccgagggcctcgccatgcgcatcgtcaagggcgacgtgcccgagggcctgcgcgacaagaaaatcgtctcgctggaaatgggcagtctgctcgcgggcgccaagttccggggcgagttcgaggagcgcctcaagggcgtcattgacgaagtcgtgaagtcggcaggcgaaatcatcctgttcgtggacgagattcacaccatcgtcggcgcgggcaagaccgagggcagccccgacgcgggcaacatgctcaagcctgcgctggcacgtggtgaactgcacctgatcggcgcgaccacgctcgacgaataccgcgaaatcgagaaggacgcggccctcgaacggcgtttccagccggtcttcgtggacgaacccagcgtggaagacaccatttccatcctgcgcggcatcaaggagcgctatcaggtccaccacaacgtcgaaatcaccgaccctgcgctggtggccgccgcgacgctgtccaaccgttacatcaccgaccggcaactgcccgacaaggcgattgacctgatcgacgagtcggcggcccggctgcggatggcgctggaatcgagccccgagcgcatcgaccagctctcgcgccgcaagttgcaactggaaatcgagcgcgaggccctcaagcgcgagaaggacgtggattcgcaaaaccgtctgctggacatcgaaaatcagctcaagacgctgactgacgagctgaacgaagtccgcagccgctgggaagccgagcgcggtgaggtggccgccctgcgcgaaaagcgtgaaaagctcgacgcggtgcgcacccagatcgaaaaggcccggcgcgactatgatctcgaagaagccgcccggctggaatacggcgaactgcctgcgctggaaaaagacgtgcaggacctggaaaagaaactcaagtctgccgaattcgcccacatggaagtcaccgaggaagacatcgccgccgtggtcagccgctggaccggcattcccgtcagcaagctgatggaaggcgaacgcgaaaagctgctgcacctcgaagagcaactgcacgggcgcgtcatcgggcaggaccgcgcgatcgtctccgtctccgacgccattcgccgggcacgcgcgggcctcaacgaccccaaccgtccgctgggctccttcatgttcctggggccgtccggggtgggcaaaaccgagctggccaaagcgctggccgagttcctgttcgacagcagcgacgcgatggtgcgcatcgacatgtccgagtacatggagaaacatacggtggcccgcctgatcggggcccctcccggatacgtgggcttcgaggaaggcggccagctgaccgaggccgtgcgccgccgcccctacgccgtgattctcttcgacgagatcgaaaaagcgcaccccgacgtgttcaacgtgctgctgcaagtactcgacgatggtcgcctgaccgacgggcagggccgcacggtggatttccgcaacaccctgatcatcatgaccagcaacatcggttcgccgctgattctggagatgcagcagcggggcgaggacgcggagacgatcaagtcggcagtgatggacgagctgcgcggcgagttccggcccgagttcctcaaccgcgtggacgacatcatcgtgttcgacgcgctgacggcgaaggatttgcagtccatcgtggacattcagctgggcggcctgcggaggcgattggccgagcgccgcatcaccctgcacctgaccgaggacgccaaggacaagctggccgaactgggctacgaccccgcctacggcgcgcgtccgctgcggcgcaccatcagccagtacattgaaacgccgctggcccgcgagattctgggcggccagattcaggacggcagcgtgctgaacgtggattacggcgacggtggatttacctttaacagcggctctttgaactga

SEQ ID NO: 24246 - DNA, 837 bp, Deinococcus radiodurans
atgaagttcggagtcatcggagcaggacagatgggcggcggcatcgcgcaggtggcggcgcaaagcggattcgacgtggtggtccacgaccagaagcaagagtttctggaccggggcaaaggcgtcatcgaaaagagcctcggcaaactgcacgagaagggcaagctgacggacgcgcccgaaacggtgctgggccgcatccatttcaccaccgacttgcaggactttgccgactgcgacctcgtggtggaagcgattgtcgagaaccagcaaattaaaaacgacctgttcaaacagctcggccagatcgtcaagccggaaggcatcctggcgagcaacaccagctccattccgattaccgcgctggcgacggcttcgggccgcccggcgcagttcatcgggatgcacttcatgaacccggtgccgctgatgcaactcgtggaagtcattcgcggctaccagaccagcgacgaaaccgcccgcatcgtgaccgaaacggcagaaaagttgggcaagacgccgctctcgtgcaacgatttccccggcttcgtgtccaaccgcatcctgatgccgatgctcaacgaggccattcagtgcgtgatggaaggcgtggccgagcccgaagccattgacggcatcatgaaactgggcatgaatcacccgatggggccgctgacgctggcggattttatcggcctcgacacctgcctcgccatcatggaagtgctgcaccagggcctcggggacgacaaataccgcccgtctcccctgctccgcaagatggtgcaggcggggctgctcgggcgcaagagcggcgagggcttttacaagtactga

SEQ ID NO: 24247 - DNA, 1182 bp, Deinococcus radiodurans
atgtcaaaagcagtgatcgtggcggcctcgcgcacgccgacgggcaagtttctgggggcgctgactgacgtgccggcggtggaactcggcgccatcaccctgcgcgaaaccctgcggcgttcggggatgcccgccgaactggtcgaagaagtcatcatgggccaagtggtgcaggcgggctgcggccagaacccggcgcggcaggcggcgctgcgggcgggcgtgtcgcacgaagcaggcgccctgaccattaacaaagtgtgtggctctgggctgaaagctgtgatgctggcggcccagagtatccgcgcgggcgaccagcaggccgtgctggcgggcggcatggagtccatgagcaacgcaccgcacctgctgccgggcgcgcgcaagggctaccgcctggggcacgcgacggtgctggacgccaacacccacgacggcctgtggtgctccatcaacgacgagggcatgggcctgaccggcgagcgggtggccgagaagtacagcatcgggcgtgaggagcaggacgcctacgcgaccggcagccaccgcaaagccgttgccgccgcgcagggcgggctgttcaaggacgaaatcgtgccggtgacgatcaagggccgcaagggtgacgtgatcgtggacaccgacgaaggcccccgcgccgataccagcgaggaaacgcttggcaagctgaagcccgctttcaagaaagacggctcggtcacggcgggcaatgctcccggcctcaacgacggcgcggcctcgctgctggtcgtgagtgaagaactggcgcaggcgcacgagctgacgccgctggccgaaatcgtggactacgcctcgggcggcctcgcgccggaatgggtgatgatgacgccggtgccggctacccagaagctgctaaagaagatgaacatccaggccggggacgtggacctctgggaactgaacgaggccttcagcgtgcagagcctcgcggtggcgcgcgaactgggcctggacgctgagcgcgtgaacgtcaatggcggtgcggtggcgctggggcaccccatcggcgcaagcggggcgcgcatcctggtgacgctgctctccgccctcaaacagcaggataaggaactcggcgtggcgacactgtgcatgggcggcggcaacgggctggcgctggccgtgcgccgcctcgggtaa

SEQ ID NO: 24248 - DNA, 756 bp, Deinococcus radiodurans
gtggttcagacgcttagaatgcctccgatgcgctggcttccctccgttctcctgctcctcaccggtctgctgctcgcggccctcgcgctcggcgtgtttgccgtgctgggcggcagcggcccgctgtggctgcgttcgctcggcagcgtgacgctcggcggccctggcccgaacggcttcgcgcgcgggctggcgctgatgctgctggcaagcacgcgccctcgcgctggcgacgctgcgccgtccggaacccagatatttagaacccgagcccgcactggagcccgcgccgccgcagggctgaggtcgggccttaccatgtccctcatgacccctctgctgattcgggacgttctgaaggccctgccccaccgttatcccttcgtgctggtggaccgcgtgttcagcacggaaaatggcgaagtccatgcgctgaaaaacgtcaccatcaacgagccgtttttcatggggcactttcccaccgagcccgtcatgcccggcgtgctgattaccgaggcactggcgcaggcgagcatgttttgcctgcacgggcagatggaaccgggccagatcggctatctggcgggcatcgagggcgcccgcttcaagcgcaaggtgattcccggcgaccaactgcacctgcacgccaaactggaatttctgcgccggggcctgggcaaaaccacctgccgcgccgaggtagacggcgaagtggcggcggagatgcagattctgtttgcagtggcgaagggctga

SEQ ID NO: 24249 - DNA, 1236 bp, Deinococcus radiodurans
gtggctcgccaacatcgtcttcgcgctgggcggcctgtggctgctgaggcgtgcatgagcggtggggaaacggggcgcaccctgcgcgcactgttcatgtcggtgtcgctgggggccgggcacgaccaggcgcagcaggcggtcaaacaggcgttcgccgagcgcggcgtggagctgctcggcgccgagcacgactcggtggagtacctcagcacctttgagcgcagtttcacggtggacctctacgagtttgaactgcgctacgcgccgtggctctaccggggcttttactggcttaccgaccaggaccagccctggaacatcatcagccgcatgttcacctggctgggcatgggggccttcaaggacgaactgcgcgagctgcggcccgaagtcgtcatcaacagcttctgggcgcccgccgccgtgtgcgacaccctgcgcgcgcagaccgggcagcgctttctgaactgcctcatcgtcaccgactaccgggcgcacctgcactgggcgcggcgcgagaccgacctgctgatggtggcctcggaggaaacgcggcggcaaatgctggagcgcggcgtgcggcccgagcaggtggaggtgacgggcattcccatttccccggccttccgtgaggtgctcgccgccgaccgctgggcgctgcgggccgaactgttcagcgaaatgagcctgcgccccggcgtgccgctgctattgctctcgggtgggggccggggccactacgcggcggcggcggacgtgctgaccgaactcggcaacctgggccgcgcagtgcaggtgctcgtgcccgcctcgaggcagggcgaaggcaccgaaaccatcggcggggcgacggtgcatcacctcggcttccggcgcgacctgccccgcttgctggcggcctccgacctcgtggtcggcaaggcgggcggcctgacggtggccgaggcgacggctctcggcgtgccgctcgtcatctacgcgccgattcctggtcaggaagaacacaacgccgactttctggaacgccacggtgccgggctgtgggccagagcgcgccacgacgtgcgtccgctggtgctgcgcgccctcgaccccgccgaacacgcccgcctgagcgccggagcgcgggcggtgggcattcccgacgcggcagaccgggtggcgggggccatcctgcggcggctgggcgatggtctgggagatgaactgggagacagtaggggaccggcatga

SEQ ID NO: 24250 - DNA, 1389 bp, Deinococcus radiodurans
ttgactccttccaccgacatcacagacagccccgctgcgctcccgggcggcgccctctaccctgtccgcatgtccgacgccctgcccgccaccttcgatgtcatcgttcacccggcgcgggagctgcgcggcgagttgcgggcgcagccgagcaagaactacacgacgcgctatctgctcgccgccgcactcgccgagggcgaaacccgcgtggtgggcgtggcgacgagcgaggatgccgaggcgatgctgcgatgtctgcgcgactggggtgcgggcgtggaactcgtcggcgacgacgccgtgattcgcggcttcggggcgcggccccaggcgggcgtcaccctcaaccccggcaacgcgggggcggtggcccgcttcctgatgggcgtggcggcgctgacgagcggcacaactttcgtcaccgattaccccgactcgctcggcaagcggccccagggggatttgctcgaagccctggagcggctgggggcgtgggtgagcagcaacgacggacgcctccctatctctgtctccggcccggtgcgcggcggcaccgtcgaagtcagcgccgagcgcagcagccagtacgcctccgcgctgatgttcctggggccactgctgccggatggcctggaactgcggctgaccggcgacatcaagagccacgccccgctgcggcaaacgctcgacacgctgtccgacttcggcgtgcgggccacggcgagcgacgacctgcggcgcatttccattcccggcgggcaaaagtatcggcccggacgggtgctggtgcccggcgactaccccggctcggcggcgattctgacggcggcggcccttttgcccggcgaggtgcggctctccaacctgcgcgaacacgacctgcaaggcgaaaaggaggcggtgaacgtgctgcgcgagatgggcgccgacatcgtgcgggagggcgacaccctgacggtgcgcgggggccgcccgctgcacgcggtgacgcgcgacggcgacagcttcaccgatgcggtgcaggccctcaccgccgctgccgccttcgcggagggcgacacgacctgggaaaatgtcgccaccctgcgcctcaaggagtgcgaccgcatcagcgacacccgcgccgagctggagcggctgggcctgcgcgcccgcgaaacggcggacagcctcagcgtgacgggtagcgcccaccttgccgggggcatcaccgccgacgggcacggcgaccaccgcatgatcatgctgctgaccctgctggggctgcgggccgacgcgccgcttcgaattaccggggcgcaccacatccgcaagagctatccgcagtttttcgcccatctggaagcgctgggggcgcggttcgagtacgcagaagcgacagcgtaa

SEQ ID NO: 24251 - DNA, 945 bp, Deinococcus radiodurans
atgactgccgcctcctctgccggcccccgcccccggcacctgctggactttcaggactggacgcctgagcgcttagaggccgtgctcgacaacgccgataccatgctgcaagtgctcgaccgcccggtgaaaaaggtgcccgcgctgcaaggattgaccgtctgcaccgcctttttcgagaacagcacccgcacccgcacgtcctttgaactcgccgcccgccgcatgagcgccgacgtggtgagtttcgccgccgggaacagcagcgtgagcaagggcgagagcctgcgcgacaccatcgaagtgctgaccgcctacaaggtggacgcctacgtggtgcgccaccacgccgccggcgccgcgcatctggtcgccaagtacagcggcaaacccgtcatcaacgcgggggacgggcggcgggcgcaccccacgcaggcgctgctcgacgcctacaccatccggcaggaatacggctcgctggaaggcaaaaaggtcgccatcatcggggatattcggcacagccgggtcgcccgctcgaacgccgagctgctgcccaagctgggcgccgaggtcgtgttgtgcggccccgccaccctgctgccccccgacctcgccgggcaaccgggcgtgcggctgaccaccgacccgcgtgaagcggtgcgcggcgcccacgcggtgatggcgctgcggctgcaacaggagcgcatgaatggcggttacctcgccagtttgcaggagtacgccgatacctatcaggtcaacgagacgctgatgcgggaggccgagagcggcgccatcgtgctgcaccccggcccgatgaaccgtgacctggaaatcagcaccgaggccgccgacggcccgcgcagccgcattatccggcaggtcgaaaatgggcaagcagtccgcatgagcgtgctgtatcacctgctggtggggcgggcctaa

SEQ ID NO: 24252 - DNA, 552 bp, Deinococcus radiodurans
atgaccgcccccaaggccaccattctgagcagtgacgagattcgccgcgccctgacgcgcatcgcccacgagatcatcgagcgcaataaaggcgccgagaacctcgccatcatcggggtgcacacgcgcgggattccgcttgccgagcgcctggcgagcaaactcagcgaactcgaaggcgtcgaggtgccgcgcggcatgctcgacatcacgctctaccgcgacgacctctccgaagtcgcacggcagccgatcatccgcgaaacgcaggtgccgttcgacctcgcggaccgccgggtgattctggtggacgacgtgctctacaccggacgcaccgtgcgcgccgcgctcgacgccctgatcgacctggggcgtccggaagggattcaactcgctgtgctggtggaccgggggcaccgcgagctgccgattcgggccgactacgtgggcaaaaacctgcccaccgccaagcacgaggtcgtgaaggtgaagttgcaggaaaccgacggcaccgacatcgtggagttgttcgacccggaggacctgcaatga

SEQ ID NO: 24253 - DNA, 2244 bp, Deinococcus radiodurans
atgaccaaccgattcgatgaccgcgcccggctcgtctttcactacgcccgtgaagagggcaaccgtctgggccacgcgatggtcgggcccgaacatctgctgctgggcctgatgcgcgagggaggaagcgccgcgcagattctgggcgagttcggggccaccctcgactcgctgcgccgcaaggtcgaggacatcattggccgcggcgagggcagccgcctcaacgacgccccgagcatcacgccccgcgcccgccgggtgatggagctttcgggcgccgaggcccgcgccctgggctcgcagaccacctccacccagcacatcctgctcggcattattcgggagggcgacggggtggcgttccgcatcctgcaagacctcaccaaggatgtcgagacgattcgctggcgcatcctggccgaggacagcggtgagggcggcaaggcggccaagccggtgcccacgccttttctcgacgagtacgggcgcgacctgacgaagtgggcccgcgagggcaaactcgacccggtgattggccgctcggaggaaatccggcgcgtgacccagatcctgacccggcgcaccaagaacaacccggtgctgatcggcgaccccggcgtgggcaagaccgcaattgtggaaggactggcactcgccattcacgagcagcgcacgccgccctcgctgcatggggtgcggctcatcagcctggacctcagcggcgtggtcgcgggcaccaagtaccgcggtgaattcgaagagcgcctgcgccagattatcgaggaactgcggaccgctaaagtcatggccttcatcgacgagctgcacaccctggtcggggcgggcggcgcggaaggcaccctcgacgcagccaacatcctcaagccggcgctctcacgcggcgaaattcaggtgatcggcgcgactactaccggcgaatatcaccgctacatcgagaaggacgccgccctcgaacggcgcttccagccggtgatcgtgctggaacccagccccgccgagacactgcaaatcctgcgtggcctcaagcccaagtacgaggagcaccacggcgtgcagattcccgactcggcgctcgaactcgccgtgcgcatcggcgagcgcagcctgccggggcgcaacttccccgacaaggccatcgacctgatcgacgaagctgccagccgggtgcgcctgaacatgagcgtgggcctgccggtcgccgaaaacgaaagcggcgagccgatggtcacccgcgaagacatggaaagcgtcatcaactcgatgggcggtatctactccgaggaaaccggggcggcgctcatcgacctcgaagagcagctcaacgaccaggtgtacggccagcccgacgcggtcaaggccctgacgagcgccatgcgccgcgcccgggtaggcctcggcggacgcacccgcgtgtcggcctccttcctgttcgtggggccgagcggcgtaggcaagacgcacctcgccaaggcgctcgcccgcacgctgttcggcagtgaacgggcactgatccgggtggacatgtccgagtttcaggaagggcactccatctccaagctcatcgggtcgcctcccggctacgtgggcttcgagcagggcggacgcctgaccgaagccgtgcgccgccagcccttcagcgtgattttgctcgacgaaatcgagaaggcgcaccccgacatctacaacaccttcttgcaggtgctcgacgacgggcgccttaccgatgggcagggccgcacggtggatttccgccgcaccgtcatcatcatgacgagcaacaccggcttcaacgtcaatccgacggtgggcttctcccccgtcacgcccgactccaacgcgccgctgcgcaacatctttacccccgagtttctggaccgcctcgacgacgtgattcgcttcaagtcgctcggcgaggacgaactggtgcgggtggcgcagcaactgctcggcgaaatgcgcgaggaactcgccagccgcgagctgaacgtgaccttcgacccggcgattgccgcctgggtggtcggcaagctcaaggcccgctcgcccaagcacgcggtgggcagctcgcggcagctgcgtactctgctgcgtgaggaactcgaagacccgctggcgctctacctcatcggctccgacgcccgtgacttacgggtggtgctcggcgaaaacagcatcgacttcgagcaggtcgagcgctcggcgccgccgcagattctggcctga

SEQ ID NO: 24254 - DNA, 1281 bp, Deinococcus radiodurans
atgcaactgactccgctccatgtcacgggaggccgccaactgggcggcgaaatcgctgttcagcacagcaagaacgcggcactgcccatcattgtcgccaccttgctctccagtgagccgatcacgctgcacggcattccccggctctcggacgtgtacacgattctggagctgatgcatcacctcggtacccggcacgcctgggtggggcccaacagcctgacgctgcatacgccggaaattgagaacaccgacgcgccctacgccctggtcagcaagatgcgggcgagctttatcgtgctgggcgccatcttggcgcgggcgggcacggccaccgtgagcatgccgggcggctgcgcctggggaccgcgcccggtggaccaacacgtcaaagcgctgcgggcactgggggccgaggtcatcgaagacggcggcaacttcttcgcgcaccgcgagggcagcctgaacggcagcttcgtcttcgaactgctgacggtgggcggtacccacaacgcgattctggcggcggcgctgggtgaaggaacggtgacgctggaaaacgcgtccattgacactgacgtggtggacgtcatcgaattcctgaacgcgctgggcgcccgcatcgaaggggccggcaccaatacgatcaccattcatggcgtgaaggaactgcacggcggcgaatacaccgtgattcctgaccgcatcgaagcgggcaccttcatgatgctggcggcggcgacccgctcgcggctcacgctgaccaacgtgcgccccgatcacctgcgcgccgtgacaagcaagctcgctgaaatgggcgtggacattcaggaagacggtaaccgcatggtggtagacgcccgtggccgcgacctcaagccggtcaacgtgactactcagagctatcccggctttcccaccgacctgcaaccgcagatgagtgcgctgctcgccaccgtacccggcaccagcgtgattcaggacccggtctaccctgaccgcctgacccacgtggccgagctgcaccgcatgggcgccaccatcaccgtgagtgggtacacccaggtcattcagggtggcaccctgcatgccgcccctgtcaaggccgccgacctgcgcgcgggcgcagcgctgtttatcgccgggctgacctgcgaaggcgaaacggtcatcgacggcgtgcagtacctcaatcggggctacgagcgcctcgccgagcgcctgcgcggcatcggcggtgaagtcatgcagcccgagccgatgctggccgctgacgactga

SEQ ID NO: 24255 - DNA, 1389 bp, Deinococcus radiodurans
ttgagcgtaaggcggctgaggtggcgtgagggggggccgatgaccaaccctaacgcccataccctacccatcatcgtcgtcggcgcgggcatgaccggcctcgccgccgcctgggagctgcaacagaggggcgtgccgtatgtcctgctcgaagcgggagactctttcggcggcaaggtacagagcgagcgcacggaggacgaatttctggtggaaaaggccgccgacgccttcatcctcggcaagccctgggcgctgcaactcgcgcaggaagtcgggctgcaagacgaacttattcacccgcgcgcggagaccaaaaagctgtatttcctgcgcggcggcgagctgctcgactttccgcagaacctgaaaatgttcgtgccgctcgacgacgagtcgtttctgcaaagcggcgtcctctcgccggagggtctgcgccggatgctcgacgagcagaacgtgccgcccaaagaaaacaccgacgaggacgagtcgctcgccgacttcatcatccggcgcttcggggcggaggcaatgaatttcatcgtgccgctggcggctggcatttacgtcgccaatccctttgaactcagcatgaaagcagcgtttccgcagtttctcgcgctggagcagaaatatggcagcgtcatcaagggcagccgcgccacgccccgtgcccaggggccgattttcgggtcgttcaaggacggcatgtccaccctggcgaacgcggtggccgccaagctgaccggcgacgtgcggctgaatacgcccgtgctggccgttcacccggacggcgtaaccctaaccggcggcgaaaaaattgcggcaagcggcgttgttttaacggctcccgcctgggtcgccgcgccaacgctgggtcagagtttccccgcagcgtccgcgctggtgggcgagctgcagacgaacggctcggtggccgttatcctcgcctaccgtgaggggcagtttccccgcgacatgcacctgcacgggctccaagtcgccgccgacgagggcatagagatgaaagccatcaccgtccactcggccaagctgcatggccgcgcgcccgagggacacgtgctgctgcgggtctttttcaaggacctggacccgcaaaaagccctggccgaggcggttcacgaagtcgcccggctgttcggcgcgcagggcgatccgctctggcacgcctatgccgactggcggggcaagaatccggcgtatcaggtggggcacctggaccacatcgcccgcatccgcgccgcgctgccgccgaatattcaggtggcggggtcgagttacacgggcgtcggcattcccgactgcgtgaacgcgggccggacggcggcgcgggatgtggttgccgcgctgggcgtggatgggtga

SEQ ID NO: 24256 - DNA, 951 bp, Deinococcus radiodurans
atgaccaccctcaccaaccaaaaacccctcggcgtcctcttcatggcctacggtggcccggaaaacctgggcgagatgcccggctacctcgctgacatccgcgccgggcgcgtgacctcgcaggcgattctggacgaaatcaccaacaactaccgcctgatcgggggtaagtcgccgctgcccgaatttacccgcgcccaggtggaagccactatggagcaactcgccagcaccgggcggcccctgaaggcctacatcgggatgcgccactggtcgccctggatcgaggacgccgtgcgcgagatgctcgacgacggcatcgagcaggccatcgccatcgtgctggcgccgcagtattccagcctgagcgtcgccaagtaccagaaaaaaatcaaggccgcgctggaaatgaaccacggtcacatcgattttgcctatatcgacaactaccacaccgagcccggttacatcactgcgctcgctgaccgcgtccggataggcattcaggagtttccggaggacgagcgcgacgacgtgcacgtgattctttcagcccacagcttgccggtccggattatcaaggagggcgacccctacgctgaccagctccacgagacggcgcgcctggtggcggcgcaggcgggcttgaccgatgagcagtggtcgtggagctaccagtcggcgggccgcagccccgagccctggctggggccgcagctcgacgagcacctgcgcgacctgaacgagcagggcatcaaaaaggtcgtgagcatcgccatcggtttcgtgtccgaccacgtggaaatcctgttcgacatcgacatcgccgcgcaggaagtcgcccacgaactcggcatgacgctggtgcgcccgcccgcgctgaacaccgacccgctgtttatcgggactctggcgagcgtgattgagcgtaaggcggctgaggtggcgtga

SEQ ID NO: 24257 - DNA, 1179 bp, Deinococcus radiodurans
gtgactcgtcctcaaagtgaacaggcgccggaaaaacaaccggccacggcgccgccgcccgccgaccagcccaccgccctcgacccctcggtggggcgggtgcccggacgccccggcgtcagccggcccgaactcgacccccgcgtgcgcgactcggcgtttctgaaaacggcgcgcggcgagcaggccccttacacgccggtctggttcatgcgccaggcggggcgttacatgcccgagtaccgcgctctgcgggccggcaagaccatgctggagtgcatccgcacgccggacctcgccgccgaaatcaccttgcaacccatcaaggcgatgccgctcgacgccgcgattcttttcaacgacatcctgaccccgctgcccaccatgggcctgagtctggacttcgtgggcggcgtcggcccggtcattcacaaccccatcaatacgcctaaagacgtggacgtgctcggcgtgcctgccaccgccgagacgatgccgtacaccgccgagagcatccgcctgctgatgcccgaactcaactcgcgcgggattccgctcatcgggtttgtcggcgcgccgtttaccctcgcaagctacgcgattgagggcaaaggctcgcgcaactacgagaagaccaagcgcttcatgtacgccgagcccgccgcctgggcgcggctgatgggcaagttcgagtcggtgctggccgattacctgaccgagcaggtcaaagccggagcgagcgccgtgcagattttcgactcctgggtgggcgcgctgtcggtctacgactatcagaccttcgtcaagcccgccaccgccggcctgatcgagcgcgtcaagaaactcggcgtgccggtcatctatttcggcaccggggccacccacctgatgcccgatatggcgagtctgggcagcgacgtgatgggcgcggactggcgcacgccgctcgacaaggcctgggacctcattcagcccggccagagcattcagggcaacctcgacccgctgctgctgcaagcgccctggcgcgaactcaagcatcagaccgaccgcatcctgcacgaggcgaacgggcggcccggtcacatcttcaacgtgggccacggcctgctgcccgaaaccccgcaggacatggtgcaccgcctgaccgactacgtgcacgagcagacgcagcgctag

SEQ ID NO: 24258 - DNA, 1497 bp, Deinococcus radiodurans
gtgagccgcccacccgctatcctgcgccccgccatgtccgagcccgtctctgccgttcccctgtctgctcccgtcacccccgagtgggtcgccgacgccgtcttctaccagattttccccgaccgcttcgcccgctcgggccgcgtgaccggcctgcaccttcagccctggggcagcgcgccgaccattcacggctacatgggcggcgacctgtggggcgtggccgagcggctgggcgaccttgccggcctcggcgtgaatgcgctgtatttctgcccggtgtttcagtcggcctccaaccaccgctaccacacccacgactattttcaggtggaccccatgctcggcggcaacgcggcgctgcggcacctgctcgatgaggcgcacgcgcgcggcatccgggtggtgctcgacggggtgttcaaccatgccagccggggcttttttcagttcaacgacctgctcgaacacggtgaggcgagtgcgtaccgcgactggtttcatgtgaccggctggccgctgagcgcctacgacgaggaccgccccgccaactacgcggcgtggtggggcatccgggcgctgcccaagttcaacaccgaccaccccgaggtgcgcgagtttctgctgagcgtggccgaatactggatgcacttcggcatcgacggctggcggctcgacgtgccgaacgagattgacgacgacgccttctggcaggagtttcgccgccgggtcaaggcgattaaccccgacgcctacatcgtgggcgaaatctggggcgacgccggacgctggctggcgggcgaccagttcgacgcggtgatgaactaccacttcacccgcccctgcctgggctttttcggggcgcggacgctcgaccatccgatgaacgaacgcagcggcaccgggcgggtggagccgctggacgccgccgcttttgccgtgcgggtggaagaagtcacccgcatgtaccaccccgccgtcgtgcgcgcgcagctcaatctgctcgactcgcacgacaccgcccgcttcctgacggcggtgggcggcgacgcctcggcgcagcggctcgcgctcgtgtttcagttcagctatgtgggcgcgccctgtctgtactacggcgacgaaatcgggctgcccggcggcgtggaccctgactgccgccgcgcttttccctgggacgagccgcagacctgggaccacgacaccctgaccctcgtgcgcgagttgacggcggcgcggcaccgttcggcggcactgcggcgcggcgactttacggtgctgcacgcgcagggcgagcaggtgtcgttcgctcgcaagcatgacggagaggcggcgtatgtggccttcaactgcgcgctggatgccgccccggttccggtgcccgccacatcgggccgttaccgcgacatgctgacgggcgcggtgcatgacctgaacgaaagctcggtgctgacgctgcctgcccggacggcggcgttgctgctgtgcgaggggtaa

SEQ ID NO: 24259 - DNA, 909 bp, Deinococcus radiodurans
gtgggtggcgtttttcaggacagcccatctcttgattctctgttttttcctcagcctctcccctccgccgccaagtcatgtcaccatgcaggtatgacttacagcgacgacgacctgcgcctcgacgagatggaattcgagaacatcaccattgaccagcatggccccatcgcggtgctgaccgtgaaccgtcccaaggcgctcaacgccctaaacgggaccaccctcagcgagctggcaatggccgccgacctgatcgccaacgaccccgaggtgggcgccctgatcgtgaccggcgcgggcgacaaggcgttcgtggcgggggccgatatcagcgaactggcggggctggaagggccgttcgctgggcgcgacatgtcgctgctgggccaggacgcgatgacgcagctcagcaacctgccgattccggtgattgcggccataggcggctacgcactcggcggcgggttggaactcgcgctgtgctgcgatatccgcatcgcttcgccgcgcgcccgcatggggctgcccgaagtgacgctggggctgctgcccggctttgcgggcacccagcgcctcccccgcctgatcggggcgggccgcgccctggacctgatgctgaccgcccggcagatcggcgccgaggaagccctgagcatgggcctggtcaactacgtggccgacgacccactgcaaaaggcccgcgaagtggccgagcagatcgtgaaaaatgggccgctcgccatctcgctcgtcaaggaagcagtcaggcggggcctcgccaccgacctcgaagcggggatggaaatcgaggccgacctcttcgggctggcctttgccaccagcgacttcaaggaaggcactaaagcgttcctagaaaagcgcccggcggagtttaagggagagtaa

SEQ ID NO: 24260 - DNA, 993 bp, Deinococcus radiodurans
ttgggctcccgccgtttcgtgcgcgggccgctccgggcgcccggcccctacactgtgactgtgaatgtgtccgcccccgacccgtccgcctctgtccctgcccggagcggctccggtccccgccgcgcttttttgttcgctgacccggcggcgcactcgctctcgccccggatgcaccgcgccgcgttcgcctgggcgggactgaacggcacctacgacgccgagcgggtgcccgctcccgagttgccgacggcgatggcccggctgcgggcgccggacgtactcggcgccaacctcagcctgccgcacaaggaagccgcgctgccgctgctcgacgggctgtcggacgcggcccgcgccatcggggccgtgaacaccgtgattcaccgcgctgggcaactttatggtgacaacaccgacgcgccggggctgttgcaggccctcgcaggcagcgggctgactgggcggctgggcgccgcagaccgggtggtcgttctcggggccggcggcgcggcgcgggcggcggtgtacgccggggcggtgattctgggccgcgaggtctgggtggtcaaccgcaccccggcgcgggcgcgggcgctcgctgcggggtggcagggtggaggagaggtccgcgctgccgggcccggtgaggtgccgtgggggcaggtcggcctcgtcatcaacagcagcagcgccgggctggacaaccccgaagaaacgccgcttcccggcttcgacttcggacagctgccggcccacgccggggtgtacgacatggtgtacaagccgcgccgaacccgattgatgcgcgacgccgaggccgccgggctgcctgctgaaaacggcctggggatgctggcgcagcaggcccggctggcgtttaccgcctggaccggggtagacgtgccggtttcggtctttctggccgcgctggaagctccggctacagggcgtggcgcaggcgacgccgcccgtactgaggccacacggtga

SEQ ID NO: 24261 - DNA, 1209 bp, Deinococcus radiodurans
atgaaccctctgagaatcggcctgtttaccgacacttttctccccgaccagaacggcatcgtgaccagcgtctgtttgctgagcgacgaactgcgcgccctggggcatcaggtggacgtggtcgccccgcgctttccggagcatctcgaccgccgccccgacgtgcgccgggtggcgagcgtgcgctacccgctgctgccgacctaccgcctcgcctggccgggccggcggtcattcgagcagcgctacgacctgattcacacccatacgccgctcaccctgggcctcgccggagcgcggctggcgcgcaagtggggggtgccgcacgtggcgacctatcacacccacctggaggcttacacccactacgtgccgggcatgacgcagctcaaccgcgcggtgcatttcatgcccaaagtcgtcgggcggctctacggcgaggccgacgccgtgattacgcccaccgccggcacgctcgacacgctgcggcaggcgggcatcaccgacgcggtggtcattccgaccagcatcgacccggcggtgctcgaagccgcgccgcccatcgccagcccctggccgcccggcacgcgccggctgctgacggtggggcgcctcgcccgcgaaaagcgcttcgacctcgtgctcgacacgctcgcggatctgcccggtgcccacctggtcattctgggagaaggcccggaacgcacccacctcgaagaccatgcccagcggctcggcgtcgcggagcacgtcaccttcgtgggcgtgcggccctggaccgaaatcggggcgtactaccgcctcgccgagctgttcgtcttcgcctccgacaccgaaacccagggcttagtgctgcaagaagcgcagttgatgggcgtgccggtggtcgcggtgggcgcgcgcggcaccctgaccggcgtgcaaagcggctacagcgggtatctgacggcgcccggcgacgtgcccgaactcgtgcgccgcgcccgcgagctgctggaatcgcccgagcagtacgcccgcttttcccgccaggcccgcgagttcggaggccgcaccacgcccgccggagtggcgcggcaggtgctggcggtgtatgcccgcacgctgggcctgccgccagagtcgccggatgaccccagggcggacggactcagtgctccggcggaggcagccggtcgtccccgaaataaccccgtgtatggccggtga

SEQ ID NO: 24262 - DNA, 1161 bp, Deinococcus radiodurans
gtgaaactccacgagtatcagggcaaggaagtgctgcgcgacttcggcgtgaacgtgcaagacggcaaagtggcgaccacccccgaagaagtgcaggccatttacaaggaatacggccagccggtcgtcgtcaaggcgcaggtgcatgtcggcggacgcggcaaggccggcggcgtgaagtacagcgccaacgaagacaaggcgctggaaaatgccaagaacatcctgggcatggacatcaagggcctgaccgtgaacaaggtgctggtgaccaaagccgtcgatatcgacgcgggcaccgagtactacgtgggcatgatcgtggaccgcaacgtccagagctacaccctgatggcctccgccgagggcggcatggaaatcgaggaagtcgccgcgaccaaccccgaaaagatcatccgtcaccgcgttgacccggtcaccggcctgcgtccctacgaagcgcgtgaagtcgccatcaaggccggcttcaggggcaacctgaacaagattgccgacatgatggtcaagatgagcaaggctgcgctcgagcgtgacgccgtgctggtcgaaatcaacccgcttttcgtggacgccgacggcacccctattgcgctggataccaagttcgagatcgacgacaacgcgatgtaccgccacaaggacctcgcccactaccgtgagctgtccgccgagcacccgctggaagtcgaagccagcgattacggcttcgcctacgtgaagctggacgacggcaacgtcggcgtgctgggcaacggtgcgggcatcgtgatgaccaccctggacgtggtgaaccgcgccggggccaagcccgccaacttcctcgacatcggcggcggcgccaaggccgacgtggtgtacaacgcggtcaagctggtcagcaaggaccccgacgtcaaggccattttcatcaacatcttcggtggcatcacccgcgccgacgaagttgccaagggcgtcatccgcgcgctggacgaaggcatcctgaccaagccggttcgtatgcgcatcgccggcactgccgaagacgaagccaaggcgctgctgaacgaaaagaacagcgacctgatcaagatgtaccccaccatgttcgaagccgcgaacgaagcggctaaagaagcgaacgcactgggaggcaagtga

SEQ ID NO: 24263 - DNA, 906 bp, Deinococcus radiodurans
atgggcattctggttgacaagaacagcaaagtgatcgtgcagggcatgaccggcagcgaaggcgccaagcacagccgcgcgatgaaggaattcggcacccaggtggtcgcgggcgtgacccccggcaagggcggccaggacttcgaaggctggccgatctataactcggttgccgaagccaaggaaaagcacggcgccaacgtctcgatcatcttcgtgcccccggcgggcgcggcggacgccgtgctcgaagccgcgcatgcgggcatccccctgatcgtcctgatcaccgaaggcgtgcccaccgtggacatgatgcgcgccgtgcaggaagtcaaggaactcgacgcacacagcaaggccaatggcggccagggcgtgcgcctgatcggcggcaactgccccggtctggtgaccaacggggaagccaaggtgggcatcatgcccaaccgcatctacaccaaccccggacgcatcggcctgatcagccgctcgggcaccctgacctacgaagcggccaagctgctcaacgacgcgggcatgggcacctccaccaccgtcggcatcggcggtgaccccgtgatcggtacgaccttcgccgacgtgctgccgatgttcgaggccgacgaaggcaccgacgccgtggtcgtgattggtgaaatcggcggcgccgacgaagaagccgccgccgagtacatcaagaacaacatgaagaagcccgtcgtggcctttatctcgggccgctccgctccggcgggcaagcgcatgggccacgccggcgccatcatcatgggcgacgtgggcacccccgaaagcaagctcgccgccttcaaggccgcgaacgtgccggtggccgacaccatgcccgaaatcatcgacctggtgaagcaggcgctgaacaagtaa

SEQ ID NO: 24264 - DNA, 1164 bp, Deinococcus radiodurans
atgaccgacaacggaatgagctttgcgcccagcagcgagcagcgcatgattttgcagcacgtccgcgatttttgccgggccgagattgcgccgcgcgccgccgagtacgaccgcagcggcgagtacccccgcgagcaactgcgcggactggccgaactcggcctgctgggcgccaccgtgcccgaggaatggggcggcgcgggcctggactcggtgacctacgcgctgtgcctggaagaaatcgccgccgccgactccagcgtggccgttatcgtcagcgtgcaaaacggcctgcccgagcagatgatcctgaactacggcacggacgcgcagcgcgaaaagtacctgcgcccgctggcgagcggcgaacacatcggcgcgttttgcctcactgaagcccacgcgggcagcgacgccgccagcctgcgcctgaaggccgagcgcgacggcgacgactgggtactgaacggggccaaagcctggatcaccagcggcaaccacgccgacaccttcctcgtcatggcacgaaccggcggccctggcgcgcgcggcgtgagctgtttcattgtggaaaggggcacgcccggcctgagcagcggcaagcccgagcacaagatgggccagcacgccgcgcaaacgaccaccgtgtccttcgacaacgtgcgggtgccccacgccaatctggtcggcgaggaaggccagggcctcatcatcgcgctctccagcctcgattcgggccgcatcggcatcgggatgctcggcctcggcatcgcccgctcggcgctcgaacatgccgccgcctacgccaacgagcgcgagcagttcggcaagaaaatccgcgagttcgagggggtgtcgttcaagattgcccggatggccgcccgcatcgaaagcgcccggctggtcggcctgaaagccgcgtggctcaaggaccagggccagcccttttccaaagaagcgagcatcgccaaactgctcggcagcgaggccgccgtggacgtgacgagagatgccgtgcagatttttggcggcaacggctacagcgccgagtacccggtggaaaagctctaccgcgatgccaaaatcaccgaaatctacgagggcacctccgagattcagcagctcgtcatcagccgggcggtgttcgcggaactggaaaagtaa

SEQ ID NO: 24265 - DNA, 978 bp, Deinococcus radiodurans
atgagaaccgtcaccgtgggggtcctgggcagcggcaccgtgggccagaatgtcttgcaactgatcgagcggcgccggcccgtgtttggtgacctgggcgtgcaaatcgaactcgcgggtgtgctggtgcgcgacgtgaacaaggcgcgtgagctgcccgccggggtgcgcgtgaccgacaactgcgactttttgcaggagtgcggcgtggtcatcgaggcgatgggcggcattgagcgcccgctggagctgctgcggccttacctcaagagcgggcgcccggtgattaccgccaacaaggcgctgctcgccgagaaatgggacgaactgcgctcctacgcgctcgacggcgacctctactacgaggcttcggtgatggcgggcaccccggtcatcggccccatgagcaccgtgctgcgggcgagcacctttacccgcttgcaggcggtgctcaacggcacctgcaactacatcctcacgcagatggaaggcggcaaggactacgcggcggccctcgccgaggcgcaggctctcgggtacgccgaggacccacccaccctcgacgtgggcggcttcgacaccgcgcacaaactggcagtgctcgcccgtttttgcgccgacggcaactttccctacgagcagatcgaggtgcagggcatcgagcacgtcaccctggacgacatcgaacaggcccggcaacgcggcgagcgcctcaagctggtggccgagctgcggcgcgagggccatgacacccagagggggggctggcgagccgtcgtcgccccgcagagcctccccgccgaccacccgctgtgcaycgccgggggcgggcgcaacgcgatggtctacgaaggcgaggaatgcggcccgctgatcttcgccgggggtggggcgggcggcatggtcacggcctcggcgatggtgggcgacctgctcgactacctgctgggctttccggggcacgtgccgctgcactag

SEQ ID NO: 24266 - DNA, 2490 bp, Deinococcus radiodurans
atggcactcaacaacgatgtcaatcgcctgggccgcattctcggtcaggtgctcaaagagcaggaaggcgaggcgtttttcaacctcgtggagcagacccgcaccctggtgcgcgaggtgcgggccgggggtgaccctgcccagctcaacgcgctcctcggcagcctgagcgagaacgacgcgtccaacctcgcccgcgcctttacctggtatttccagctcgtcaacatcgccgaggagtacgagcgggtgcgcgtcttgcaaagccgcagtggggtcaggtcgcaaagcctcgcgcaggcgctggcggacctcagagagcagggcctgagtgccgaggacgtggaaaacctgctcgcccgcgtgaacctcgaacttaccttcaccgcccaccccaccgagatgcgccgccgcacggtgcgctctcacctcgagcacatcgcccgcgagctgccggacctcggacgcgaatcggcgcaggagcgcgtcgccgcccatgtggaagcgctgtggcgcacgcccgagctgcgccgcctcaagcccaccgtgctcgacgaggtcaagggcggcctcaactacatttcgaccatcgcgcaggcgctgcccaagctggagcgcgacctgagcgacgcttttcaggccacctacgggcgcgagaccgcggcccacgtcccgctgcgcttttcgtcgtggatgggcggcgaccgcgacggcaaccccttcgtgacgccggaggccacccgcgaggcgctgcaactgcaccgcgagcgggcgcgggaactgctgctcgcggcgctgcggcaggcgtacaccgacctcagccaggaggaggaagaggacgccgccgagggcacctaccgcaccgaactgcgcgccctccacaacgccgtgcgcgatggggaaccggtggagctgctcccccgcctcgaagccctgaatgcccgccttcacgccgacgggcaggagcgcaccgcctggcaactgctgatgccgctgctctcggtggcccgcgtgttcgggcagcacctcgtgagtctggacatccgcgagcattccgggcagaccggggcggcggtggccgaactgctgaaggcggcgggcgtggaggccgattatctgggcctctccgaagatgccaagctggagcttctgacccgcgaactgcgctcgcaccgcccgctgtggcctgccggggccaccttcaccgagacgctcgaagccgtcatcgggccgattcgggaagtgcaggccgccgcgcggcgggtggggccgctcgccttcgggcactacgtcatctcgatgtccgaaagtgtctccgacattctcgaaccgctgattctcgcccgcgaggtcgggttccgggtgctgccggtgccgctgttcgagacgctcgacgacctacaacacgccccccgcatcgtcaccgacctgctcgcgctgcccgagtaccgcgcggtgctgggggacgacatgcaggaaatcatgatcggctactccgactccaacaaggacgccgggttcctggccgccaactgggccctgcacgaggcgcagcgcaccatcagcgacgtgtgccgccgcgcgggcgtccgctggcgcttcttccacgggcgcggcacctccatcgggcgtgggggcgggccggcgagccgggcaattctgggccaacctgccggaacgattgacgcgggcgtgcggattaccgagcagggcgaagcgctcgccgacaagtacagccacccggtgctggcgcggcgcaatctggaacaggccctttacggcgtgctgctcgcggcggcccggcccgtgggcgacccccccgccgactttatggccgccatgacccgcgcggcggaggcgagtgccacggcctaccgcgacttcgtgcatgatccggacttcctgcctttcttcgagcgggtcacgcccatccacgaaatcagccgcctgaacatcgcctcgcgcccggtgcgccgccccggtgcgcccacgctgggcaacctccgtgccattccctgggtcatgagctggacgcaaaaccgcgccaacctccccggctggtacgggctggccgaggggctcgctgaaatcggccccgagctggcagcgaagatgtacgccgagtggccttttttccactccatgctcgacaacgcgcagatgagcctcgccaagagcgacccgctggtgttcgccgagtacctgaccctgctggaaggcgccagcacccggctggccgaccacctgcgcgagagctacgcccgcacggtggcggcggtagaaagcgtcatcggcggcgaactgatgctgggcgagcagcggctgaaagaaagcatcgcgctgcgtaacccctacatcgacccgattcaccgcctgcaagtcgaactgctgcgccgctcgcgctcgcacgaaggcggcctggacgagtacgagcgtccgctgctgctcacgctgcaaggaatcgcggcaggggtgcggaatacgggctga

SEQ ID NO: 24267 - DNA, 1197 bp, Deinococcus radiodurans
ttgactcagttcaagaattttcccgctgctcccgccgtggagtggccgacaggagccgacatggatttcaccctgaccgacgaacaacgccagttgcagcagctcgcccgtgactttacccgcaaggaaatcatcccgattgccgccgagtacgaccagaaagaagaactgccctggcaggtcgtcgaaaaggcctttgaagtgggcctgctcaatgcgtctatccccgaacatgccggcggcctgggcctgggcatggtggacgaaaccctcatcggcgaggaaatcggctacggctgcatgggcatctacaccatcttgatggcctccgaactggggattaccccgattctggtcggcggcaccgaagagcagcaaaagcgcttcctggggccgctcaccgaaaagcccggtctggccgccttcgcgctgtctgaacccaacaacggctccgacgccgccgggatgcacaccaccgcttacctcgacggcgacgagtgggtcatcaacggcaccaagatgtggatcagcaacggcggcatcgccgaagtgaccgtggttttcgccaccaccgacaagcagggcggccaccgcgccaccgtcgcgctcgtggtgcccaaggacgcccccggcttttcgtacaacaagatcaagcacaagatgggccagcgcgcttcgctgaccagcgaactggtcttcgagaatgtgcgcgtgcccaaggaaaaccagctcggcggcctgggcgacggctttaagatcgccatgaagacgctcgacaagacccggattccggtcgccgccgggtcggtgggcctcgcccggcgcgcgctggaagaaagcgtcaagtacgccaagcagcgcgaacgcttcggcacgcctatttcacagttccaggccattcagttcaagctggccgacatggcgattggcgtcgaaacgggccgcctgatgtaccagaaggctgcgtggctggtggaccaggggcacacccacggcgccgaaagtgccatcgccaaggcgtactgctcggaaatggccttcaacgccgccaacgaagcgattcagattcacggcggctacggctacgtcggcgagtacccggtcgagaagctgctgcgcgacgtgaagctcaacatgatctacgaaggcaccagcgaaattcagcgcgtggtcatcagccgtggcctgctgaagtaa

SEQ ID NO: 24268 - DNA, 735 bp, Deinococcus radiodurans
atgcagaccctcttggctctcaactggaaaatgaacaagacgcccaccgaagcgcggtcgtgggcggaagaactgaccaccaagtacgcccccgccgagggtgtggacctcgccgtgctggccccggcgctggacctctcggcgctggcggccaacctcccggcaggcatcgccttcggcgggcaggacgtttcggcccacgagtcgggcgcctacaccggcgaaatcagcgcggcgatgctgaaagacgcgggcgcaagctgcgtggtcgtcggtcactccgagcgccgcgagtaccacgatgaaagcgacgcgyatgtggccgccaaagcgcgtcaggcgcaggcaaacgggctgctgccgattgtttgcgtgggtgaaaacttggatgtgcgcgagcgcggcgagcacgtgccgcagacgctggcgcaactgcgtggcagcctggaaggcgtgggcgccgacgtggtcgtggcttacgagccagtctgggccatcggcaccggcaagacggccacagcggacgacgccgaggaactcgctgccgccattcgtggggcgctacgcgagcaatacggtgcccgcgctgaaggcattcgcgtgctgtacggcggcagcgtgaagccggagaatatcgccgagatttgcggtaagcccaacgtgaacggcgcgctggtcggcggtgcgagcctcaaggtaccggatgtgctggggatgctggacgcgttgaggtga

SEQ ID NO: 24269 - DNA, 1236 bp, Deinococcus radiodurans
ttgacgggtttgtgcccgctccatcaaccatcacctcttgaccatccacattccggaggaacacccatgcaaaacctcagtcaattggatgtcaagggcaagcgcgtcctggtgcgcgtggactacaacgtgccggttggggacggcgtggtacaggacgacacccgcatcacggcgagcgtgccgaccatcaagaagctgcttgacggcggcgccagcgtcgtgctgatgagccacttcggacggcccaagaatggccccgaggacaagtacagcctgaagccggtggctgaggccgtcagccgcgcactcgggcaggacgtgaagttcattcccagcctgccaggcagcgacgaaaccctccaggccgtgcaggcgctcaggcccggtgaagtcgcgctgctggaaaacgtgcgcttcgaggcgggcgaggaaaagaacgatgcggcgctgaacgacaagctggccaagctgggtgacgccttcgtcctcgacgcgtttggctcggcgcaccgggcgcactcgtcggtcagcggcgtggccggcaagctaccgcacgcggcgggcgggctgctccagagcgaagtggacgcgctcggcaagttgctgcacgcgccggagcatccctacgtggtcatcatcggcggggcgaaagtcagcgacaagatcaaggtgatcgagaacctgctgcccaaagtggaccgcatgctgatcggcggcggaatgatgttcaccttcatcaaggcgcgcggcgggcagatcggcaacagtctggtggaagacgaccagcttgacctggcgaaggggttgctggagaagtacggtgacaagctgctgcttccgaccgacgcggtggccgccgacaaattcgccgccgatgctcagagcaaagtcgtccctgccgaccagattcctgacggctggatgggcctcgatatcgggcctgacacgcagcgggcgtatgccgacgccttgcagggcgccaaaactgtcttctggaacggtccgatgggcgtgttcgagttcgaccagttcgcggcaggcaccaacgcggtggcggcggcggtggggagcctgaaagaccaggcctacaccgtggtcggcggcggcgactcggtgagcgccatcaacaagagcggcaaggccgaccagatcgaccacatctccaccggcggcggtgcgagcctggaactgctggaaggcaaggagctgcccggcgtcgtggcgatggcgtga

SEQ ID NO: 24270 - DNA, 993 bp, Deinococcus radiodurans
atgaaagtaggcatcaacggctttggccgcatcggtcggctggttttccgcatcctcgaagcgcgcggcgtcgaagtggtcgccatcaacgacctgaccgacaaccacacgctggcgcacctgctcaagtacgactcgaccgccgggcgctttgacggcaccgtggagtacgacgaaagcagcctgacggtcaacggcaagaagattcaggccatcgccgagcgcgaccccgccaacatcaagtggggcgagtacggcgccgacatcgtgatcgaatccaccggcatcttcaccagccgcgaaggggcctccaagcacatgcagggcggggccaagaaggtcatcatcaccgcgccggccaagggcgaggacttctccatcgtgctgggcgtgaacgacgagcagtacgaccccgccaaccaccacatcatctccaatgccagctgcaccaccaacagcctcggcgtgccgatgaaggtcatcgacgaggcgttcggcatcgagaaggccatcatgaccaccgtgcacagctacaccaacgaccagcgcgtgctggacctgccgcacagcgacctgcgccgcgcccgcgccgctgcgatcaacatcattcccacctcgaccggcgccgccaaggctgtgtcgcaggtgtaccccgcgctgaagggcaagttcgacggcaccagcctgcgcgtgcccacgcccaccggctcgatcagcgacgtgagcgtgatcctggggcgcgacgtgactgtcgaggaagtcaacaacgtcttccgtgaagccgcgaacggcaagtacaaaggcatcatggcctacaccgaagaccccattgtgctgaccgacattcagggcgacccgcacagcgcgatcattgacggcggcctgaccatggcgatgggcaacctcgtcaagttcttctcgtggtacgacaacgagtggggctacagcaaccgcatcgcggacctggtgcagctcgttcagaacaaaggctaa

SEQ ID NO: 24271 - DNA, 1422 bp, Deinococcus radiodurans
atgagccaaccccagcctccctcccgcctcctcgtcatgaaattcggcggcaccaacatgcaaagcgcccacgccatccgccacagcgcctcgctcgccgggcgcagcgtccgggaaggcgtgaaggtggtggtggtggtcagcgccatggccggcgtgaccaacggcctgctgcacctcgccgacgccgcgcagtcgggcgacatcgcgcgcgccaacgacgagatcgccgcgctgcgcacccggcacttcacggcggcgcaggaactcggggcggcgcccgactcggaaaccgtgcgcgaactgcgcgaactgcacgagacgctgcggcaggccgtctacggcgtgtacctgctgcgcgaactcaccccgcgcagccgcgacctgatcgtggccttcggcgagcggctttcggcccccttgatgagcctcgcgctcgagcagtcgggcctgcgcgcccggcacctgaccggcggcgaggcgggcatcctgaccgacaccaacttcggcaacgcccggccgctgcccggcacctacgagcgcgtgggcgaccgcctcagcggctttctgagcgccggcgtcacgccggtgatcgccggtttcatgggcgaaaccgagcagggcgcgatcaccaccctcgggcgcggcggcaccgatttctcggcgaccatcgtgggcaaggcgctcggggcggacgaggtgtgggcctggaaggacgtggacggcgtgatgtcggccgacccgcgtgtggtgggggacgcgagcaacatcggggtgctgagctacggcgaggtgatggagctcgcctatttcggcgccaaggtgctgcacccgctcgcggtcacgcccctgcaagacagcgggattcccctgcgcgtcaagagcgccgccgaccccgacttcgccggcacactggtgcgctcgcaggccgaggaaattccgggccgcccggtcaaggccgtgaccgccatcaagaacgtcagcctgctcaccgtcaccggcgccggggtcctgggggtgcccgaagtcatcgcgagcgtcttcaccgccatcgcccgcgagaacatcaccctgctgatggtgtcccagagcagttcgatgagcaacgtctcgctcgcggtgccgagcgccgacgccgcccgagccttgcaggcgctgcgcgcggggctgtcgagcgagctcaacgtcgaggaaacgaacggcgtggcggtcctcgccatcgtcggcagcggcatgcgcggtcagcagggcgtctcggcgcggctgttcacggcgctcgcgagcgaggacatcaacatcctgatgatctcgcagggctcgagcgagctcaacatatcggtggcgctcagcggcgaagaagtcgaccgcgccaccgccgccgtccacgccgcgttcaccctcagccagcccgtcggcgcctga

SEQ ID NO: 24272 - DNA, 1695 bp, Deinococcus radiodurans
ttgaatcccgtgtcttctatttcatataaaaaatattttccggcgtcgcaattctcatctgaaacgattcagtccaccctaaacttgagcatgacttccctgcaaggcgagctgaaatggtggcaaagcggcatcatttaccagatttacccacgttcctatcaggacagcaacggcgacggcgtgggcgacctgcccggtatcacggcgcggctgccgtatgtcgcgagtctgggggtgcaggcggtgtggctctcccccattttcaaaagcccgatgcgcgatttcggatacgacgtggcggattactgcgacattgacccggtgttcggcacgctggagcagttcgatgcgttggtggccgaggcgcaccggctggggctgaaggtcatgctcgactacgtgcccaaccacaccagcagcgaccacgcctggttccaagaggcgctcacgggcaaggccagcgccaaacgcgactggtacgtatggcgcgaccctgccccggacggcgggctgccgaacaactggaaatccttcttcggcggcccggcatggacgctggacgaggcgagcgggcagtattacctgcaccagtttttgccctcacagccggacctcaactggcgcaatcccgacgtgcgggcggcgatgtttgatgtgctgcggttctggatgcgccggggcgtggacggcttccgggtggacgtcatctggctgctggccgaggacgagcggtttctggacgagccggaaaaccccgacgccgaccgcgaagtcgttggcgggcagatcgaacacagtacgctgctgcacatctacacgcaggaccagcccgagacgcacgactatgtgcgcgagatgcgccgggtgatcgacgagttcgacgaccggatgatggtcggtgaaatctacctgccgctcgacaaactgctgccctactccggcacgcccgaggcgccgatggtgcatctgccgttcaactttcacctgattctgctgccgtgggacgcgcaaaccatccggcagttcgccgacgagtacgacgcagcgagcaacgcggcgggggcgtggcccaattgggtgcttggcaaccacgaccagcaccgcttcaagacgcgggtgggcgcggcgcagtaccgggtcgcgcaaacgctgctgctcacgctgcgcggcacgccgacggtgtactacggcgacgagatcggtatggaaaatgtgcccgttcccccggagaagatggtggacccctccggcctgcaacagcccgacagcccggacgccgggcgcgaccccgagcgcaccccgatgcagtgggaggcggcgccgggcgcaggatttacggcggcaggcaccgagccctggctgccgctcaccgacaacttcgcgcaggtgaacgtgcaagttcaggagcaggactcgcagagcgacctgaactacttccgcgccctgacccgcctgcgccaggagcagccggccctggtgggcggcagctaccgcagcctggacagcgggcacgccgacgtatttgccttcgagcgtgaactgaacggcgagcggttgacggtgtggctgaatttccgcggtgaggaacgcgcggtggccgccacggggcaaacgcttctgagcagccgtggcgatcagcccgccgcccaatcgccgctgcgcgggcacgaggcgcgggtggtgctgggttga

SEQ ID NO: 24273 - DNA, 531 bp, Deinococcus radiodurans
atgagccttcctcccggcaacggccccgtgcagatcagcgcggagcagatcaaagcccgtattcaggaactcgcggcgcagattcgcagcgactacgcgggccagcggccccacctgatctgcgtgctcaacggcgctttcatgttccacaccgatctggtgcgggcgctcgacatgcccgccaccatcgatttcatgcaggcgagcagctacggcaccgccaagcagtcgagcggcgaagtgcggctggtcaaggacctcgcctttcccatcagtgaccggcacgtgatcatggtggacgacatcgtggacaccggcatcaccatgagttacctgctgcactacctccagggacgcggcccggccagcctgaaggtggcggcgctgctcagcaaacccagccgccgcaaggtggaagtgccggtggactacctcggcttcaccatccccgacgccttcgtgtacggctacggcctcgaccgggcgcaactcgaccgcaacctgccatttatcactagtcaggaggagtaa

SEQ ID NO: 24274 - DNA, 1065 bp, Deinococcus radiodurans
atgatggacaaagatttgggcgcttcccccgcttctgcctacgaacgggccggggtcagtatcgacgccgggcaccgcgccgtggacctgatgaaaggagcggtggcccgcacccacaccgccaacgtgctcggtggcctcggcggtttcggtgggctgttccgtgccgctttcggcgacatggcggaccctgtgctcgtcgccagcaccgacggcgtgggcaccaagaccaaggtagcggtcaaggtcgggcagttcggcgggctcggacacgacatcgtgaaccactgtgtgaacgacattctggtgcagggcgcccggcccctgttttttctcgattacgtggcgatgggcaagctgcgccccgaggcggtggccgaggtcgtgagcggcgcggcgcaggcgtgcgaggcgctcggcgtggcgctgctcggcggcgaaaccgcagagatgcccggcgtgtacgtggacggcgaactcgacatcgtaggcacgattgtcggcgtggtggaccggcccaacctcattgacggggggcgcatcgaggtcggtgacgccgtgattgccctcccgagcagcggcctgcacaccaacggcttctcgctcgcccgcatggcgctcgacgccctcgactggaacgaggcccgcagcgatctgggcgggcagaccctcgccgccgtgctgccggttccgcaccgctcctaccttcccgcctacgacgcgctggaaaaggccggtgtggacgtgcgcggcatggcccacatcaccgggggcgggctggtggacaaccccccgcgcgtgtttccgcagggcatcgggatgcaggtggacaccgcgagctgggcggtgccgcccctcttcgaactcatcgtgcgcgaggcgggcgtggagcggcaggaagccttccgggcgctgaacatgggcgtgggcttcttgttcattgtgcccgctgcgcagcgggagcaggccatgcagaccctgcgggcggcgggtgagcagccctgggtcatcggggaaatggtcgccgggcagggcgtcaccttcagcgggggcggcgcctcttga

SEQ ID NO: 24275 - DNA, 990 bp, Deinococcus radiodurans
atgcgtcccgaactgctcgcccgcgtgctctcgctgctgcccgaaaccagcgccacgcccgaactcgcccgcttctacgcgctgctgcgcgactacccgcagcgcggcggcaagggcatccgctcggagctgctgctcgccagcgcccgcgcccacggcctgagcgagtcggacaccgggtgggagagcgccctgtggctcgccgccgcgctggaactgtttcagaactgggtgctggtccacgacgacatcgaggacgactccgaggagcgccggggccggcccgcgctgcaccacctgtgcgggatgccggtggcgctcaacgtgggcgacgcgctgcacgcctatatgtgggcggcggtgggcaaagcgaacgtgcccggcgctttcgaggaattcttgcagatggtttaccgcaccgccgaggggcagcacctcgacctcgcctgggtggagggccgcgagtgggggctgcggcccgccgactacctgcaaatggtgggcctgaaaaccgcgcactacacggtgatcgtgccgctgcggctgggggcattggcggcaggcatggcgccgcaggacgcttttaccccggcgggactggcactcggcaccgccttccagattcgggacgacgtgctcaacctcgcgggcgacccggtgaaatatggcaaggaaatcggcggcgacttgctcgaaggcaagcgcaccctgatcgtgctggactggctgaccaccgcacccgacgaccggaaggcgatttttctcgaccagatgcgccggcaccgcgccgacaaggaccccgccgtcattgacgagattcaccgctggctgctggaaagcggcagcgtggaagccgcgcaggactacgcgcaggcgcaggctgccgaggggctggacctgctggaaaaagcgttggcagacgccccggacgcgcaggccgccgccgcactgctcgccagcgtacgcgaactggcgacgcgggagaagtga

SEQ ID NO: 24276 - DNA, 1533 bp, Deinococcus radiodurans
ttgcagttccggtcccggggagcgcctgtctgccgagtgcccgctagactctggcgcatgagccttcaatcgccgcccgagctgcccagcggctttattcgcacctctgatgtcctccacgagcgcctgaccccggcgcgcgcgcggcacctcgacctgcaatacggcaacgaggaactgctctacggcctcgacgtgctggggctggcggggccgttttaccgcacctcgccctgggaactcgaagacgagcagggcgtgcggcgtatcaacgcctgcgggtacgccgcgctgccgttcggggaaatgccgcccgccatcaccagcttcatgcaggaatttctggaacacaaccgcgccatgacgctgccgcagcagtcgagcagcccctggcgggcagccctgcaaaccaacctcgtcaagctgctgtcgcgtgagctgccgagccacagcgacagccaggtcttcttctgctcgagcggcaccgaggccatcgagggcgcgatgaagttcgccaaggcgtggcgcccggaggcgcggcacttcatctcgtttggcagcggctaccacggcaagacctacggcagcctcagcctgacgcccaaccccgagtaccaggacgtgtttcgcccgctggtgcccggtgcgctcacctcaccctacggcgacctcgatgcgctgaaggctctggtgcgccgcgcgggaccggacaaaatcatcgcggtggtcgtggaaccgattcagggtgagggcggggtcaacattccgccgcccggctttctgcgtggcctgggggagttctgccgctcgcacggcatcgtggtcattgccgacgagattcagactggcctggggcgcaccggccactggttcgagtcggcggcgcaggggctcgacgccgacatcattaccctcgccaaaccgctcggcggcgggctggtgccggtgggcgcgaccatcgtccggcagcccatctacaagaaaatgctcggcggcctgagcagcaagcgccactccaacaccttcggcggcggggcgctgagcatggcggtgggcctgaagtcactcgagtacctgctcgaaaacgacctgcccgcccgcagccgcgccctgggcgaacagggcctggcccgcttgcaggacttgcagcggcgctttcccaaactgctgcaggcggtgcgcggtcagggcctgctgctggccatgcagtttcagccggtggtcgggctggcgctgccgggcgcgattcgtgaactggtctacgagggcaccgcgattctggcgctgcgcgaactgcaccacgcccgcgtcatggcgaacctcagcctcagcagcaaacgggtggtgcgcctctcccccgcgctcgacatgccgcaggacgtgttcaccgagctgatggaccgggtcgaacgcttcgcgcagctcaaccccaacgcccgcagtctggtcacgcatacgcccgcgcccacgctgctgcggctggcgaccttcgcggcgagcaagcccaaaaagcgcacgccgagcgacgggtaa

SEQ ID NO: 24277 - DNA, 879 bp, Deinococcus radiodurans
atgctttctagagatcagcattgttttacattcgccaagcgattttctttcttggtatgcattaggatagtcaacatgatcgtggtgaaggtaggcggcagcgatggcatcgattacgacgcggtgtgtgcggacctcgcggagcgctggcaggcgggagaaaaactcattctggtgcacggcggcagcggcgaaaccaaccgggtggccgaggcgctggggcacccaccgaagttcgtgacgagtccgagcggctacacctcgcgctttaccgaccggcaaacgctcgaaattttcgagatggtgtactgcggcaagatgaacaaagggctggtcgagcggctgcaacggctgggcgtcaatgcggtgggcctgagcggtctcgacgggcgcatcttcgagggcaagcacaaagacagcgtgcgctcggtggagaacggcaaggtcaaagtgctgcgcggcgaccacaccggcacagtggaaaaggtgaacaccgggttgatcgaactgctgctcggcgcgggttatctgccggtcttgacgccgcccgccgccagctacgagggcgtcgccatcaacgtggacggggaccgcgccgccgcgcaactcgccgccgcgctgagggccgaggcgctgctgctgctctccaacgtgccgggcctgctgcgcgactaccccgacgaggccagcctgattcgtgaaatcccggcgaacgacgtggagagttacctcgaattcgcgcaggaccgcatgaaaaagaaggtgctcggcgccgccgaagcggtggccgggggcgtgggccgggtcgtgttcggcgacgcccgcgccggcaagcccatttcggcggcgctggctggggaggggactgtggtttcctag

SEQ ID NO: 24278 - DNA, 1263 bp, Deinococcus radiodurans
atggaacaggatacggcatggcgccaggaagcaaatcagaccttccatacccgcgccacttttcttgagtgtgctcgtgttaacctggggagcggaggccgggctgatctgtcccggcgaaaaagaagacctatggactactacgaactgctgggcgtgtcgcggacggcgagcgccgacgaaatcaagagtgcttaccgcaagctcgccctcaagctgcaccccgaccgcaacaaggaagagggcgccgccgagaaattcgcgcaggtcagcgaggcctactcggtcctgagcgacaccgaaaaacgcgcccactacgaccgcttcggctcggcgcccggcgcggggatgcccggcggcgacrccttcggcgggatggggggcatgggcggcgtgggcttcgaccccatggacatcttcgagcagctgttcggcggcgcggcgggcatgggtggacgcggacggcgcggcccggcgcggggcgacgaccttgaaaccgaagtgcgtattacgctcgagcaggcgcgcgcgggcgaggaagtcgaagtcacggtggaccgcctgaccgagtgcgagcactgccacggcacccgcaccgaacccggcggcaagccgcccgtcacctgctcgacctgcaacggcagcggcgccgtgcgcggtcaagcccgcaccattttcggcgtggtggaaacccagcaggtctgcccgacctgtaagggcgacggcaaaatggtggtggacccctgcaccgtttgccacgggcgcgggcgcaccctcaagtccgagccggtcaaggtcaagctgcccaaaggcatcgacgagggttaccgcatccgcgtggcgggccagggcaacgaaggccccggcggcaacggcgacctctacgtgcatatcgagatggagccgcaccctgaactgcaccgccaggacgagaacctgattttccccgcccgcatcggctttgcgacggcggcgctcggcgggcgcatccaggtgcccaccctcgacggcccgcaggaagtcgaggtcaaacccggcacccagcacggcgaacttcaccgtctgcgcggccaggggatgccccggctccagggcgcgggcacgggcgacctgattgtcgattacgaaattgtggtccccaagcacctcaacgccgaggcaaaagacgccctgcaagcctacgcccgcgctgtgggcgacgaggtacccgaggaacacgaggggctgttcggcaagatcggcaagctgttcgggcgcgactga

SEQ ID NO: 24279 - DNA, 810 bp, Deinococcus radiodurans
gtggggtatcctctcccctgcatgactcgactcgacacccccgcgaagcccgcgcccagcacgctgcaaaagctctggaaggaactgctcgaacccatcttgttcgccgtcgtcatcacgcagttcgtggcgacgctggtgggggtggatggcaactccatgctgccgggcctgcgcaaccgcgagcgcgtcttcgtgcccaagtacgaaacttggctgcacaaggccggcgtgggcaacttcaaacgcggcgacatcctgattttcaaaccgcccgcccaggccgcccagaaaatcgaaaacctcaaccgctcgtttctgggcctgtggaactaccggcccttcctgatcaagcgcctgatcgggctgcccggcgacaagattcgcatttccggcggcgaggtttatctcaacggcgccaagctcgacgcgagctggacgaccggctactggcagcagcaggagtgctgggacacgcaaagcgacctcgccacgcaggccacctcgggccgcgccggggtgatgcccgaccagcccgaattcaccgtgcccgccggcacctacttcgtgatgggcgacaaccgcacggtcaacggctcggaagactcgcgcatgttcggcccagtgccgctgcgggacatcgcgggccgcgccgccgccgtcgtgtggccggtcatgcgcaagagcaacctgaagtacgactgcgccgccgaaacggcgggcgaactctcgggcgagaacgagctgaactggcgcgtgctgaaccgcccgcccggcttcagcgcggtgccggccccgacgacgccctga

SEQ ID NO: 24280 - DNA, 1209 bp, Deinococcus radiodurans
gtgcgcctaggaaccggaggacttgttatgcccgaagccgtcatcgtctccaccgcccgcacccctatcggcaaggcctaccggggctttctcaacgacacccacggctctgacctcggcgcccacgcggtcaagcacgccatcgagcgcgcgggcgtgaaccccgccgacatcgaagacgtgatcatgggcgccggcaaccccgaaggcgcgaccggcagcaacatcgcccgccagattgcgctgcgcgccgggctgccggttacggtcagcggcgttaccgtcaaccgcttttgctccagcggcctgaacaccatcgccctcgccgccaaccatgtgatggccgggcaaggcgacgtgttcgtggcaggcggcctggaaagcatcagcctcacccagaacgagcacgccaacaccttccacctgcgcggcgagtggctgctggagcacaagcccgacatctacatgagcatgttgcagaccgccgaggtcgtcgccgagcgctacggcatctcgcgcgagcgtcaggacgagtacggctaccagtcgcagatgcgcaccgccgccgcgcagcaggccggcaagttcgaccatgaaatcgtgccgatgactgccaccatgaaggtgcaggataaggcgaccggcgaaatttcgacccaggaagtcacccgtaagctcgacgagggcaaccgccccgacaccaccctcgaaggccttgccaagctcaagccggtgttcgagggcggcgtgatcaccgccggcaacgcctcgcagctctccgacggcgcggcggcggtggtcgtgatgaacagcgacgtggcccgtgaacgcggcctgcaaccgctcggcgttttcaagggcttcgcggtcgccggctgtgaacccgacgagatgggcatcggcccggtgcttgccgtgcccaagctgctcaagcgccacggcctgagcgtggacgacatcgacctctgggaactgaacgaagccttcgccgtgcagaccctgtattgccgcgacaagctcggcatcgaccccgagaagttcaacgtgaacggcggcgccatttccatcgggcacccttacggcatgagcggcgcgcgcctgaccgggcacatcctgcttgagggtcagcgccggggcgccaagcacgtcgtcgtgaccatgtgcgtgggcggcggcatgggcgcggcgggcctgttcgaagtgctctga

SEQ ID NO: 24281 - DNA, 657 bp, Deinococcus radiodurans
atgaccgcacagacgacccccgaacgtcgccccgatcacctgacgctcgcgctgcccaaaggccgcatcatggacgacgccatcgcgctgctctcgcaagcagggctgccgctgacccgccccgaagcgagccgtgccctgcgccacgagtttcccggcgtgacggtgctggagctgcggaatcaggacgtgccggtgtacgtggacctcggcgtggccgacgcgggcatcgtcggcaaggacgtgctgctcgaagccgggcgcccggtatacgagccggtggacctgcacttcgccgagtgccgcctgtcgctgattcgtgaaatcggggccagcgggccgattgcccgggtgggcaccaagtacccgcgcgccgcccgcgcctatttgcaggagcgcggcattcccgccgaggtggtcaagctcagcggcaacatcgaactcgccgcgctgaccgggctagccgacgccgtgatcgacctcgtgcagactggaagcaccctccgcgccaaccacctcgaagaagtggacgtgctctttcactcatcagcccgcctgatcgtcaaccgcaccgccctcaagctgcggcgcgagcgactgcgcccgctgatcgcccgactgcgcgaattgacggcgccggcaggggaagaaagttaa

SEQ ID NO: 24282 - DNA, 999 bp, Deinococcus radiodurans
ttgtccctgcccacgtccaccacccccgagagcttcatgaattcccgccgctcgccgctgctggtgttttccggccagagcaaccgtccgctggcgcaggccatctgcgacaacctgggggtgccgctggggcgcagccgcaccgagaagttcaccaacgacaacctgatcgtgcactacgaggagtcgctgcgtgagggggacgtgtttatcgtccagactttttccacgccggtgagcgacgcgatcatggagctgatgctgatgatcgacgccgccaagtcggcgagcgccgggcgcgtgaccgccgtgattccttattactcctacgcccgcagcgacaagaaagacagcccgcgcatctccatcgccgggcggctggtcgccgacctgttgcaggaagccggcgccgaccgcgtgctcaccatgacgctgcacagcccgcaggtgcacggctttttcaaggtgccggtcgaccacctctcggcggacgtggtgctcagccagcatttcaaaaagtgcgtgcccgacgcccacaacggcgtggtcctcgcccccgacgcgggcagcatcaagcgcgcctcgcagattgcccggcgcctggactcgggcctcgccatgatcgataaagagcgcctcagcgacaccgaagtgcgcccccgtgcgctgatcggtgacgtggacggcaagaccgtgtttatcgtggacgacgagatcagcaccgccgggtcgctggtcgaaaccgtgagcattgcccgcagtatgggcgccaaggacgtgtacgtggcggtgacgcacggcgtgtactccggccccgccatcgagcgcatcgccgcgctggacgtgacgcaggtggcgagctgcaacaccgtgctggtgccgcaggacaagctcgaccgcgcaggcggcaagctcgcggtgctcgacgtggcgccgctctttgccagcgcgattgccaacattcacaccggggcttcggtcagcacgctgtttacctga

SEQ ID NO: 24283 - DNA, 768 bp, Deinococcus radiodurans
atgacccaggaagcaaagcagtttgaaaagcagagcggcggcgccgacagcaaccaattcggagccggcaagtcggccttcgtgaccggcgcgagcaagggcatcggctacgcggtggcgcaggcgcttgccgccgagggctaccgcgtgaccatcaccagccgcaagcaaggcgagattgatgaggctgcccagcagctcggcgagaacgtgcgcggcgtggtctgcgacgtgaaagacgccgccgctgtgcagagtgcggtggacgcccatgtagaagcgttcggcagcctcgacgtgctgttcgtcaacgcgggcgtgggccacttcgccaacatcgagcaactcagcatcgagcagtggcaggacgtcatcgacaccaacctctcgggcgccttctacaccatcaaggccgcgattccggcgctgaaaaagcagggcggctacatcctcaccctgtcgagcctcgcgggcaaaaaccctttcgagggcggcgcggcgtacaacgccagcaagtttggcctcaacggcttgagcgaagtcgtcaacctcgacctgcgccagtacgacatcaagaccacccagatcatgcccggcactgtagcgacgcacttcaacgaccacacgccgaacgaggacgatttctggaagattcagcccgaggacatcgcgcagctcacggtggacctgctcaagatgcccgcccgcaccctgccgagccgggtcgaagtgcgcccgagccggcctgaccggaagccgaagaaataa

SEQ ID NO: 24284 - DNA, 1452 bp, Deinococcus radiodurans
atgcaccacctcatcctcccggcgctgctgctcgcctccgccgccagcgcccaggctgcgcctacatcaaccggccccagctttgaaggccagatcatctatcaggtcatgcccgaccgtttcttcgacggtgacccttccaacaatgccggggtggaccgtgccaacctccgcgcctggcacggcggcgacctcgcggggctgacgcaaaagctgccttacatccagaaacttggggcgacggccatctggatgacgccgatctaccgccagcagaccgccaaatccttcgacaccgccgcttatcacggctactggcccgccgatttccggcaggtggacccgcacttcggctcgatggcgaccttcgatacgttcatgaaggcagcgaaaggcgcggggatgaaggtggtccttgaccaggtcatcaatcactacggctacgaggccccagcggtgaaggccaatccgggctggttcaacggcaaggcgcagtgcgacgcgaccaagaacaaggacgtggactgtcccctcgccggcctacccgacctgcgccagagcgtgcccgccgtgcgccagcagttgttcgggaacggcgacttctggcgggcgcgaggggtggacggcttccgttacgacgcgatcaagcatgtggagcggcctttcctgctcgacctgctgaaaaaagaccgcgccgccggcacctggacgctcggcgagtggtacgacgccgacgcgggcacggtggccgagtggcaaaagcaggggtttgacagcctgtttctcttcagcttgcaagcggcgatgcgcggcagcgtgatgggcgcgtccagcctggtcaacgtgcgcgaggtgctgcgccgctcggacgaacttgcccggcccggcgaggtggcactgtttctcgacaaccacgacgtgccgcgtttctcgcagggcagctttttcgaggacgaagggcaggcccgcaccaaatacggcctgcgggcgctgctcacgctgcggggcgtgccggtcctctaccagggcaccgaaattgccatgcgcggcggagccgaccccgacaaccggcgcgacatgcgctttgaaagccagtggacgcccgccgaaaaagccgtatacaacgtggcccgcgacgccattgccgtccgcaaggcgagcccgcccctcagtcggggcacccagacgctgcttcccgtccccgaccggcaggccgacgacctgctgctgctgacccgcgagcagggcggacagcgggtgctggtggcctggcacaacgggttgaaacgccagagctactcgctgaagctcagtaccctgggaatcaaggcgaacgctcaggatgtgaccaagacgctgtttgccgggcaggacgccaaagtgagcgtgaagggcgggtatttgcacctgagcctaccgcctaaggacgcggcggcgttcgttttgcggtga

SEQ ID NO: 24285 - DNA, 1890 bp, Deinococcus radiodurans
gtgaacgaacttcccggcacgtccgataccccgctgctcgaccagattcatggccccaaagacctcaaacgcctctcgcgggagcagttgcccgcgctgaccgaggagctgcgcggcgaaatcgtgcgtgtctgctcgcgcggcggcctgcacctcgcgtcctcgctcggcgcggtggacatcatcacggcgctgcattacgtgctcgactcgccgcgcgaccggattctcttcgacgtggggcatcaggcctacgcccacaaaatcctgaccgggcggcgcgaccagatggccgacatcaagaaagaaggcggcatcagcggctttaccaaggtttccgagtccgaacacgacgcgattacggtgggccacgcctccacctccctcgccaacgcgctcggcatggcgctcgcgcgtgacgcgcagggcaaggatttccacgtcgctgccgtcatcggcgacggctcgctgaccggcgggatggccctcgccgcgctcaacaccatcggcgacatgggccgcaagatgctgatcgtgctcaacgacaacgagatgagcatctcggaaaatgtcggggccatgaacaaattcatgcgcgggctgcaagtccagaagtggtttcaggaaggcgaaggtgcgggcaaaaaagcggtggaagccgtcagcaagccgctcgccgacttcatgagccgggcgaaaaactccacccgccacttcttcgaccccgccagcgtcaaccccttcgccgcgatgggcgtgcgctacgtcggcccggtggacggccacaacgtgcaggaactggtgtggctgctcgaaagactggtggacctcgatggcccgaccatcctccacatcgtcaccaccaagggcaagggcctgagctacgccgaggccgacccgatctactggcacggcccggccaagttcgacccggcgaccggcgagtacgtgccgagcagcgcctattcgtggagcgccgccttcggtgaggccgtgaccgagtgggcgaagaccgacccgcgcaccttcgtcgtcacgcccgccatgcgcgagggcagcgggctggtcgaattcagccgcgtacacccgcaccgttacctcgacgtgggcatcgccgaggaagtcgcggtgacgacggcggcgggcatggcgctgcaagggatgcggcccgtcgtcgccatctactccaccttcctgcaacgcgcctacgaccaggtgttgcacgacgtggcgattgagcacctcaacgtcaccttctgcatcgaccgcgcgggcatcgtgggggcggacggggccacgcacaacggcgtgttcgacctcagcttcctgcgctctatccccggcgtccgcatcgggctgccgaaagacgccgccgaactgcgcgggatgctcaagtacgcccagacgcacgacggcccctttgccatccgctacccgcgcggcaatacggcgcaggtgcccgccgggacgtggccggacctgaaatggggcgagtgggaacggctgaaggggggcgacgacgtggtgattctggcgggcggcaaggcgctcgactatgccttgaaggccgccgaggacctccccggtgtgggcgtggtcaatgcccgcttcgtcaagccgctcgacgaagagatgctgcgcgaggtggggggccgggcccgcgccctgattacggtggaagacaacaccgtcgtcggcggcttcgggggcgcggtgctcgaggcgctgaacagcatgaacctgcatcccaccgtgcgcgttctcggcattcccgacgagtttcaggaacacgccactgccgagagcgtccacgcccgcgccggcatcgacgccccggcgattcggacggtgctcgccgaactcggggtggacgtgccgattgaggtgtag

SEQ ID NO: 24286 - DNA, 2193 bp, Deinococcus radiodurans
atgaaagtcaccgtagacggcgtccccctcgaccttcccgccggcacttccggcatcgacgccgtgttcgccgccgggcgcgacgtgccgtatttctgcgcccactcgtacctctcgccggtcggggcctgccggatgtgcctggtggagtcgggcagcccgcgcaagggcaaagacgggaattttgaactcgatgagcagggcgaggtcaagattttctggttccccaagccgatggcggcctgcaccatgcaggcgaccgaggggatgcacatcaagaccgccgcgacgagtgaagtggtcgccaagtcgcaggcagggatgatggaatttaccctgctcaaccacccgctcgactgcccgacctgcgacaagggcggcgcctgcgagttgcaggaccgggccttcgagtacggctacggcgcgagccgcttcgggtttgaccgtcgccacgccgacaagcactacccgctttcggacttcgtgattctggaccaggagcgctgcatccactgcaaacgctgcgtgcgctacttcgaggaagtgccggggcaggaggttctggactttatcgagcgcggcgggcacaccttcatcgacactcaggaaggcgggctgcccaccggcttttcgggcaacatcaccgacatttgcccggtcggggcgctgctcgacaacgtggcgcgcttccggggccgcaactgggaatacgaccacacgccgacgacctgcacgctgtgcccggtgggctgcgccatcacggtggacgcccgcaatggccggctggagcgtatcgtgggccgcgaaaaccgcgacgtgaacgaaatctggctgtgcgacgccgggcgcttcgggcacactttcgccagtgaaggccgcctgacccgtccactcattcgtgagaacggcagactgcgcgaggccgactgggacgaagcgattgcagccatgcggcgcggcctgagcggtattcacccgtcgcagctcggcctcttcatcgccgccgattccaccctggaagaaggcatggcgctcgaacgcttcgccgcgcagctcggcgcaggcaacgtggaccactggccgcgccatccggtgcagctcaccgcgcctgccgcaaccctgaccgacgtggcgcaggccgacgcgctggtggtcatcggtgccgacctcggcgaggaagccccggtgctggaactgcggattctggaagccctgcgcggcggcatcctgcccaccgagtttgaccacggcaccgcgattgccgacctgcggctggtggaacgccccgcccgcaagcccgaaaagctggccgttatcgggcgcgagtcgtccatctggcgccacgccgggattcaggccgcgtccaacggccacaacgctgtcgcccggctgttgcggcctgacaccgacgagctgcgggcggcactgaagctgctggaggaggccgaaaagccggtggtcatcctgggcgctgacgtactgggtgccgacgtgctgggcagcgggactgatggcctggccgcgcaggtgagcgaactggcgaaccgcaccggagcaaaggtgctggccgtagccgccgcagccaacagcaccgggctggccgcactgaacctgctgccgcgcagcggagccgctgggtacgcgggcctgaccgacgctcccgccgccttcctcagccgcctcgacccggtgggccaggggctgctgagcttgccgcgcggctttaccgtcgtccacgacacccacctcaccgagacggcgcagcaagccgatgtggtgttgcccgccgtgacgaactatgaaaagcgcggcaccaccgtcaacctcgaaggccgcttcctcgcgctggagcaggccgcgctgagcgccggggaaggcgccgacctgattcgcaccctcaccgcgctcgccgaggcgctgggcgtgcggccccaggtgcgcgggctgaagtcggcccaggcggctttgcaggagcggctgggcttgcgggtggacacgctgccgccgcaaggagcactcaacctgaacgtgaaccgcgccgccgcgcccgtgggcgtgccgtacacgccgcagctctggaaaccccgcatgcgccccgcaccgcaggcgagcgagcagccagacctggggcgcgggcaagcaagctgggcagcgccgctctctgccgccgcccccaccggaggtgacgactga

SEQ ID NO: 24287 - DNA, 1779 bp, Deinococcus radiodurans
gtggagcagacaggcaagcaggggcagaaccgtggggagatgaccggcgccaaagcgctgtgggcgactctggcggggcacggcatcacgacggtgttcggctatcccggcggggcgatcatgccggtgtacgacgcgctgaccttttacccggaagtgcgccacatcctcgcccggcacgagcaaggcgccattcacgccgccgagggctgggccaaagcgaccggtgaaatcggcgtgtgcatggcgacatctggccccggcgcgaccaacctcgtcaccgggctggccgacgcgatgctcgacagcgtgccgctgctggcgatcaccggcaacgtggcgcagcacctgatgggcaccgacgcctttcaggaagccgatatcaccggcatcaccatgccaatcaccaagcacaactacgtggtgcgcgacgtggacgagctgccgcgcgtgatcgccgaggccatccgcatcgcccgctcggggcgtccggggccagtgctggtggacattcccaaagacgtgcagctcgcggccttcgcgggcgacattcccaccccgcacacccgcccacaggcgcccgaggccagtgccgagagcatcgcgtcggccagagaactgctgagaaatgccaaaaaacccgtgctggtcatgggcggcggctcgctcgacgcctcggcggaactcactgcgctcgcccacgcctggggcctgccggtcatcaccacgctgatgggcctgggcgcgtacccggcgtccgatcccctctggctggggatgccggggatgcacggctcggtggcggccaaccgcgccatttccgagtgtgacgtgctgctcgccgtcgggatgcgcttcgacgaccgggtgacgggccgggtcagcggatttgcaccgcacgcgcagattattcacgtcgaactcgacgccgccgagatcggcaagatcgtgcggacccacctgccgatccgcagcgacgcgaaaactgccgcccggcaactcgccgagggcgccgagaaactcgaactcggcgagtggctttcccagatcgaggagtggaaaggacgggcggtgcccccgcagcagtggggcgcggcctacgcggtgggacaggtcacggcccggctgcggcctgacgacattctcagcagcgacgtgggccagcaccagatgctcgccgcgcagctcgcccgcttcgaaaagccccggcgctggctgaactccggcgggctgggcaccatgggcttcggctttccggcggccatcggcgcggcgctcgccgaacccggcgtcgtcagcatggtggtggcgggcgacggcggcttccagatgaccgcgcaggaactcgccacgctgaagatgtacgacatccgcaacgtcaaaatctgcatcatcaacaactcgtacctcggcatggtgcggcagtggcaggagctgtttcacggcaagcgctactccgaggtgtggctgggcgactccaaccccgatttcgtcaagctggcgggcgcctacgacgtgccggcctaccgcgcgagcagcgccgaggaactgcccgccgccatcgacgcctggctgagcgaccccaagtcctccctgctggaagtggtcgtaccgcacgaacacggcgtgttcccgatggtcccggcgggcgcggcgctgcacgagatgatggaaaccgagccggtccgcaccgacatcagcgcggaggccaccgaggtcaacgaagccacctggcaggaaatgaccgagcaggaagccgaggagatgaatcagggatga

SEQ ID NO: 24288 - DNA, 795 bp, Deinococcus radiodurans
atgcaacttgccatcgtcggtgtcggaaaactgggcctgtctctgctgaccggggtcatcgcccggggagtcatcgcgccgcaggacatcgggattatcgaggccaacgcggcgcgggcgcaggacatcgccgcgcagaccggcgtgcaggtcattacgccgccgcagctcgcgcaggtcgggcgcatcgtggtgagcgtgcagccgcgcgtctttcccgaggtcgcgccctggctggcgcaggaaaacgcgggctacatctccaccatggccggggtcagcgccggcaccatcgggcggcggctcggcacccggcgcgtggtacgggtgatgcccaacctcgccgccaccatcgggcgctcgcagaccgccatcaccgggccgcgtgaagcccacgaagcgggtgacatcgccttcgccgagcagctcttcggcgccgtcgggcaggtgtacgagttgcctgagcacctcttcaacgcctttaccggcatgagtgcgtcggggcctgcctacgtcgccgtcgtggccgaggcgctggcagacggcggcgtgcggatgggcttgccgcgtcccctcgccaatgaactcgccgcgcggctgctggcgtccactggcgagctgctgctggagcgggcgcatccggggctgctcaaagacgaggtggcgagtcccgggggcactacgattgccgggctagaggagttggaagcggcgggcgtgcgcggcggcgtgatgagggcggtggtggcggcgacgcggcgggggacggagctggggaaggaccaggaggattga

SEQ ID NO: 24289 - DNA, 849 bp, Deinococcus radiodurans
gtgctctacactgcccgaatgcaagaacagccctggagcattcccggtacgccggtcaccggctacgtgtgggccgccgagtcgccccgcgccgccgtgctgctcacccacggcctcggtgagtacgcccggcgctacgtggaccacttcggcgccctgatcccgcacctcgtgcaggcggggtacacggtctacgcctacgaccagcgcggacacggcaattcgcccggcgagcgcggcttagtggacaccgcgccgctgctcgaagaccacttccgtgcccgtgaagcgctgcggagccagccgctccccgtttacaccttcgggcacagcctcggcggcctgattacggcggcgagcgcggcccgcgacccgcgtggcctgagcggcgtgatcctgagcagcccagcgcttctcatcggcgagggccagcctcagctcaccaaggcactcgccccgctgctcgcccgcgtcgcgccgcgcctgccggtcagcgaactgggcaccgacgccctgtcgcgccgcagcgatgaagtccgcgcctaccaggacgacgaaaacatctaccacggcaaggtcacggcccagaccgcctggaccatgctccggctcagtggcgaactgtggcccgactacgtgcgctggcagttgccgacgctggtggttcacggcgaccaggaccagctggccgatgtcaaaggctcgcagcggttcatcgaaacgattcctgccgccgacaagaccctgcgcgtgttcgagggcggctatcacgaactgctcaacgacgagccgagcgacgaggtgaggcagatcattttggactggctggccgcgcatacggcgggctga

SEQ ID NO: 24290 - DNA, 1293 bp, Deinococcus radiodurans
ttggtcggacgaccggcgggggttggagtagagtgggcaagcatgagtaagcacatcaaggtgcccgaacagggcgaaaagatcacgatgcagaacggcaagctgaccgttcctaaccgccccatcattcccttcgtggaaggcgacggcaccggccccgacatctgggcggccagcgtgcgcgtgttcgacgcggcggtggaaaaggcctacgggagcgagcgcaagctcgagtggatggaagtctacgcgggcgaaaagtcgctggaggtctacggcgccaacgagtggctgccgcaggaaacgctgaccgcgttccgcgactacctcttcggcatcaagggcccgctgaccactccggtcggcactggcatccgcagcatcaacgtggcgctcaggcaggaactcgacctgtacgcctgcgtgcgcccggtgcagtacttcaacggcgtgccgagccccgtcaagcgccccgaagacatcgacatggtgatcttccgtgaaaacaccgaagacatctacgccggcatcgagtggaaggccggcaccgacgaagccgagaaggtgcgcggcttcctgatgcgcgaaatgaacgtcaccaagattcgtttccccgacacctcctcgttcggcgtcaagcccgtgtcgaaggagggcaccgagcgcctggtgcgcgccgccatcgagtacgccatcgaaaacggccgcaagagcgtgagcctggtccacaagggcaacatcatgaagttcaccgaaggtggcttccgcgactggggctatgaactcgccaagcgcgaattcggcgcggtggaaatcgacggcggcccctggtgccagctcccgaacggcatcgtcatcaaggacgtcatcgccgacaacttcctccagcagatcctgctgcgtcctaccgagtacgacgtgatcgccaccctgaacctcaacggcgactacatctccgacgcgctcgccgcgcaggtgggcggtatcggcatcgcccccggcgccaacattaactacgtgaccgggcacgccatcttcgaggcgacccacggcaccgcgcccaagtacgcgggcaaaaacgtcatcaacccttcttcggtgatcctctccggcgaaatgatgctgcgttacatgggctggaccgaagccgccgacctgatcctcaagggtctggacgccaccattcagcagcgcgtcgtgacctacgacttcgcccgtggcatggacgacgccaccgaagtcaagaccagcgagttcgctgacaagatcatcgagaacatgcgcaacgcctga

SEQ ID NO: 24291 - DNA, 1269 bp, Deinococcus radiodurans
gtgcattcaaacctgaccccatcttccttagaccctcagaccgaaaccggaggtttccccatgaccagcaccctttcccgcccggcccagaaccccaacctcaccccgcagaacgacgaccagcgcaccgtcctgagcagcctcaaggccttcctgaaaaacaaggtcgagcccggcgccgccgagcgtgaccagaccggcgagtttcccttcgagatcgtcaaggaactcggcgcgatgggcatcatgggtgcccagacacccgaggagtacggcggcgcggggctcgacagcgccaccttcgccatgatcatcgaagaaattgctgcggtggacggctcgctgtgcctgaccgtcgcctcgcacaactcgctgtgccagggccacatcctgatcggcggcagcgaggagcagaagcgcaagttcctgcccgacctcgccagcgcgcagaaactcggcgcctggggcctgaccgaacccggcagcggctcagacagcggcggcatgttctccaacgccaaggagcaacccgacggttcgtggattctgaacggctccaagaacttcatcacccagggcagcgtggcgggcacctacgtggtgctggcgcgcaccgaccccgcccgcgaaggcaagggcaaaaacgacggcatcagcgccttcgtgttcaaccgcgacgaggtgcagggcttttcgattggccgcaaggaagacaagctgggcctgcgctcgtccgataccgcgcagctcatcttcgaggacattcacctgcccgccgatgccctgctgggtgagcgtggcaacgccttcaaggacgtgatgcgggtgctcgacggcggacgtgtgggcatcgccgcgatgggcctgggcctcgggcgcggcgcctatgagtacgccgcccgctacgcgctggggcggcatcagttcggtaagccgattgcgtacaatcagaacattgccttccgcctcgccgacatcgacaccaagctggaagccgcccgcctgctgatccgcaaggccgccgacctcaaggacgcgggccagaacttcaccgtgccggtcgcccgcgccaagctgtacgccaccgtggtcggcgtggaagcctgcgacgaggcgattcagatgctcggcggctacggttacatcaaggaataccccgtcgagcggatgtggcgtgacaaccgcctgacccgcatcggcgaagggacggacgaggtgcagcgtctggtcatcagccgcgacgtgctgaagcgcttcgcgcaggactga

SEQ ID NO: 24292 - DNA, 1236 bp, Deinococcus radiodurans
gtgggctctgcggcagtcggcggcccccggccccacctatacttcccggcgatgagctttttttctcctccgtcggccagcgtcgccagcacactcgggcccaaaatcgcggtgctgtgccacaccggggcgggcggctccggcgtggtcgccaccgagctcggcttgaaagtggccgacgccgggcacgaggtgcacttcgtgggcaccgctatgccctttcgcctgaccggacaccagggcctgcgcgggccgtactttcaccaggtgggcggcttcgcctacgcgctgttcgagcagccctttcccgaactgagcgcggcaaacacgctctccgaagtcattctggaacacggcgtggacctcacccacgcccactacgccattccgcacgccagcgccgccctgcacgcccgctccatcaccggcaagacccgcgtgctgaccaccctgcacggcaccgacgtgacgctggtaggcaccgagcccgcctttcagcacaccacccgccacgccatcgagcgcagcgaccacgtgacggcggtgtcgcactcgctcgccgccgagacgcgcgaggtgttcggggtggaccgcgatattgaggtcattcacaacttcgtggacagtgaccgcttccggcgcattcccgaccccggcgtgcgcgcccgttttgcccaccccgaagaagccctgatcgtacatgtcagcaacttccggcccatcaagcgggtggaggacgtggtgcaggtcttcgcgcgcatcgcctccgagattccggcgcggctgctgatgatcggggacggccccgagcgtgcccgcgccttcgaactcgcccgcgaactcggggtcatcgggcgcacgcagtttctggggtcgtttcctgacgtgcagacggtgctcggcatcagcgacctctttttgctgaccagctcgcacgagagtttcggcctcgccgcgctcgaagcgatgagctgcgaggtgccggtggtggcgtcgaacgccgggggcattcccgaagtcgtgcagcacggcgtgaacggttttctgtcggacgtgggcgacgtggacgacatggcgcatcacgcgctcaagattctgcgcgaccaggaaacctatcagcagatgggacaggcggcgcggcgcacggcggtggagcagtttcacccgcgcctgatcgtgccgcagtacctcgcggcgtaccggcgactggccgagcagtccgcctccaccttttga

SEQ ID NO: 24293 - DNA, 1161 bp, Deinococcus radiodurans
gtgacgcgttcgaccctcgccgccgccgctagccgttatgatgctttttatgcacaacaggggagagcaatgacccagcaacacacaggtgaggtcctcctcgccgtcaacaacctcaagacctacttcaacaccgacgacggcgtcgtcaagagtgtggacggcgtgaccttccacatcaaaaagggcgaaaccctcgccgtggtgggcgaatcgggctcgggcaagagcgtgaccagcctgaccgtcatgcgcctgattcccatgccccccggccagatcgcaggcggcgagatcctgttcaccggcaaagacggggtgcagcgcaacctcgtcaacgtgtccgaagccgagatgcgtaggattcgcggcaacgacatctccatgatctttcaggagccgatgaccagcctcaacccggtctacaccgtgggcgaccagatcgccgaggcggtcgtgctgcaccagggcaagacccgcaaggaagcgatggacgtggcgactgacatgctgcgcttcgtggggattccggcgcccgaaaagcgcgtcaacgagtatccccaccagatgtcgggtgggatgcgccagcgcgtgatgatcgccatggcgctctcgtgcaagcccgcgctcctgatcgccgacgagccgaccaccgccctcgacgtgaccatccaggcgcagattctggacttgatgcgtaacctgcaacgggaagtgggcatgagcattctgtttatcacccacaacctcggcgtggtggccgaaatggctgaccgtgtggtggtgatgtacggtgggcgcgtggtggaagaaggcgacgtgatcgagattttcaaggcgccgcgccacccctacaccatgggcctgctcaactccattccccgtcccagcgaagacgagcacgcccacgtgcccgggcagcccaaaaagcgcctggaagccattcccggcaacgtgcccaacccgctcaacctgccccccggctgcaccttcgagccgcgctgcaagttcgccgtgccccagtgctcgcaggccgtcccggcgctcgaagacacggggggcggccacatggcccgctgcatccgctggcgcgaatttgaacaggttcagggcggccagccccataccggcaccggcctgagctccgaggtgaacgcatga

SEQ ID NO: 24294 - DNA, 918 bp, Deinococcus radiodurans
atgctcgttaccggtaaagacattctggttcccgcccgcgcaggcaaatacgcggtcggtgcgttcaacaccaacaacatggaaatcacccaggccatcatccacacggcggaaaaactgcgctcgcccgtcatcgtgcagatgagtgaaggggccatcaagtatggcggccaggacctcgccaacatcgtgatcgacctcgcgacccgcgccaccgtgcccgtcgcgctgcacctcgaccacggctcctcctacgagtcggcactcaacgccatcaagatgggctttacctcggtgatgatcgacgcctcgcaccaccccttcgaggagaacgtccacgaaaccaagcgcgtggtcgaagccgcgcacgccatgggcatcagcgtggaagccgaactcgggcgcctcggcggcatcgaggagcacgtcgtcgtggacgagaaggacgccttcctgaccgaccccgacgaagccgtcaagttcgtcgaggagaccggcaccgattacctcgccatcgccatcggcaccagccacggcgcgtacaagggtaagggccgcccgtttatcgaccaggcgcgcatcaagaagatcggcgagctgctcagcattccgctcgtcgcgcacggctccagcggcgttccggcggaaatcgtgcagcgtctgcgcgcagcgggcggtgaaatcggcgacgcagcgggcattgccgacgaggacctgaccgaagccgcgcagtacggcatcgccaaggtgaacgtggacaccgacctgcgcctcgccagcaccgtgggcattcgcgaagtcctcaaggccacccccaaggaattcgacccccgcaagattttcggcccggcccgcgacgtgatgagccagattgtcgagcacaagatgggcgtgctcggcagcgtcggcaaagcctaa

SEQ ID NO: 24295 - DNA, 1107 bp, Deinococcus radiodurans
ttggttatgaaaatcggcatgatcgggctgggcaagatgggcggcaatatggtgattcgcctcaagaacggcgggcaggacgtggtcggttttgaccgcagccaggaagcgattgaccacctcgtgtcgcagggggtcgcggcggacgcgctgacgagtgacatggaccgttttatcgagctgctcggcgaacccggtcagcgagcggtgtgggtgatggtcccggcgggccagattacccagtcggtcatcgacgacctcgcgggccgcctcagcgcgggcgacgtgattatcgacggcggcaactccaactttcacgacacccagcgccggggcgaggctctggcggccaagggcctgcacttcgtggacgtgggcacttccggcggggtgtggggcatcaccgagggctatggcatgatggtgggcggccccgacgagggtgtggagcgcatccgcccggcgctggaagctctggcgcccgcgcccgaccggggctggggccacatggggccgaccggcagcgggcactacgtcaagatggttcacaacggtatcgagtacggcatgatgcaggcctacgccgagggcttcgagctgatgaaggcgcaccagaccttcaacctcgacatggctcagattgccgaagtgtggcgtcacggcacggtgattcgctcgtggctgctcgacctgaccgccgaggccctgaaaaacagcgccgacttcgaccagctctccgactacgtggccgattcgggcgagggccgctggacgattatcgactccatcgaactcggcgtgccgaccccggtgattacgctcgccacccagatgcgcttccgcagccagcaggacgtgagctaccagggccagatgctctcggccatgcgccgcgcgttcggcgggcacgcggttaagacgctggaagcaaccaagcaggaaagcgtggtgccagcggtcaaacccggcgaaagccccaaggccgccgcgcccgagaacatccccaccgccgccgcgcagcccagcatcagcggacgcagcgaagcgcaggaactcggtgaaaccgggcagcagcgcaccaccggcgaccagaaggcgggcgaatga

SEQ ID NO: 24296 - DNA, 1773 bp, Deinococcus radiodurans
atgaccgaccggccccgtcccaaaaagagcagtccgaaaaagagtggccccgagaaggccctcgccaaggaaagtgccgcgcagggcgaggcggccaaggcgacccggcaggccactcagcagaccgaggcggccaagaaggtcggtgtggcccagcccggcgctccggcgcagtcccgcaaagcggcccgcaagtcacgccagcgggtgcccaagcacgccggggacaatgcccccaaaagcgacgcgcccggcgccgacggccagaatccctttcgcaccgccatgcgccgcagccgcgcgcccgaacctgccacgctggtgattttcggcgcgaccggcgaccttgcccggcgcaagttgctgcccgccgtgttcggcctgtggcaagacggcctgctcggcagcgcgttcaacatcgtcggcgtgggccggcaggaaatggacgacgagcagttcaaggactacgccatagacgccctgaagacctccaaggaaaccgacgaaatcaaggaaggcagcctggaaaagttccgcgagctgctctactacgaatacggcgaattcggcgaggacgaggtgtacgacaaggtccgcagtgaactcgaccgcgccgagaccgcccgtggcggcggcaagaacgcgctgttttacctctccaccccgccgagcctcttcgagccgatttcgagcggcctggggcggcagggcctgcaagacgagacggaaggctggcggcgcatcgtcatcgaaaaacccttcgggcgcgacctgcaatcggcccgcgaactcaacgacgccattcaccgcgtctgggacgagtcgcaggtgtaccgcatcgaccattatctcggtaaggagacggtgcagaacctgatggcgatccgtttcgggaacgccattttcgagccgctgtggaaccgggggtttgtcgaccacgtgcagatcacggcgtccgaggacctggggctggagggccgcgccgggtactacgaggaagcgggcatcgtgcgcgacatgctgcaaaaccacctgatgcagctttttaccctgaccgccatggaagcgccctcggcgttcgaggccgacgccatccgcgacgagaaggtcaaggtgctgcgggccgtcaagcgcattccggcggaccgggtgcccgaagtcgccgtgcgcgggcagtacggccccggcgccctcgacggccagaccgtgcccggctacaagcaggagccggacgtaaagcgcggcagccgcacgcccacctacgtcgccgtcaagctcgaggtggacaactggcgctggcagggcgtgccgtttttcctgcgcaccggcaagcgcttgcccaagaaagtcaccgaaatcgccgtggtgttcaagcgcccgccgctgggcctctttcccggcggactggagcgcaacgtgctggccttccgcattcagcccgacgaaggcgtgagcctgaagttctcctccaaatcgccggggcaagagatggtgctgcgcgaggtcgtgatggatttccgttacgacgccttcggggcacagctcgaaagcccctactcgcgcttgctgctcgacgcgatgctcggcgacgccaccctctttccccgcgaggacgaggtggaccacgcctggcaaatcgtctcgggcatcttgcaggcctgggaaggcgcggacgcggcggcccccaaattccccaactacgcggcgggcacctggggccccgacgccgccgatgagctgctcggccccggacggcgctggaggcggctgtga

SEQ ID NO: 24297 - DNA, 582 bp, Deinococcus radiodurans
atgcagtcattggtcgaggcgattaagcgcgaaggcagggttcttccgggcgggtttctcaaagtagacggattggtcaaccaccagcttcaccccgcgctgacccgcgagatgggggagacgttcgcccggcattttgcgccgctcgcgccgaccaaggtgctgaccatcgaggtgagtggcattgccccggccatcatgaccgccgccgagctcggcgtgccgatggtctacgcccgcaagaaaaagccgctgaccatgagcgagcaggtctacacggcgcagtcggtcagccgcaccaagggcggcacggtggacctcttcgtcagctccgagtacctggggccgcaggaccgcgtggtcgtcatcgacgactttctcgcctcgggcggcaccctgcgctcgctcagtcagatcatcgccgacagcggcgcgaccctgctcggcctcggctgcgtcatcgaaaaggaattcgaaggcggacgccagcacctcgccgacctgaacgtgccgattcacaccctcgccaacatcgtgcggatgagtgaggaagaaggcatcgtggtgcaggccggacgctga

SEQ ID NO: 24298 - DNA, 2058 bp, Deinococcus radiodurans
atgacacaatccactgctcagagcagcaacccgctgctgaatatcggtttcaagattcctttcgaccagattcgccccgagcacgccgaacctgctgtagacgagttgctggcagcggcacgggagcgcgtggaaaacttggcccgttccggcgaacgcaacttcgagaacttcatggccgacctcgacaccctcaccgagcagctcggcaccgtgaacaccatcgtgcaccatctcgacagcgtggtcagcagcgacgagtggaaagccgctaccgaggccatcatccccaaaaccacgcagttttataccgaactcagcctgcatccggggctgtggggggcgctcaaggcgtttggagagacggacaccgccaaggggctcgacccggtgcgtgcccggcacctcaagctgaccaccgacgaattccgccggggcggggccgacctgcccgacgaccagaaggcgcggctgctggaagtgaacaccaagctcgcccagacgaccaaccagtttgccaagaacgtgctggacgccactgccgcctacgaactgtacgtgcccacggagcgcctggggggcgtgccgcagcgcgtgcaggacgcgacccgccaggacgcccagagcaaaggccaggaagaccaccgcctgacgctgcacgcgcccacgctgcaacccatcctgacctacgccgacgaccgcgaactgcgccgcgaactgtgggaagcgagcggaatgctggggcagcaggaaggccgcgacaaccgcccgctgatccgcgagattctgaagctgcggcgcgagcaggccgagattctgggcttcgccaactttgccgactacgtgctggaagaccgcatggcgaagtcgggccagggcgccctaaacttcgagcgcgacctcgacgccaagacccgccccgcctacgagcgcgaaaacgccgagctggaggcgtactaccgcgagaaggccggagccgacgcgcccgccctggcgccctgggacattgcatactgggccgagaagcagcgtcaggaaaagtacgacttcgacgaggaagccctgcggccctacttcgcgctcgacaacgtgctctcgggcctgttcgaaatctgccgccgcgtcttcggcatcacggtgaaagaagcccaggcccccggctggcaccccgaagttaagttctacgacatcttcgacgaggcgggcacccacatcgccagcttctacaccgactggttcccacgcgacactaagcgcggcggcgcgtggatgaacgcctttatcaccggcggcccgaaagaaggcggcgtagacccccacctcggcctgatgtgcggcaacatgactccgcccagttcaggagggcagggcgctgatgcccccgccctgctgagcatccgcgaggtggaaacggtgttccacgagttcggccacctgctgcaccacgccatgagccgcgtgccggtcaagtcgctcagcggcaccaacgtcgcctgggacttcgtggagttgccctcgcaaattatggagaactgggtgatggagcgcgaggccctcgacctctttgcccggcactaccagaccggcgagaaactgcccgacgacctgttccagaagctggtgaaggcccagaactaccgcgccgcgaacttcgccatgcgccagtactccttcggcctgaccgacctgacgctgcacgtcgagtacgaccccagcggcgaggaagacccggtggccgtggcccgcgacgtgatggcccgcttttaccccactgagctgccagggaactacgcgcaggtcgccagctttaaccacctgttcagctcgccggtcggctacggcgcgggctactactcctacaagtgggccgaagtgctggacgccgacgccttctcgcgcttcgccaaggaaggcatcttcaaccgcgaaacgggccgcgcctacgtggacagcattctcagccgggggggcagcgcagaccccgccgcgctctaccgcgagttcatgggccgtgaccccgacgccgacgccctgctgcgccgcagtggcctgctgtaa

SEQ ID NO: 24299 - DNA, 1002 bp, Deinococcus radiodurans
  unsure (1)..(1002): unsure at all n locations
atggcgaaataccgcatttgtctcatcgagggcgacggcatcgggcacgaagtgattcctgccgccaagcgcgtgctggaagccgccggcttcgacgccgagtatgttcacgccgaggccggctacgaatacttcctcgaccacggcaccagcgtgccagaagccacctacgacgcggtggaaaacaccgacgcgaccctgttcggcgcggcgaccagccccagcggcgaaaagcccgccggattcttcggcgccatccgtcacctgcgtcagaagtacaacctgtacgccaacgtcaggccgaccaagacccgcccggtgccccactcctacgagaacgtggacctcgtcatcgtgcgtgaaaacacccagggcctctacgtcgagcaggagcggcgctacggcgataccgcaattgccgacaccgtgattacccgtgaagcgagcgaccgcatcggcaagtttgccgccgacctcgccatgaagcgcagcaagcgcctgacggtggtccacaagtccaacgtgctgccggtgacgcagggcctgttcatgaacaccatcctcgaccacaccaagaccgtcgagggcctctccacgagcaccatgatcgtggacaacgccgccatgcagctcgtacgcaacccgcagcagttcgacgtgatggtcatgaccaacatgttcggcgacatcctctccgacctcgccgccggtctggtgggcgggctgggcatcgccgcctcgggcaacgtgggcgaccagttcggcatcttcgagtcggtgcacggctcggcccccgacatcgccggtcagggcatttccaacccgaccgccaccatcctggccgccgtcatcatgctcgaccacctcggcgaccacgaaacggcccgccgcctcgacaacgccatcaacaaggtgctcgccgaangcccgcgcacccgcgacctcggtggcaccgccggcacgcaggaatttaccgaggccgtcatcaaggcgctggcgtaa

SEQ ID NO: 24300 - DNA, 1308 bp, Deinococcus radiodurans
gtgcatttcgggggtcgagtgcccctcttcctttcttgctgccgtcttcatctttcgggggtccccatgaaaccacgtgttctcggcatgattctcgcgggtggtcagggctcgcgcctggccccgctgacgcagaaacggtccaagcccgccgtgccgtttggcagcaaataccgcatcatcgacttcgccatcaacaacttcatcaactcgggcatgttctcggtctacgtgctgacccagtacaaggcgcagagcctcaccgagcacattcagcgcggctggcgcttcggcaccttcctgagcgactacttcatcacgctcgtgccggcgcagatgtatcgcttcgaggaactcggcgacgcctggtaccggggcaccgccgacgccgtgtaccagaacatgcacctcatcgacaacttcgaggccgactacgtggcgattttttccggtgaccacatctacaagatgaacgtggaacacatgctggaaaaacacatcgagacgcgggccgacgtgaccatcgccgcttacccaatgccgcagtcgcaggcgcaccagttcggcgtgatgcaggtggacgagcgctggcgcgtgaccgagttccacgagaaggtgcccgacccgcccaccatccccggtcaagccgacctgagcctgacgagcatgggcaattacatcttcagccgccgggcgctcgaagaactgctcgaagccagcatcagcgggcaggaaaccggctacgacttcggccacaacgtgattccgcgtgcgctctccgacggctaccacgtccaggcctatgacttccacaaaaatcccatccccggtcaggagcgtcccaacacctactggcgcgacgtgggcacgctcgacgcctacttcgaggcgaacatggacctcgtgtcggtcaaccccgagttcgacatctacaaccccgagtggccgctgcgcaccagcagcgaattctcgccgcccgccaagttcgtgcacgagtccgagggccgcaaggggcaggcgttcaactccatcatggccgggggcgccatcatcagcggcggcaccgtgcgcgacagcgtgctcgggcgcaacgtccgcacccactcctactcgctggtcgaaagctgcgttctgttcgacgacgtgcaggtgggccggcactcgcacctgcgccgcgtcatcgtagacaaggacgtggtgattccgcccggcaccaccatcggcctgaaccgcgagcacgacgagcagcgcggcttcaccgtcaccgagcacggcgtggtcgtggtgcccaaggggtacgtgttctga

SEQ ID NO: 24301 - DNA, 1755 bp, Deinococcus radiodurans
atgacctcaattcctgctgttcccgctgctccgtccggttccctgccccggccctggctcacctcctacgaacccggcgtgccgcaagacctcgcgcccagcagccgcaccctctaccgcctgctcgaagacgcggccacccgctaccccaaccgcgaggcgctgcaattcctgggtcagggcaccaccttccgcgagctgctcaagcgggtgcgccgctttgccaaggcgctgcaacgctcgggcgtgcagcagggtgaccgggtggcgatcatgctgcccaactgcccgcagttcgtggtggccttctacggcaccctgctggcgggcgcagtggtcgtgaacaccagcccgctctacaccgccgccgaactcgagcaccagctcagcgactcgggcagcgaaacgctggtcattctcgacagcctgtatccgcgctacgccgaagttgcggacaaggtgccggtcaagcgcgtgctggtcagccgcattcaggacgagctgccgttccccaagaacctgctctttcctatcaaggcgctgaaggaaggcacgctggcgagcgactcgttcaagcgcaatccccgcgccgtgccgatgcgcttcgtcacgaagctgcaagaccccgacccggtgtcggtgccgatcacggcggacgacgtggcgctgctgcaatacaccggcggcaccaccggcgtgcccaagggcgcgatgctgacccaccgcaacctggtggcgaacgccgaacagtgccgctcgtggatggtcgggctgcaagagggccgcgaaatcaccatggccgccattccctttttccacgtgtacggcatgacggtcgccatgaacctgagcatgctgatcggcgccacgctggtgctggtgcccaacgcccgcgacatcaagatggtgctcgacgaaatctcgcgcacccgcgccaccatcttccccggcgtgcccacgctctacaacgccatcaacaaccatcccgacaccgccgcgcacgacctgaccaccatccgggcgtgtatcagcggctcggcgcctctgatgcaggacaccgcccgcaccttccgtgaaatcacccagggcgccaacctggtcgaagggtacggcctgaccgaaaccagcccggtcacgcacgtcaaccccatcaccggcgagcagaaggaaggctccatcggcctgccgctgccgggcgtggacgcgctcatcatggacgacgcgggccagccggtgccgaccggcgaagtcggcgagctgtgggtggccggcccgatggtcatgaagggctactggaacatgcccgatgaaaccgccaaggtgctgcgcgagtacgccggcaagacctggctgctgaccggcgacatggcgacgatggacgagcagggctttttccgcatcgtggaccgcaagaaagagctgattatcgcgggcggccacaacatctacccccgcgaagtcgaagaagtgctgacctcgcaccccgccgtgctcgaagccgccgccgtggggctgcccgacccttaccgtggcgagaccgtgcacgcggtggtggcgctcaagcccggcatgcaggccaccgagaaggaaatcatcgcctactgccgcaccctgctcagcgcctacaaagcgccacgcagcgtggaattccgcgacgagctgcccaagacggcggtcggcaagaccctgcgccgccagctcgctgccgaggcccgtgagcgactgaagaaggaaaaggctgagaagtcggcctga

SEQ ID NO: 24302 - DNA, 1644 bp, Deinococcus radiodurans
atgcccacccccatccacgtcctccccccccacgtcgcccgcctcatcgctgcgggagaagtggtctcccgcccgctcgatgtggtgcgcgaactggtggaaaacgcccttgacgccggggcgagccgcatcgaaatcgaggtggacggcggcggcctggagcgcgtgcaggtacgcgacaacgggtccggcatcgcggcacagtcggtgccactggcccccgcccgccacgcgacaagcaagctgacggctggccccgaaaccggcagcctgagcgttaccaccctcggcttccggggcgaggcgctgtgggcggcggcgcaggcgggcgaactcgaactcacgacccgcccggcagcgcaggtgggggcggcgcggctgcgcgctcagggcgacgcggtggaggtcagccgcacctcggcccccgctggcacgacggtcacggtatcccagctctttgcccggctgcccgcccgactgcggacccaggcaagtgcggcggcggaagtccgtgacatcaccgcgctcctcgggcgctacgtgctgcaccactcggcgctgcactggcggctgacggtggacggcgacccccggctgacccacgcgcccgccgaccaccggggcgcggtggcgacggtctacggtccgctgagcgccaaccgcgtgctgacgctggacacacccggcgtgcgcggcgtggtgtcgcgtcccgaactgacgcgggcgcggcgtgaccggatgcacttcgcggtcaacgggcggcccatcgtggcgccgccggaactcgaacgcgccgtgatcgacgcctacgccgagttgctgcccgccggcaccgcgccgctgtgcgtgctcgacctgacggtggcgcccgaggattacgaccccaacattcaccccgccaaacaggtggtcgcgctcgctgacctgcctgccgtggcgctgcgggtgcgcgacgccgtcgctggtgccctcgctgggcatccgctggtgagggcagccccggccctcatcgcgccgcccgagccacatccggcgcccacggcgggcaactttcccgacctcaccctgctcggcgtctatcaggagctgtacctgctcgcgcagggcgagggcgacctgtgggtggtggacgcccacgccgcgcacgagcgggcgctgtatgagcggctgggacgcgaactcgggacggcggctccgctcgaactgcccacgccggagctgctgcacctgacgcccgagcagaccgcccggctgcacgaacgcggcgccgagttgcgcggctggggcctgaccatcgaggatttcggcgcggggctggcacggctgcggaccctcccggcggcgctggcggccctgccggtgccccggctgcatgaagtggtggtggaaacggccctttccggtggccccgacccccggcgcgaggtgctggcgcggctggcgtgtctgcccgcgctcaaggcgggaatgctcgacgctgagcgcggcgcgctggttctggccgccctacgcgagtgcgagcagccctgggcctgtccacacgggcgccccaccgtgctgcggctgtccgagcgcgacctcgcccacgccttcgggcggcgcggcgtgcgggatgtggcgcgggggcgtgacagcgtggtttga

SEQ ID NO: 24303 - DNA, 1170 bp, Deinococcus radiodurans
atgaccgagcctttgcctgacgtgacctttccccagggctttcgcgccgccgcgatggccgctggcatcaaaccgagcggcaaacccgacctgagctgcgtggtcagcgagcgtgactgcgcctgggccttcgcgggcacgcgctccacgactgccgccgcctgcgtgacccgcaaccgcgagctgtacgcgagcggcgccccgctgcgcgccctggtggtcaatgcgggcgtggcgaacgcggccaccgggcaacaaggagcacgggacaacgcggacatggccgacgccctggcgagcgtgctggcggtgggtgaggccgaggtcatcaccgcgtccaccggcgtcatcggccacctgctgccgatggacaaggtgctcagcggcgtggagcatctgcccgaggagcttgagggcgcagcgctgccctttgcgaccgccatcatgaccaccgacacccggtccaagctggcgcacgtcaccctctccaacggagcgcgcatcgtcggcacggcgaagggcagcggcatgattcaccccgacatggcgaccatgttcgccttcgccttcaccgacgcgcaggtggatcaaggggcgctgcgtggggctttccccgccatcgtcgcccggaccttcaacgcggtgacggtggacggtgacacctccaccaacgacatgacggcggtgctcgccaacggcgcggcgggggagaccgacctgaccgagttcctgacggcgctcgaaggcgtgatgcgtgacctcgcccgccagattgctgccgacggcgagggggccacccggctgctcaccgtgcgcgtgacgggcgcggcgagcgaagccgaggccctgggcgccgcccgcacctgctgcgtcagcccgctgctcaagagtgccgtgcacggcgccgaccccaactggggccgcgtcatcatggcggtgggccgcagcggggcgggggtgaaggtggaagccatgaaagtcagcgtgcagggcgtgcctgtctttgccggagggccgctgaactacgacgcggcggcggtcagccagagcatgaaaaccgacgaagtgattttcgatgtggacctcggtgtcggcagcgcgcggggcgaggcgtggggctgcgacctcagcgccgagtacgtgagcatcaacgccgattacacgacctga

SEQ ID NO: 24304 - DNA, 1275 bp, Deinococcus radiodurans
ttgcaggcggtgaccgaggtgatgaccagcatctggccctttgtgcaggcgcaccccgagtacgccgagcacgcgctgcttgagcgccttatcgagcccgagcgcgtcatcagcttccgcgtgacctgggtggacgacgccgggcaggtgcaggtcaaccggggctaccgcgtgcagcacagttccagcatcgggccatacaagggcgggatgcgctttcaccccagcgtcaacctcagcatcctcaagtttctggccttcgagcagaccttcaaaaatgccctcaccaccctgccgctcggcgggggcaagggcggcagcgacttcgaccccaagggcaagtccgacggcgaggtcatgcgcttttgtcaggcattgatgaccgagctgtggcggcatctcggtcccgacaccgacgttccggcgggcgatatcggcgtgggcgggcgcgaggtcggctacctcgccggcatgatgaaaaagctcgccaaccacgcgggtggggtatttaccggcaagggcctgagctacggcggctcgctgctgcgccccgaggcgaccggctacggcacggtgtatttcgtggagcacatgctgcgcgaccagaggatggagatggagggcctgcgcgtgtcggtgtcgggctcgggcaatgtggcgcagtacgccatcgaaaaggcgctgcacctcggcgcccacgtgctgaccgccagcaactcgggcggcacggtggtggacgaggacggctttacctacgacaagctcgccgtcctgatggacatcaagaacgagcgccggggccgggtggaggactacgcccgcgaggtcggcgccgagttccgccccggcgtgcgcccctgggacgtgccggtggatgtggcgcttccctgcgcgacccagaacgaactcggcgccgacgacgcccgcaccttgattgcaggcggcgtgcgcgtggtggccgagggcgccaacatgccgtgcgacctcgcagccatccaggccttcgaggaagcgggcgtgctctacgcaccgggcaaggcgaccaacgcgggcggcgtggcgacctcgggcctggaaatgtcgcaaaacgcccagcgcctctcctggacccgcgaggaagtggaccagcgcctgcgcagcatcatgtcggccattcacgattcgtgcctggagtatggccgccgcccggaccgccacgtcagctacctcgacggcgccaacattgcgggcttcgtcaaagtggcgacggcgatgcgcgaacagggcgtgctgtaa

SEQ ID NO: 24305 - DNA, 2721 bp, Deinococcus radiodurans
atgagcgacaaggcgatgaacctgtttggcgcccgtgacaccttgcaggtgcccggcagcgacaagaagctgtacttttacaacctcaacaagctccagggccacgacgtgtcgcgtctgcccgtcagcatcaaggtgctgctggaaagcgtgctgcgcgaagccaacgactatgacgtgcgccgtgaagacgtggaaaccgtcgccggctggagcgccaccaaccccgaagtcgaaattcccttcaagcccgcccgcgtgattttgcaggactttaccggcgtgcccgccgtggtggacctcgccgccatgcgcagcgcgatggtcaagctcggcggcgaccccagcaagatcaacccgctgattccggtggacctcgtcatcgaccactcggtgcaggtggacgagttcggcaccgagttcgcgctcgccaacaacatggcgctggaattcgagcgcaaccgcgaacgctacgagttcctgcgctggggccagcaggccttcgacaacttcggcgtggtgccccctgccagcggcatcgtgcaccaggtcaacctggaatacctcgccaagggcgtgcagagccgcgctgaagacgacggcgaagtcgtgtaccccgacagcctggtcggcaccgactcgcacaccaccatgatcaacggcctgggcatcgtgggctggggcgtgggcggcatcgaagccgaagcggtgatgctgggccagcccatctacatgctgatgcccgaagtcatcggcttcaagatcactggcgcgatgcccgaaggcgccaccgccaccgacctcgcgctgcgcgtgacccagatgctgcgcgagaagggcgtggtcggcaagttcgtcgagttctacggcgcgggcctgagcaacatgaccctgcccgaccgcgcgacgattgccaacatggcccccgaatacggcgccaccatgggctttttcccggtggacgacgaagcgctgcgctacctgcgccgcacgggacgtctggaagacgaaatcggtctggtcgaggcctactacaaggcccagggcatgttccgcaccgacgaaacgcccgaccccgtcttcaccgacaccatcgaactcgacctcgccaccatcgttcctagcctcgccggccccaagcgcccgcaggaccgcgtgaacctcagcgacatgcacagcgtgttcaacgaagcgctcaccgcgccggtcaagaaccgtggctttgaactcggcagcgacaagctggacgcccagggcaccatcggcggtaccgacatcaagatcggccacggcgccgtgaccctcgcctccatcacctcctgcaccaacacctccaaccccagcgtgctcatcgccgccggtctggtcgccaagaaggccgtcgagaagggcctgaagaccaagccctgggtcaagaccagcctcgcccccggctcgcgcgtggtcaccgagtacctcgaaaccgccgggctccagcagtacctcgaccagatcggcttcaacaccgtgggctacggctgcatgacctgcatcggcaactcgggcccgctgcctgaacccgtcgtcgaagcgattcaggaaggcgacctggtggtggcctcggtcctgtcgggcaaccgcaacttcgaaggccgcgtcaacccccacatcaaggccaactacctcgcttctccccccctggtcgtcgcctacgcgctcgccggcacggtcgtcaacgacatcgtgaacgacgccatcggccaggacagcaacggtcaggacgtgttcctgaaagacatctggcccaccaacgccgagattcaggaagcgatggaccgctccatcaacgccgagatgttcaagaaggtctacgacggcatcgagaagagcaacgccgactggaacgccatccccgtcgccgaaggcgcgctgttcgactggaaggaagacagcacatacatccagaacccgcccttcttcgacaccctcgcgggcggcgcccacgaaatcgagagcatcaagggtgcgcgcgccctggtcaaggtcggcgacagcgtgaccaccgaccacatctcccccgccggttcgttcaaggccgacacccccgctggccgctacctgaccgagcgcggtattgcccccaaggacttcaactcctacggctcgcgccgtggcaacgaccgcatcatgacgcgcggcacctttgccaacatccgcctgaagaaccaactcgcccccggcaccgaaggcggcttcaccaccaacttcctgaacggcgaagtcaccagcatcttcgacgcttccaccgcctacaaggaagcgggcgtgcccctcgtcgtgctggccgggaaggactacggcatgggctccagccgtgactgggccgccaaaggcaccttcctgctgggcgtgaaggccgtgattgccgaaagcttcgagcggatccaccgctccaacctggtcggcatgggcgtgctgcccctccagtacaagaacggcgaaaccgccgacagcctgggcatcaacggcgacgaaaccttcgagttcgtgctgcccggcgacctcaagccccgtcaggacgtgaccgtgaaggtcactggcaaggacggcaacacccgcgacatcaccgtgatgtgccgcatcgatacccccgtggaaatcgattactacaagaacggtggcatcctgcaaaccgtgctgcgcggcatcctgagcaagagccagggcgaagtcaaggcgtaa

SEQ ID NO: 24306 - DNA, 1338 bp, Deinococcus radiodurans
gtggtacctgctcctccctttctcggccacgcggcggagatggggaccatcaaactgcgtccctttctcacccgctgctatcaggcgtacggcccggtctttcaactcacggtgccgggccagaaaattaccgtgctcgccggtcccgaagccaacctgttcgccatgaaggaaggccaccgggtgctgcgctcgctggaggcgtggcgcgacaatgaccacgagatgggcagtgaccgctccatgatcagcctcgacggggccgagcaccgcgcttaccgccgggtggagggccgcgccttcgcgcgttcgttctttgcggcggggctgcggcccgcgctcgcggtgctggctgaagacctggctcccttccaacccggtgacgtgctgccggtggcgacctggtgcaagaaaaccatcaccgaacagctcgcacgcatggcggtgggcggcaccgtccggccctacctgcctgacctgctgcacttcatccagaccgcccttcaggtcacggtcaaccggcaactgccccccgccgtgctgcggctgcccaaataccgccgcgccaaagcccgcatctttcagatggtggacgacctgatcgaggaccaccgccagaacccgccggaaaagagcggacgcgcccccgacctgattgacgacgtgctggccgatcagcaggtcaaccccgagcgctgggagcatcccgacgtgcgcctcgccgcgctgggcgcctttatcgcgggcatggacacggcggccaacagcctcgctttcgtcctgtaccggatgcacctgcattccgaatttttgccggcgctgcgggccgaggccgacgcgctgttcagggacggtccccccaccgccgaggccctgggccgctcgccgctgctgcaccgctttgtgatggaaacgctgcgtgtccatcccatcgcccccgccctgagccgcacgctgaccgaggacgtggaattcgccgggcaccgcatccccgccggcacccccgtcatcatcgggaccaccgtgccgcatggcctgcccgaactgttccccgaccccgagcacttcgacccaggccgctttgcgccgggccgcgccgagcaccgtcagccgggcgcctacgcccccttcggtgtcggcagccacacctgcgcgggcagcggcatggccgaagggctgatcatgctgggcgccgccgccgcgctgcggaccctggacctgagcctggagcccgactacgtcctgcggcagaccgctaagcccacccccagcctcgacaacaagctgcaattgcgcgtcaacgccgtgcggcacaacccggtgtttctggtgcattga

SEQ ID NO: 24307 - DNA, 1437 bp, Deinococcus radiodurans
atgacccccgaaaaactcgccctcaccaccaattcccgcgcccgcaagccccgctcggacggcacgcccgacaatccgctggccgccgagctgacgcgcacgctggggcacaagaaagtgctgcatcacctttcagagcggctgaattaccgctacgacgccattcagttcggggttacgccgctggcggtggtattgcccgaaagcaccgccgacgtggtggcggcggtcaaggcggcgaaggcggcgggcgtgcccatcgtaggacgcggggcggcgagcggcctcagcgggggcgtgacgcccctccaggagtcgctggtcatctcgtttacccgcatgactggcctgcacattttccccgaacggcgcgaggcggtggcgcagcccggcgtggtgacactgaaggtgacggaagcggccaaaccgcatggactgatgtatccgcctgacccggcgtcttttcgcaccagcaccatcggcggcaacctgggcgaaaacgcgggcgggccgatgtgcttcaagtacggcgtgaccggcgattacgtgcgggcgctggaatttgtagatgtggacggtgacgtgcaccgcctgacgcgcgactgttacgacctcgccgggctgctgatcggctcggagggaacgctgggcctcatcaccgaggccacgctgcggctgattccgccgccgaaatttacccgcacgctgatgagccatttcgccgaagtcgggcaggccgccgaagccgtgagcagcgccattgcggcgggcgcggtgccatccaagctggaattcatggatagggcctgcgtaggcgcggtagaggactacctgcacctgggactgccacgcgacgcggatgcggtgctgctggtggacaccgacggagacgacgccgaaatcgtggctgccgaactggaactggtggcgcaggcgtgcgcggcggcgggcggaacggtgcgccgcgccgcgaacgacgccgaggccgacgccctgtggcgagcgcgccgcagcatcagcccctcgctgggccgcattcgtccgcagcgcatgaacgaggacatcgtggtgccccgttcagcgctgcccgacgtggtgcgcgaaatccgtgcgctgggcgacgccagcccctttcacctcgtgcagttcggccacatcggcgacggcaacctgcaccccaacatcatgttcgacccgcgcaccgaggacacccacgctgtgcacgacctcgcgcacaaaatcgccctcgtcgccatccggcacggcggcgtgctgagcggcgagcatggtatcgggacgatgaaacgcgacttcatgcgcgacgcggtagacccggtgacgctgaacgtgctgcgcgacgtgaaacgggcgctggacccagcgaatggactcaatccggggaaaatcctgccggatttgttgatggacgagaggtga

SEQ ID NO: 24308 - DNA, 705 bp, Deinococcus radiodurans
atgaaacgccccgccggtgtgcggcgcttctggcgcgagtgggcggggccggtgtgctgggcgctgctcgtcacgcagttcggcgcctcggcggtgcgggtggacggcgcgagtatgctgcccgccctgcgccacggcgagtggctggcgctgcccaaagccgagggctgggtgcaccgcctgggtctgggcgagtaccagcgcggcgacgtcgtggtgttcaagccgccccgcagcgctgcttacgagtggacgaacgtttaccggggcgtgaacttgccctgggcgtatcgcccctacctcgtgaaacgggtggtcggtctgccgggcgacaccgtgcaggtgcgggccggaactctgtatgtcaacggccagcccgtgcccgagccccgcacgctgaattactgggcggcgttttgccacgacaccggcagtgacctcgccaacacgccgccgctgaaagttcccgccgcgcattacttcgtgatgggcgacaaccgcagccccggcggcagcctcgacagccgcgtcttcggcccggtccctgcctgggacgtggacagccgcgccgttgccagcctgtggccgctcgcccgccaggaagaagcccgccccgcctgcgacgagcagccccagccggaaaagcgggtgcagctgagcggccccgtgcagtggaatccgcgctggggttttggagggaggtaa

SEQ ID NO: 24309 - DNA, 1626 bp, Deinococcus radiodurans
atgagccgcctgaccgacctgcccgcctggcaagccctcgaagaccactactacgagctgcagggcacgcacctgcgtgagttgttcgctgccgacccggagcgcggcgagaagatgaacgccgagggggccgggctctacctcgactactccaagcaccgcgtgaccgacgaaacgctgcggctgctgcgggaactcgcgcaggcgacgggcgtggaagcgcggcgcgacgccatgttccggggcgagaaaatcaatgtgaccgaaggccgcgccgtgctgcacaccgccctgcgtgcgccgcgtgacgcggtcatcgaagtggacggaaaaaacgtggtacccgaggttcacgaggtcctagaccgcatggcgacgttcgcagacgccgttcgcagcggcgagtggctcggctacaccggcaagcccatcaagaacatcgtcaacatcggcatcggcggcagcgaccttggcccggtcatggcgtatgaggcgctcaagcactacgcccagcgcgacctgaccgtgcgcttcgtgtccaacgtggacggcaccgacctcaccgaaaagacccgcgacctcgacccggaagtgacgctgtttatcgtttcctccaagaccttcaccacccaggaaacgatgaccaacgcccgcagcgcccgcaaatggctgctcggctccctgaaagacgacgcggcagtgacgcggcacttcgtggccgtctcgaccaacgctgaggaagtgcaaaagttcggcatcgacaccgccaacatgttcggcttctgggactgggtggggggccgctacagcatggacagcgccatcggcctgagcctgatggtggcggtggggccggagcacttccgcgaaatgctcgccggcttccacgacatggacgagcatttccgcaccgcgcccgccgagcagaacctgccgatgctgatggggctgctcggcgtctggtacggcgactttttcggcgccgagtcgctggcggtgctgccctacgaccagtacctcgcctctttcccggcttacctccagcagctcgacatggagagcaacggcaagcacgtcaccctgggcggcgagccggtggactaccagaccgggcccatcgtgtggggtcaggcgggcacgaacggccagcacgccttttaccagctcatccaccagggcaccaagctgatcccatgcgatttcatcggcttttgccagaccctgaatcctttgcccccgcaccacgacctgctgatggcaaacgtgttcgcgcagaccgaggcgctcgcgttcggcaaaacgctcgagcaggtgctggcagacggcgtggcccccgaggtcgctccgcaccgcgtctttgaaggcaaccgccccaccagcacgattctggccgaccgcttgaccccgcgcacgctcggcgccctcatcgcgctttatgaacacaaggtcttcgtacagggcgccgtgtgggacatcaattcttttgaccagtggggcgtagaactcggcaaggtgctcgccaagaagattgacggcgagttgcaaagcgagggcgagccggaattgcagcacgacagcagcacgaacgcgctgattcggcgctaccgggcgcggcgccaggggtga

SEQ ID NO: 24310 - DNA, 1140 bp, Deinococcus radiodurans
atgtcgctttcccgccacgccctgcaagacgccgcccaacgcttcggcacgccgctgtatctctacgacgccgaagaactcgacgcggcgctgtggcgggtgcagcgggccttcggggacgcgcgcatcttctacgccatgaaggccaaccccaacctgaacctgctccggcgctacgcggcggcgggcgtgggtttcgagtgcgtcagcctgggcgaactgctgcgggccgaagcggcgggcgcaggtggcgagcgcatgattctcaacggccccgccaagagtgacgccgagtacgcggcggcggcgcggctgggcgcgaccatcgtggtggaccgcgaggaagaggttgtgctgctgccgccgggctcgcgggtgctggtgcgtgtcaacccggccatgaccgtcagcacccatgaacacctcgccaccggcactgcccgcagcaagttcggcctgaccccggagcaggtgccgggcaccctcgccgagttgcgcgacgccgggcacgaggtgctggggctgcacatgcacatcggcagcgccatcgagcaggccgaggacttcacggcggcgtttgcccgcgtcaccgagctgcgggcgcatatcggcgggctgagcgtgcttaacgtgggcggcggctggagcctgaacgctgacctggaaggcatcgcctacgaggcgcacgaggcggcgcgggtcttcggggccgagctgtgggtggagccggggcgttatctggtggcgagcgcgggctggctgctcacccgggtggtcggcaccaagcgcaccgggcgcaacttctgcctggtggacgcgggcatgaccgagttcctgcggcccatgctctacggcgcgtcgcatccgctttatcccatgtgggacgcgctggcgaccgaggtctgggacgtggcgggcccggcgtgtgaaagcggcgacctgatcgcacggggcgtgccgctgccgacgccgcagcgcgggcacttgctccttatcggggaagccggggcctacggcgccagcatgagcagcacttacctttcgcgcccgcgccccgccgaggtgctgtggaccgggcacgactggcaacttctgcgccgccgcgagacgccccaggacatctgggcggcggaagtctga

SEQ ID NO: 24311 - DNA, 2238 bp, Deinococcus radiodurans
gtgacttcttccgccggccccgacctgctccaagccctcaaccccacccaggcgcaggctgccgaccatttcactggccccgcgctcgtgattgccggggcgggcagcggcaagacgcgcacgctgatttaccgcatcgcgcacctcatcgggcattacggggtgcatcccggcgagattctggcggtgacgtttaccaacaaggccgccgccgagatgcgcgagcgggcgggccacctcgtgccgggcgccggtgacctatggatgagcaccttccactcggcgggcgtgcggattttacggacctacggcgagcacatcgggctgaggcgcggctttgtcatctacgacgacgacgaccagctcgacatcatcaaggaagtcatgggcagcattcccggcatcggcgccgagacgcagccgcgcgtcattcgcggcatcattgaccgcgccaagagcaacctgtggacgcccgacgaccttgaccgctcacgcgagccctttatcagcggtttgccgcgcgacgccgccgccgaagcctaccgccgttatgaggtccgcaagaaaggccagaacgcgattgatttcggcgacctgattaccgaaacggtgcggctgttcaaagaagtccccggtgtgctcgacaaggtgcagaacaaagcgaagtttattcacgtggacgagtaccaggatacgaaccgggcgcagtatgaattgacgcggcttttagcttcaagagaccgcaacctcttggtcgtcggagatcccgatcagtcgatctacaagtttcgtggcgccgacattcaaaacattctcgacttccagaaagattatcccgacgccaaagtgtatatgcttgagcacaattatcgttcgagcgcccgtgtactggaagcggcaaacaaactcattgaaaacaacaccgaacgcctcgacaagacactcaagccggtcaaggaagcgggccagcccgtcaccttccaccgcgccaccgaccaccgcgccgagggtgactacgtggccgactggctgacccggctgcacggcgaggggcgggcctggtcggagatggcgatcctgtaccgcaccaacgcgcagtcccgcgtgattgaagagtcgctgcggcgggtgcagattccggcgcgcatcgtgggcggcgtgggcttttacgaccggcgcgagattcgcgacatcctcgcctacgcccggctcgccctgaacccggcggacgacgtggcgctgcggcgcatcatcgggcggccccggcgcggcatcggcgacacggcgctgcaaaagctgatggagtgggcgcgcacccaccacacgtcggtgctgacggcctgcgccaacgccgccgagcagaacattctggaccggggcgcgcacaaggccaccgagttcgccgggctgatggaagcgatgtcggaggccgccgacaactacgagcccgccgcgttcctgcgctttgtgatggagacgagcggctacctcgacctgctgcgccaggaggggcaagaagggcaggtgcggctggaaaacctcgaagaactcgtgagcgccgccgaggaatggtcgcaggacgaggcgaacgtgggcggttcgattgccgatttcctcgacgacgccgcgctgctctcgagcgtggacgacatgcggacgaaggccgagaacaagggcgcccccgaggacgccgtcaccctgatgacgctgcacaacgccaaggggctcgaattcccggtggtcttcatcgtgggcgtcgagcaggggctgctgccgagtaagggcgccattgccgaggggccgagcggcatcgaggaggagcggcgactcttttacgtgggcatcacccgcgcgatggagcggctgctgatgaccgccgcgcaaaaccggatgcagttcggcaagaccaacgccgccgaagacagcgcctttctggaagacatcgagggcctgttcgacacggtagacccctacggccagcccatcgagtaccgcgccaagacctggaagcagtaccgcccgaccgtgcccgccgcgacgacagcggtcaagaacaccagcccgctgaccgccgaactcgcctaccggggcggcgagcaggtcaagcaccccaaattcggcgaggggcaggtgctcgcggtagcgggcgtgggcgagcggcaggaagtgacggtgcatttcgcctcggcaggcacgaaaaagctgatggtgaagttcgccaacctgacgaagctgtag

SEQ ID NO: 24312 - DNA, 1296 bp, Deinococcus radiodurans
atgggaatgacgattgccgagaagatgctggccgcccacagcgggcacgacaccgtggtgccgggccaactcatcgagtgcgccaccgactgggtgctgtgccacgaaatcaccacgcccgccgcgctgaggatgctcgaggagcgcggcatggaccgggtgttcgacccgcagaagatcgtggcggtgcccgaccactcggtgcctgccatgaacatcaaggccgccaagatgtaccaaaagctcaagagctgggtgcaggaaaaaggcatcgagcacttctacgacgtggggcgcggcggcatcgctcacgtggtgctggaaaacaccggcctgatgaagccggggcagacgctggtttccggcgactcgcacacctgcaatgcgggcgcactgggcgccttcgcgaccggcgtgggctcgaccgacctcgcgggcgccatctacgcgggcaaggtgtggttcaaggtgcccgagacgatgctcatccgggtgacgggaaaaaccaaccccggcgtgacccccaaggacatcgtgctggaggtcatcaagcagatcggggccgacggcgccaactacatggtgatggaatgggtgggcgactacatcgaccagctcgacatggaaggccgcttcaccctgaccaacatggcgattgaggcgggcggcaagaccggcatcgtggcggtggacgacaccacccgcgcctacatgcagcagcgcggcgtgtcgcccgagcagtacaccgagtaccagtccgaccccgacgccaagtacaaggtcgtggtcgagattgacgccgcgcaggtcgaacccaccgtcgcctacccccacattcccagcaacggccgggtggcgggcagcgaccgcatccgggtgacgcacgcctacgtgggcagctgcacgaacgggcgcatcacggacctgcgcgacgtggcccggattctgaagggccgcaaggtggcgcaggacgtgcagatgattgtcgtgccggcgacgcaggccatctggaagcaggcggcgcaggaagggctgctcgaaatcttcgtggacgcgggcgcgagcgtcagctacccctcgtgcggcgcctgtctggggatgcactcgggcgtactcgggccagacgacatctgcatttcgagttccaaccgcaacttcgtgggccgtatgggcgacccctcggcgcagatttacctcgccagccccgccacggtggccgcgagcgcagtggagggcttcatcgccgacccgcgccgctatgacgccgagggcaacgacctgaacgcggcggactga

SEQ ID NO: 24313 - DNA, 1059 bp, Deinococcus radiodurans
atgcctaaagtcattaccctgcccggcgacggcatcggccccgaagtgacggcggcggcagttcaggtgctgcgcgaagtggcgcccgacgtgacggtggaggagcacgccatcggcggcggcgcctacgacgctcacggcgaaccgtttcctacgtccacccgcgacgccctcaaggaagccgacgcggtgctgctcggcacggtgggcggtgcccacgacagcgcgtggaaccagttgccccggcacctgcgccccgagtcgggcctgctcgcgctgcgtaaggcgctcggctgctacgccaacctgcgcccagtgcgcgtgcagccggggctcgaacacctctcgccgctcaaggccgaactggcgcgcggcgtggacatcctgatcgtgcgggagctgctgggcgggatttatttcgaccaggaccgcaaaatcgagggtgacaccgcctacaacaccatgcgctacaccaccagcgaggtggagcgggtcgccaaagtcgccttctgggccgccgagcagcgcaagggccgcgtgaccagcgtggacaaggcgaacgtgctcgaagtgtccgagttgtggcggcgcgacgtgcaggcgttgcgtgaccgcgactaccgctcgattcacctgaaccacgagtacgtggacagcgtggcgatgctgatcgtggccgaccccagccgctacgacgtgattctgaccgagaacctcttcggcgacatcctttccgacctcgccgccgtgattcctggctcgctgggcctgatgccctcggccagcctgggcgacggggcggggctgtttgaaccgattcacggctcggcgcccgacatcgccgggcagggcgtcgccaaccccgccgccgccatcatgagcgtgggcatgttgctgcggcacgggctggagcgcagcgaggccgccaatcaggtggaccgggcggtggcgctcgccctgcgtgagcagcccacccgcgacctcggcggcagcgccgacacgcagacctttacccgcgcggtcctcaaggcgctggggagttcgccgagcgtgggctga

SEQ ID NO: 24314 - DNA, 1794 bp, Deinococcus radiodurans
atgtcgaaagtccgtatttataccctcgccaaagaccttggcgtcgacaatcacaagatgctcgaaatcctcgacggcctcggcgtctcgtacaagagcgtgagcagcaccatcgacgaggaaaacgtcgaaatcatcaagcagattctggccgacgaagcggcggagggcggcgacgcggccccggcagcggcttctgctcctgctgcggccaccgccgagcctgaagaagccgacgaaaccccggcggcagcggcccaggccgacgccgaaccagcgagcgacctgccccaccgcgctccggtggtcaccatcatggggcacgtcgaccacggcaaaaccagcctgctcgactacatccgcaagacccgcgtggcggccaaggaagccggcggcatcacccagcacgtcggggcgttcgaggccaagacgagcaagggcaagatcgtctttatcgacacccccggccacgaagccttcacgaccatccgcgcgcgcggggcgaacgtggccgacatcgccatcatcgtgattgccgccgacgacagcctgatgccgcagacccgcgaagcgattgcccacgcacaggccgccaaggtgccgatgctgatcgccatcaacaaggtcgacctgccgcaggccgatcctgaaaaggtcaagaccgacctcacgcagctcaacctcgtgcccgaagagtacggcggtgacgtgatcgtggtgccggtgagcgccaagaccggcgaaggcgtcgaagacctgctcgaatacatctcgctgactgccgaactcgaagacctgcgcgccgaccccaagggccagttcagcggcgtcatcatcgaaggccgcgtggacaagcaagcgggcgtcctcgccaccgtgatggtgcaggaaggcacgctgcacgtcggggatttcctggtcgtgggcgagaactacggcaagatcaaggcgatgaccgacagcaacggcggacgcattaaggaagccggccccagtaccccggtacagattctgggcttttcggaagtgccgagcagcggtgaaacggtggtcagcgccaagaacgagcacgccgcccgtgaaatcgtggcgcagcgcgcttcggatcgccgcgacgaggaagacgcccgcgaacgccgcaaggcgcagcgcagcctcgccgacctgctcgggccgctcggcgaagtccacaccgtcaacctgattctgcgcgccgacacccagggcagcctggaagccattcagggcatcctggcacgcaaggaaaccgaggatgtcaagctcaacgtgatgctcgcgggcatcggcgcgccgaccgaaggcgacgtgctgctcgccagcaccgccgaagcgcaaatcctgtgcttcaacgtgaccccctcggcggcggtgaccaaggtcgccgaaaccaaggaaatcccgatcaaggcctaccgcatcatctacgagatgatcgacgaggtggaccgcctgatcaagggcaacctcgatcccgtgttcgaggagcagtacctgggccgcgccgaagtgcggatggtcattcaccaccccaagagcggcaacatcgccgggtcgtatgtcaccgacggcatgttcaagcgcaacgccaaggccaaagtgacgcgtggcaaggaagtcgtgtacgagggcaccgtggtcggcctcaagcgcttcaaggacgacgtgcgcgaagtccagcagggctacgagtgcggtatcaacatcgactggaacgacgtgcaggaaggcgacatcatcgaagccagcgaaatggtggaagtcgagccgcgctaa

SEQ ID NO: 24315 - DNA, 363 bp, Deinococcus radiodurans
atgaccaccacccccaccgaccgcaaatacgccgcctcccacgaatggctcacccaagacggcaccgtgggcatctccgaccacgcgcaggagcagctcggcgacgtggtgtacgtcgaactgcccgaagtgggccgcgaagtgaaggccggcgaagccgtcgccgtcgtggaatcggtcaagaccgccagcgacatctacgccccggccagcggcacgattaccgccgtcaacgacgaactgagcggcagccccgaaaaggtcaacgaaagcccctacgaaggcggctggctgttcaagctcgacgtgaccgaggaaggcgacctgctggacgcggcggcgtatgaggcgcaggcgaactga

SEQ ID NO: 24316 - DNA, 1086 bp, Deinococcus radiodurans
atgacccagccccccgccccctctaccaccgaaaacctcaacgtgaccggcttcacgccgctgatgaccccgcgtgaactcaaggccgaggtgccgctgaccgacgctgccgagcgcaccgtgctcgccggacgccgggcggcgcaggccatcctgagcggcgaggacgaccgcctactggtggttgtcgggccgtgcagcattcacgaccaggcgcaagcgctggagtacgccgggcggctcgcggcgctgcgtgagcgggtgaaagaccggctggaagtgcagatgcgcgtctacgtggacaaaccgcgcacgacggtgggctggcgcggctacctgctcgaccccgacatggacggcagcaacgacatgggcaagggcgtgcgccgcacccgcgagctgatggtggcggtgagcgaactcgggctgccggtggcgaccgaactgcttgaccccttcgcgccgcagtacctcttcgacgccgtagcctgggcctgcctgggcgcgcgcaccgccgagtcgcagacccaccgggtaatggcgagcgccgtcagtgccccgatgggcttcaagaacggcaccggcggcggtatcaagctcgcggtggacgcggtggtggccgccagtcacccgcacgcttttttcaccattgacgaagatgggcgcgccgcgattgtccacaccaagggcaacgcgcacgggcacgtcattttgcgcggcgggcgtgccggccccaactacgccccgcagttcgtgcaggaagcagcagacctgctgcgcgcggcgggccgcgaagaagccgtcatggtggactgctcgcacgccaactcggggtcggactggacccggcagcgcttggtgtggcgcgacgtgctgggccagcgcctcgccggacagcgcgccatccggggcgccatgctggagagcaacctgcaagccggcaaacagagcctgcctgccgacctcacgcagctcaagcccggcgtgagcgtcaccgacgcctgcgtgggctgggacgaaaccgaggccctgctgctggaggcccacgaacagctcagtggccgcgcggcactggcgacctgctga

SEQ ID NO: 24317 - DNA, 1335 bp, Deinococcus radiodurans
atgccgaaccctaatgctctgcccggcgcggctcacctgagcggggcgggggctgcgcagactggcagtccgatgaagacccggattgctggcaaaaccattctcgccatcgtgctggccggggggcgcggcagccgcctctcgccgctgaccgacgagcgggccaaaccggcggtgccgtttctgggcacctaccgcctgatcgatttcaccctttccaacctcgttcacagcggcatcaacgacgtgtgggtcatcgagcagtacctgccgcacggcctgaacgaccacctctcgggcgggcgcccctgggacctcgaccgcacacgcggcgggctggtggtgatgccgcccttcgcgagcgccgagaacgaggaaggcgagttcgcgcagggcaacgcgcacgccctggcgcagcacgcgcacctcatccgcgagttcggcgccgacttggtgctggtcctgagcgccgaccatgtgtaccgcctagactactcggacgtgatccggcagcatgtggagcgcggcgcgagcgtgacgatggtcacgacggagctggcagacgaacagcaggccacccgcttcggcaacgtccgtgcggcgaagaatggcaaggtcagcgagttcgcctacaaacccgacgagccgctcggcaagaccgtaaccgccgaagtcttcgtgtacgacgcgcacatcatgctttccacgctggaagccctgtcaaaagagggcgagctgggcgactacggcgaggagctgctgcccgcgctggtggcccgtggtgacgcccacgcctttcccatgcacggttactggatggacgtgggcacgctggacgcttacttgcaaacccaccgcgattttctggacggcaaaggctttgcgctcgacgacccgcagtggcccttcatcacttccagcatcagccgcccgccgacccggatcgagaagaccgcccggctggacgaggcgttggtctgcggcggcgcggtgatcgccggggaagtcgtgcggagcctgattgccccgaacgcggtggtggaagcgggcgccgtggtccgcgactcggtggtgcagccgggtgccgtgattcgcgccggggcacaggtgagccgcgcggtggtggaccaggacgccgaagtcggcccgggctcgcgcgtgggcggacagaccggcaacagccgccccaccgtggtcggcgcccatgcccacctgggtcccggcgtgcaggtcggccccggtcaggtggtggccccgcgcacccgcgtgaaggcaggcgaggaggggcagaaggtgcaggagctggacgcggacgacaaggcggggaaaaagtag

SEQ ID NO: 24318 - DNA, 459 bp, Deinococcus radiodurans
atgaccgctgcttcatacgccgggcagctgactttttccacttctcatctctctacctgcgaccctcacgaccttcacgggtgttttactgagttcctggccagtggacgggcgcgttactctcggcgcatgactcaggatttacaagtcgagaaataccaggaaggcagcggccagccggcagaaaaaggcaagatggtcagcgtgcactacacaggcacgctggaaaacggccagaagttcgactccagccgcgaccggggccagcccatcgagttcccgctcggcgtcggctacgtgattcccggctgggaccagggcatcgcgcagatgcgggtgggcgacaaggcccggctgaccatccccggccacctcgcctacggtgaagcgggcgttcccggcgtcattccccccaacgccaccctgattttcgacgtggaactgatggacgtgcgctga

SEQ ID NO: 24319 - DNA, 2118 bp, Deinococcus radiodurans
atgacgtttcccttgcccctcgaccacgagcacctgcaaaagctggtgaccgccgatctggtccggcccgaccacctgctcggcgcccacccgaccaccgaacacggggttcagggggtgcgcttcgccgtgtgggcaccgaacgcgcagcatgtgagtgtcgtgggcgatttcaacgactggaacggcttcgaccatcccttgcagcgcctcgacttcgggttctggggcgccttcgtgcccgccgcgcagccgggccagcgctacaaattccgcgtgaccggcgccggggggcagaccgtggacaagaccgacccctacggcacctttttcgaggtgcggcccaacaacgcgagcatcatctggcagcaggacttcgaatggaccgacgccgggtggctggagcagcgggcgcggcgagggcaggcgctcgaagaccccatcagcatctacgagtgccatgtcggctcgtgggcgcggcgtgacgacggctggttcctgaactaccgcgacctcgcgcaccggctgggcgagtacgtgacctacatgggctacacccacgtcgaactgctcggcgtgatggagcaccccttcgacggctcgtggggctatcaggtcacgggctactacgccccgaccagccgcctgggcagcccggaagatttcaaatatctggtcaaccatttgcactcgctcggcatcggcgtgttgctcgactgggtgccgggccatttccccaccgacgagttcgcgctcgcgcacttcgacggttcgccgctctacgagtacgccgacccgcgcaagggctaccactacgactggaacacctacatcttcgactatggccgcaacgaggtcgtgatgttcctgatcggctcggccctgaagtgggtgcaggactaccacgtggacggcctgcgggtggacgcggtggcctccatgctgtacctggacttttcgcgcaccgagtgggtgccgaacatctatggcgggcgcgagaacctcgaggccatcgcctttctcaagcgcctgaacgaggtcgcgcaccacatggcccccggctgcctgatgattgccgaggaaagcacgtctttccctggcgtcaccacgccgacgcccgagggcttgggcttcgactacaagtgggcgatgggctggatgaacgactcgctcgcctacttcgagcaggacccgatctaccgcaagtacgaccaccacaagctgacttttttcaacgtgtaccggacgagtgaaaactacgtgctggcgattagccacgacgaggtggtgcacctcaaaaagccgatggtcctcaagcaccccggcgactggtacgcgcagcgcgccgactaccgcgcttttctcgccatgatgtggaccacgcccggcaagaagctgctgttcatgggccaggactttgcccagggcagcgagtggaaccatgacgcgccgctgccgtggttccacgccgaccagcccgaccaccgtggcgtcatgaatctggtgcggcgcctgaacgagctttaccgcgagcgccccgactggcacacgggggacgcccgcgaggaaggcatggcgtggatcagtgccgacgacaccgacaactcggtctacgcctacgcccggcgcgacacctacagcggggcctggagtctggtgatcgccaacctaactccggtctaccgcgaggactacgtgatcggcgtgccccagggcggcgagtaccgcgtgctgctgtccaccgacgacggcgaatttggcggcttcggcacccagcaacccgacctcagcgcccgcgacgaagccgcccacggtcaggcccacgccctgcacctgaacctgccgccgagcagcgtgctggtgcttgaacccgtggccgccgcgccggtgaagggccttgtcagccgccaggaactgacccccgaactgcgcgaagtcgcccggcaatcggcccaggcggtgcaggtcgagcgcgccgccgacccccgccccaacgagcaacagcggctggtggccgagacgccggcccatgaggggggccgcagcgctccggcagacgccgctgaatcggcagagcagaagcctgacgacgagcagaaaggcgggaagaaggcttga

SEQ ID NO: 24320 - DNA, 621 bp, Deinococcus radiodurans
gtggggtggcatcccctcggggagcacggcgcgccgcacaatagcagcatgacccagcaaacgaattcccaggggactcagcccggcgcggctcaggaacaggccatcttcgcgggcggctgcttctggtgcaccgaggccgtgatgcaggacctgcgcggcgtgcaaaaggtcgagagcggctacatcggcggtacggtgcccaatcccgattaccgctcggtgtgcggcgggcagaccgggcacgccgaggcggtgcgcgtgacctttgacccgaaccagatcagctaccgcgacctgctggggctgtttttcgccacccacgaccccaccagcctcaaccgccagggcgccgacgtgggcacccagtaccgcagcgccctgtttccgctgacccaggagcaggaacagacggcccgcgaaatgatcgagcagctcggcaccgaggacgtgttcgggcggcccatcgtgaccagcatcgaaccggcgagcaccttctacgttgccgaggactaccaccagaactactacaagaacaaccccggccagggctactgcatggccgtcatctcgcccaaggtcgccaagctgcgccagtactacggcgacaaactccgctga

SEQ ID NO: 24321 - DNA, 984 bp, Deinococcus radiodurans
gtgtgcccttcctgtgcagccaccttcctgtcgcctatcttgctgggcatgacccacggcaccccggcccaagctccgaacacccaaacctcgaacgctcagtctccaaacgcagcagcgagcggcacctttctcatcggcggcgagttggaggtcaaccgcctcggctacggcgccatgcgcgtgaccggcgacggcgtgtggggcgaccccgccgaccgcgaaggctcgctggcgaccctgcgggcgctgcccggcctcggtgtcaacctgatcgacaccgccgactcctacggcccggcggtcagcgaggaactcatccgcgaggcgctgcacccctaccccggtctggtggtggcgaccaagggcggcctgacccgcaccggccccaacgtctggcctccctgtggccgtcccgagtacctcattcagcaggcccaaatctcacgccgccgcctcggggtggagcgcatcgacctgtggcaactgcaccgcattgacccccaggtgccgcgtgacgaacagttcggcgccattcggcaactgctcgacgacggcgtgattcgttttgtgggcctctccgaagtgaacgtggaggaaatcgaggccgcccggcaggtgttccccgtcgccaccgtgcaaaacctctacaacctgaccaaccgcaagtccgaggcggtgctcgactactgcgggcgcgagggcatcggctttttgccctggtatccgctcgcctcgggcaagctcgccgccgagggcagtgtgctgaccgaaacagccgcccgcctcggtgccgcgcccgcgcaggtggccctggcgtgggtgctgcgccgcagcccggtcatgttgcccatccccggcaccagcaaggtgaagcacctggaagaaaacgtggccgccgcgtcccttacgctgaccgatgaggacttccgggcgctcgacgaagcgggccgtgcagagtgggaagcggggcagcagaagtaa

SEQ ID NO: 24322 - DNA, 519 bp, Deinococcus radiodurans
atgggcgtgtcggggtcgggcaaaagtacggtggcgcgggcgctggcggagcggctgggctgggcctttgccgaggccgacaagtttcacccgcccgaaaacgtcgccaagatgcagggcggcaccccgctgaccgacgaggaccgctggccgtggctgcgggcgatccgggactggctgacgcaggaagcgcaggccgggcacagcacggtcgtgacctgctcggcgctgcggcggagctaccgcgacgtgctgcgggaggcggcaggtgaggtgcggttcgttcacctgacaggcacccgcgacctgctggccgagcgcatgggccaccgccagggccacttcatgcccgccagcctgctcgactcgcaactggcgacgctggaagtgccgggaccggacgaacacgccctcaccctcaatatcggcgccgcgccggacgagctggtgcgggaggtgctcgccgggttgcagctcggctcaaccgcttccctctcaagcaggccgggacgagactga

SEQ ID NO: 24323 - DNA, 1506 bp, Deinococcus radiodurans
atgtctgagcatcagtacatcctggccctcgaccagggcaccaccagcagccgcgccatcgtcttcgaccaccagggcaacatgaagggcgtcggccagcaggaattccggcagcactttcccaagcccggctgggtggagcacgacgcgaacgaaatctggagcacccagatcggcgtggcgcagcaggccctgagcaacgcgggcatccgcgcctccgacctcgccgccatcggcatcaccaaccagcgcgaaacgaccctcatctgggaccgcgcgaccggcaagcccattcaccacgcgattgtttggcaagaccgccgcaccgcgccctactgcgactctatccgcgctcagcacgaaaagaccttgcaggacaagaccgggctggtgctcgacgcctacttctccggcaccaaggtcaagtggctgctcgacaacgtgcccggcgcccgcgaacgcgccgagaagggcgaactcgctttcggcaccatcgactcctggctggtctacaacctgaccggcggcgaactgcacatcaccgacgccaccaacgccagccgcacgctgctctacaacatccacaccggcgagtgggacgacgaactgctgcgcatcctcgacgtgccgcgcagcgtgctgcccgaggtccgcaactcctccgaggtgtacggcaagacggcggcggggttgctcggcgcgcaggtgccgattgcgggcatcggcggtgaccagcaggcggcgaccttcgggcaggcctgccttgagaggggcatggcgaaaaatacctacggcaccggctgcttcatgctgatgaataccgagggcgaggcggtcccgagccagaacaaactgctgaccacggtggcgtggcagctggacggcgagcggacctacgcgctcgaaggctcggtgtttatcggcggcgcggtggtgcagtggctgcgcgacggcctgaacatcatccgctccagcaccgagatcgaggcgctcgcccgcacggtggacagcagcgaaggcgtgatgctggtgcccgcgttcgtcggcctcggcgcgccctactgggacgcctacgcccgtggcacgatggtcggcatcacccgtggcaccaccaaggcgcacatcgcccgcgccgcgctcgaagcggtggcctaccagtccgccgagctgctcgaagccatgcaaaaggactcgggcgtggagctcaaggaactgcgcgtggacggcggcgccagcaccaacgacctgatgatgcagttccaggccgacatcctcggcgtgccggtcatccggcccaaagtcaccgaaaccaccgcgctcggcgccgcttacctcgcgggcctcgccgtgggctactggaagtccaccgacgacatcgcccaccagtggcaggaagacaagcgcttcgagccccagatgagcgaagaggagcgcagcaagctgatgcgccgctggaaaaaggccgtggcccgcgcccgcgactgggaagacgacagcgaagcgtaa

SEQ ID NO: 24324 - DNA, 1287 bp, Deinococcus radiodurans
atgtgggctttcaatgttcaatttgggacttcaaaaggagacgacatgatttctggactcaaacgggtcgttatcaccggcctcggcccggtcacgcccatcggcgtcggggcaaaggcctacgccgaggcgcagcgggccggcaaaaacggcatcgggccgatcacgcgcttcgacgccaaagacacggcgagcaaaatcgcgggcgaagtgcacgacagcctcgacgatttcgtggatccccgcgaggcccgcaaactcgaccgctacaccctgctggccctgagcgccgccgaactcgcggtgcgcgacagtggcctgagcgccgaggacctgcgcggcgagcgcaccggcacgctggtcggcagcggcatcggcggcatgaagaccttcgaggaccaggcccgcgtgtacgtggagcgcggcgctggacgcatttcacccatgttcatccctatgcagattgccaacatggcgaccggccacatcgccatgcgctacggcgcaatggggccgagcagcaccgtcgtcaccgcctgcgccaccggcaccggggcgattggcgaagcggcccgttacatccaactcggcctggccgacgtgatgctcgcgggcggcgcggaggcctccattacggcgatggcggtgggcggcttttccaacatgaaggcgctctcgacccgcaacgacgaccccgagcacgccagccggcccttttctgccacccgcgacggcttcgtgctcagcgagggcgcgggcgtggtggtcctcgaagaatacgagcacgccaaagcccgcggcgcgaccatctacgccgaagtcgccgggtttggcgtgagtgccgacgcctaccacatcaccatgccagccccgcagggcgcgggcgcgcagctcgccatgaaaatggccctgcacacggcgggcgtgaaccccgagcaggtggggtacatcaacgcgcacggcaccagcacccatttcaacgacctgcacgagacgcaggccattcagcacgtgtttggcgaccacgcggcgcagctcgcggtcagctccaccaagtccatgaccgggcacctgctcggcgcagcgggcgcgattgaagcgattgccgtggcgcaggccctcgccgacgggctgctgccccccaccatcaacctgaccgaccccgaccccgagctgcccctcgacttcatccccgagggcgcccgcgagcggcaggtggactacgcgctgagcaactcgttcgccttcggtggacagaacgcggcgctgctgctgggacgggtctga

SEQ ID NO: 24325 - DNA, 333 bp, Deinococcus radiodurans
ttgacggaagcgggcggctcgttgcaccccgttcagccttgcgcccccgcttctgcccggcgtgtacactgcgggcacttcagtttcaggaggaatttggtaatggcgacttttgatgacgtgaaagatgtgattgtggacaagctcggtgtggacgaaggcaaggtgacccccgaagcccgcttcgtggaagacctcggcgccgacagcctggaaaccgtggaactgatcatgggcctggaagacaaattcggcgtgaccattcccgacgaagccgccgaaaccatccgcaccgtgcaggccgcggtcgactacatcgacaacaaccagtaa

SEQ ID NO: 24326 - DNA, 765 bp, Deinococcus radiodurans
atgacccacaacgaaatttctcccgctcccgcccgcgtcgccctcgttactggttcgagccggggtctgggccgggccatggccctgcgactcgcccaggacggcttcacggtggccgttcactatggccggggagaagccgaggcgcagcaggtcgccgcagacatccgggcggcgggcggcgcggcgcaggtctttggtgccgacctctcgcagcccgccaacgccggaacactcgtcgaggacgtgatcgccgcgctgggccgcctcgacgtgctggtgaacaacgccggcattacccgcgacggcctcgccattcgcatgaaggacgaggactgggacgccgtgctgcaaaccaacctgtcgagcgccttcgccgcctgccgcgccgccctcaagcacatgatgaagaatcgcagcgggcgcatcgtcaacgtttcgagcgtggtcgccctcgccgggaaccccggtcaggccaactacgtggcgagcaaggcgggcctcatcggcctgacccgcgccctcgccaaggaatacggcgggcgcggcatcaccgtcaacgcgattgcgccgggctttatcgagtcggacatgaccgcgaagctgcctgaggacactaaaaagcagtatcaggcgaatattccgctggcccgcttcgggcagcccgaagaagtcgccgcgctggtcgcctttctcgcctcggagggcgccgggtacatcactgggcagaccatcggggtggacggcggtatgaacccgaattga

SEQ ID NO: 24327 - DNA, 918 bp, Deinococcus radiodurans
ttgagcgcttccaagattgccgcgttgtttcccggtcagggttcgcacgccgtcggcatgggcgcggacctggcaggcgagtttccgcaggcgggggagacctacgcggccctggacgccacgctgcccggcctgcgttcgctgattgagggaggcccgctcgacgacctcacccgcactgccaaccagcagcctgcgctcgtcgccgcgtcggtggcggcctaccgggcgtggcaggcgcacaccggcctgacgccgatggtggccgccgggcactcgctgggcgaatactcggcgctggtggcggcgggcgtgctgacgctggaagacgcgctgcgcctgacccgcaagcgcggcgagctgatgcagcaggccgtgcccgaaggcgtcggtgccatgagcgcggtgatgggcgacccggcggtggtggccgaagtctgcgccgcgcaagctggcgtcgtgcagcccgccaacttcaacgcgcccacccagacggtcatctcaggtgaaaaagccgctgtggacgccgccagcgccgaactcaagacgcgcggcctcaaggccatcccgctcaaggtgtctgccccgttccactgcgccctgatgcgccccgccgccgaggggctgtccgccgagttgcacgccgccgcttacggcccctacctgtttccagtggtcgccaacgtgagcgccgagttggtggacagccccacccacaccgccgacctgctcgaacgtcaaatcaccggcagcgtgcgctgggtcgagacggtgcagacgctggccgaactcgggaccgaggttttcatcgaatttggccccggcagcgtgctgagcggactggtcaaacgcattgtgcccggcgcccgaaccctaaatgtcggctcaaccgaacaggtgcgggcttttgccctctga

SEQ ID NO: 24328 - DNA, 1026 bp, Deinococcus radiodurans
atgaaatccatcggcattaccgccatcggcatgtacgtgcccgagcgggtcgttcacaaccacgaattcgagtcgcgcatgggcatcgaggacggctggatcgagtcgcgctccggcatccgcgagcgccgtttttccgcccccggcgagttcgccagtcacatcggcgcgaaggccgtgcaggacatgctcgcgcgtgacccggacgcgctgaaagacgtggacctcgtcatctacgccacctgcacccccgacgccatgtttccctccacggcggcgcttgtcgccgggcaggtcgggctgaccggggtgggcgcctatgacctgtctaccgcgtgcagcggctttgtctacgcgctgagcatggcgcgcggcatgattctgggcggcagcgcgaaaaacgtgctggtcctcggcggcgaggtcctgagcaaggcgctcgaccaggacgaccgcgacaccgccatccttttcggcgacggctgcggctgcgcggtggtgggcgaggtgcccgccggatacggctttcaggacttcgtgctcggcgcggactcggcgggcgggccggcgctgtacatctccaacctcgccgaccagtttcccgacggccagatcatgcgcggcgttcccaccatgaacgggcgcgaggtgttcaagttcgccgtgcgggtgctgggcgactcgggcacccaggcgctgcaaaagtcgggcctgagcaacgccgacgtggactggctgattccccaccaggccaacatccgcatcatcgaggccgccacccagcgcttcgggattccgatggaaaaaaccgtcatcaacctcgaccgctacggcaacaccagcgccggaaccgtgccgctcgcgctgtacgaggcggtcaacgacgggcgcattcagggcggccagcaactgctgatggtcgtcttcggcggcgggctgagctgggccgcctgcacgatgaagtggtggggcgggcggccttcgctgcacgcgcaggtcgcgcagccggcggaggtgcccgcttga

SEQ ID NO: 24329 - DNA, 1140 bp, Deinococcus radiodurans
gtggggagaggcgtgtcctgcgggatgcgcctttttcttttgcgggtgggtagcgcccttgaacccggttcagacagccccattttcctgtcgggcgggccgggcaggtgttacggtcacgtcatgacggcatccctttctgcgcctgccatcggcatcctggcggtgggcgcctacgccccggcggcagtgatcaccaacgcccactacgcgacgcgcctcgacacctccgacgactggatcacctcgcgcaccggcatccgcgagcggcgccacgcggctcccgacgagagcagcagcgtgctcggcatccgggcgacgcaggacctcgccgggcgcttccctggcgccttggacggcgtgaacctggtgatctgcgcgacgagcagccccgacgccatgtttccctccacggcggcgctgatcgccgggggcacgggcctgcgcggggccgccgccttcgacgtgagcgtggcgtgcagcggctttctgtacgccctgagcgtgggctacggcatgatccgggccgggctggcgaaaaaagcattgattgtcggcagcgaggtgatgagcggcgcggtggaccagaacgaccgcaacaccgccatcctcttcggtgacggcgcgggctgcgtggtgatcggggaagtgccgcaaggctacggttttcagtcctttgtgctgggtgccgacagcgcgggcgggccgcacctctacctgcgcggcgcggcgctgcggctgcccgagggcacggaaatggggccgcacctgacgcaaaacgggcgcgaggtcttcaagttcgccgtccgtaccctgggcgacagcgccgagcaggccatgcggcaggcgggcaaaaccactgccgacatcgactggctcgttccccatcaggccaatatccgcatcattgaggccgcctgcgagcgcttcgggctgcctatcgagcgggcggtgaccaatctcgaccgctacggcaacaccagcgcggcgagtattccgctggccctggccgaggcccaggcgcagggccgcttcaaagacggcgaccaactgctgctcgccggtttcggcggtggcctgagctggggagcggcggcgctgaagtggtggagcgggcctactgggaaacagtcgtcctga

SEQ ID NO: 24330 - DNA, 1200 bp, Deinococcus radiodurans
atgtctgaaaaaattgtcatcgtggcggccaagcgcacgcccatcggcagcttcatgggaagcctgaaagacgtgtcggcggtcgacctcggcgtcacggcggcgggcgcagtcctgagcggcgtgagcgacgaagtgaaggccgacattgccgacgtcatcgtgggctgcgtgctccaggcgggccagggcatgaacgtggcgcggcaggtggggcgcggcgccgggctgcccgacgcggtgccgggacagaccatcaaccgcatgtgcggcagtggtttgcagtcggtggtgagcgccattcagggcctcaagtccggcgacggccagatttacctcgcgggcggcaccgagtccatgagccgcgcgccctacctgctccccaaggcccgtgaaggctaccggctggggcacggcgagattctcgacaccatcctgaccgacggcctgaccgacgtgttccacaactaccacatgggcacgaccgccgagaacctcgccgagaaatacggcatttcccgtgaggaccaggacgccttcgcgctcgaatcacaaaagcgcgccgccgccgccatcgaaggcggatacttcggcgacgaagtggtgccggtggaagtcccgacccgcaagggcccggtgaccttcgacaaggacgagcacccccgcgccacgtcgctcgaagcgctcgccaagctgcggcccgccttcaagaaggacggcggcaccgtcacggcaggcaacgccagcggcatcaacgacggcgcggcgatggtgctcgtcaccaccgagagctacgcgcaggaacgcgggctgcctatcctggccgaggtgaagggctactcgaacgtgggcgtggacccggccatcatgggtatcggcccggcctacgcggtgccgctggcggtcaagcgggcggggctgtcgatgagcgacgtggacctcttcgaactcaacgaagccttcgccgcgcagagcctcgccgtgctgcgcgacctggggcagcagggggccgaggtggaccccgcccacgtcaacctgaccggcggcgcgattgcgctgggccaccccatcggcgcgtcgggtgcccgcgtgctgaccacgctgattcaccagttgcgccgcaccggcaaggaaaccggcgtggcgagcctgtgcatcggcggcggcatggggattgcgctggtgttgcaggcccgctga

SEQ ID NO: 24331 - DNA, 795 bp, Deinococcus radiodurans
atgagtgtgacgattgacctttcgggcaaaacagcgttggtgatgggcgtggcgaatgcccgcagcctgggctgggcgattgctgagcaactcctgcaagcgggctgccgcgtgggcttttcctaccagggcgagcgcctgaaaggtgagctggaaaaactgacgaaagactggccgaacacctggattcaacaggccgacgcgaccagcgaagaagacatggacgcgctgtttgcccgcgtgaaagacgagttcagcgagctgcacctgctcgtgcactccatcggcttcgcgccgcgcaccgcgatggacgggcgctttattgacaccaccgctgacgactggaacaccgcgctcaacgtcagcgcctacaccctggtcgccgccgcccgccgcgccgagccgctgatgcccgacggcggctccatcatcagcctgacctaccacgcctcgcagcaggtggtgccccggtacaacgtgatgggtgtggccaaggccgccctcgaagccgccacccgttacctcgccgccgacctcggtgagcgcgagattcgcgtgaacaccatcagcgccgggccgatgcggaccatcgccgcccgctcgattcctcatttcggcaagctctacaacaagggggccatgaacgccgctttcgggcgcaacgccacctccgaggaagtcggcaagctcgcgctgttcctgctctccgacctcagcagcggcatcaccgggcagaccatctatgtggacgcgggcctgagcatcatgaccgtgaaggaaaccgccgaggactga

SEQ ID NO: 24332 - DNA, 2442 bp, Deinococcus radiodurans
atgatctgggaacttcccgtagttgcgctgagaaatatcgtgattctgcccggcgtcaccatgaacgtggacgtggggcgccccaagagcaagcgggcggtggacgaagcccaggccgccgaccgccgggtgctgttgctgacgcagcgtgacccccgcaccgacgaccccacccgcgccgaactgttcgacatgggcgtgctggccgtggtcaagcaggtcgtgcggatgcccgacaacacctatcaggtgctcgtcgaggcgcaggaacgggcccgcgtgatggacgaagtgccgagcgcctacatgcgcgtgcgcgccgacacccagagtgccaccgagccgcagggtgaacaggcccgcgtgatcggtgtactcgccagcgaagtcaagtcggcattcgaggactaccagcgccagaacaagaacctgcgcctggacaactaccaactcgaaggcctcaaggccctgaccgacgcgggcgccctggccgaccaggtcacgcaccacgccacctggacccctgaggaaaagcaggaagtcctcgaggccggcgacctgcaaccccgcctcgaagcggtgctcaagctgctgacccgtgacaccgagcgcttcaacatggacaagaagatcgccgggcgcgtcaaagagcagatggacgccaaccagcgcgagtactacctgcgcgagcagatgaaggccatcggcaaggaactcggcggcggcgaggacagccccgccgaagtggacgccctgcgcgagaagatcgaagaagccggaatgcccgagtcggtcaaggacaaggccctcaaggaactgcaacgcctggaacgcacccccggcggcagccccgagagcaccgtggttcgcaactacatcgactggctggtcgacgtgccgtggagcaagcgtgacgaggaaatcctcgacattggccgcacccgcgacattctcgacagcgaccactacgcgctcggtgacgtgaaagaccgcatcctggaattcctggccgtgcggcagctcacccacaaggacggcgaaaccgaggagcagcgccgtgaacgcagcgccgaagaacgcaccgacgacgccgaactgcgtgcgcccatcctgtgcctcgtgggccctcccggcgtgggcaagacgagcctgggcaagagcattgcccgcagcctcaaccgcaagttcgtgcggatggcgctcggcggcgtgcgcgacgaaagcgagattcgcgggcaccgccgcacctacatcggcgccatgccgggccgcatcatccagggcatgaagacggcgggcgtggtcaatccggtggtcctgctcgacgaaatcgacaagatgagcagcgactggcgcggcgacccctcgagcgcgatgctcgaagtcctcgaccccgagcagaaccacaccttccaggaccactacctcgaagtgccctacgacctctcgcaggtgatgttcatcacgacggcgaatagcctccagaccatcccccgcccgctgctcgaccgcatggaagtcatccagattcctgggtacacccagcaggagaaggtcgagatcgccaagcgctaccgcgtgccccggcagatcaagtcgcacggcctgaccggcaagctcgaaatcaccgacgcggcgctcaaccggattgtcgaggaatacaccgccgagagcggcgtgcggaacctcgaccgccagatcagcaagctggcccgcaaagccgcccgcgaactgctcgaaaccccctgggagggcctgaaggtcatcgacgcgccgcagattcccgacttcctcggcgtgccgctgcaccgccccgagaagatggaaaaagagccccaggtcggcgtggcgcagggcctggcgtggaccagcgtgggcggcaccatgctgctcgtcgaggcgctggcgacccccggcaccggcaaggtcgtcatgaccggctcgctgggcgacgtcatgaaggaaagtgtgggcgcggccatcgcctacctgcgggcgcacgccgccgagtatggcgcggaccccgacttccacaagacgatggacatccacgtccatttccccgacggcgctacgcccaaggacggccccagcgcggggatcacgattgccaccgccgtcatcagcgcggtgaccgggcgcccggtgcgcctcgacgtggcgatgaccggcgaaatcagcctgcgcggccgggtgctgcccatcggcgggctgaaggaaaagctgctcgccgcgcaccagggcggaatccgcgaagtcatcttccccaaagacaacgagccgagcctgcaagaagttcccgaaagcattcgcggcgacctcaaggtgcacgccgtggagcacgtcagcgaagtgctggagctgctgctgctgcccaagcccgagcaggccgagcaaaccccgccgcccgccctcggcaagtcggtgcagccgggcgcataa

SEQ ID NO: 24333 - DNA, 1611 bp, Deinococcus radiodurans
atgagcgacgaaaacaacaagggcgtcggcacggcggtgcagggcgtgggcggtccccgcgacgggcgcaccgcccccggcgagcaaggcaccaccctgaccacccgccagggccaccccgttcacgacaaccagaacagccgcacggtgggcagccgtggcccgatgacgctggaaaactaccagttcatcgaaaagctctcgcacttcgaccgcgagcgcattcccgagcgtgtggtgcacgcccgcggcgtcggcgcccacggcgtgttcagagcgacgggcaaggtcggcgacgagccggtgagcaagtacacccgcgccaagctgtttcaggaagacggcaaggaaacgcccgtcttcgtgcgcttctcgacggtgggtcacggcacccactcgcccgaaacgctgcgtgacccgcgcgggttcgccgtcaagttctacaccgaagacggcaactgggacctcgtcggcaacaacctcaaaatcttcttcatccgtgacgcgctgaagttccccgacctgatccacagccagaagcccagcccgaccaccaacatccagtcgcaggagcgcatcttcgatttcttcgcgggctcccccgaagcgacccacatgattaccctgctgtactcgccctggggcattccggcgagctaccgcttcatgcagggcagcggcgtgaacacctacaagtgggtcaacgaccagggtgaaggcgtgctggtcaagtaccactgggaacccgtgcagggcgtgcgcaacctgacgcagatgcaggccgacgaggtgcaggcgaccaacttcaaccacgcgacccaggacctgcacgacgccatcgagcgcggcgactttccccagtgggacctgttcgtgcagatcatggaagacggcgagcaccccgaactcgactttgaccccctcgacgacaccaagatctggccccgcgagcagttcccctggcggcacgtcggccagatgacgctgaaccgcaaccccgaaaacgtgtttgccgaaaccgagcaggccgccttcgggaccggcgtgctggtggacggcctggacttcagcgacgacaagatgctccagggccgcaccttcagctactccgacacccagcgctaccgcgtcggccccaactacctgcaactgccgatcaacgcgcccaaaaagcacgtcgccaccaaccagcgcgacgggcagatggcctaccgggtggatacctttgagggccaggaccagcgtgtgaactacgagccgagccttctcagcggtcccaaggaagcgcctcgccgcgcccccgagcacaccccccgcgtggaaggcaacctcgtgcgcgccgccatcgaacgccccaaccccttcgggcaggccgggatgcagtaccgcaacttcgccgactgggagcgtgacgaactggtgagcaacctctccggcgctctggcgggcgtggacaagcgtattcaggacaagatgctcgaatacttcaccgccgccgacgccgactacggccagcgcgtgcgcgagggcattcaggccaaggaagccgagatgaagggccagaagcaggaagcccccgtctacggcaccgaggcgagcagcctgtactga

SEQ ID NO: 24334 - DNA, 1017 bp, Deinococcus radiodurans
atgcgcgtcgccattgtgggagccaccggggccgtcggccacgaactgctgaaggtgcttgaaacctcaagtctcgacttcagcgaactgcaactctacgcctcgccgcgcagcgcgggcagcacgctggagtttcgcgggcagccgctgacggtgcaggccacgccggacggcgccctgcccgccgacctcgtgctcgcctcggcgggcgggtccatcagcaaggaaaaggccccgcgctgggtggaaggcggcgccgtcgtcatcgacaattccagcgcctttcgctacgacgacgacgtgccgctcgtcgtgcccgaggtcaatggtgaagcggccctggggcacaagggcattatcgccaaccccaactgcaccaccgccatcgccgtggtcgccgtcgcgccgattcaccgcaagtacggcgtcaagcgcatgatcgtcagcacctatcaggccaccagcggcgccgggcaaaagggcatggacgagctgctcaccgagacgcacaaggtgctgcacggccaggacgcgggccaccatgaattcgttcaccccattcccttcaacgtgattccgcacatcgacgtgtttcaggacaacggctacaccaaggaagagatgaaggtggtctgggagacgcgcaaaatcatgggcgacgagagcttgcagatcagttgcacggcagtccgtattcccaccctgcgaacccacagcgaggccatcacgctggagctggagcggcctgctacgcccgaggccatccgtgagctgctggcgacggcggcgggtgtggaggtgcgcgacgaccctagcgcgaagctctaccccatgcccctgaccgccagcggcaagtacgacgtggaagtggggcgcatacgccagagcctcgtgttcgacggcggcatcgaactgttcgtggcgggcgaccaactgctcaagggcgccgctctgaacgccgtgcagattgccgaagaccttcagcggcgcggggggctgaaagttcagcggggctaa

SEQ ID NO: 24335 - DNA, 1659 bp, Deinococcus radiodurans
atgacccaggcacacccggagtggtacaagagcgctgtcttctacgaactgtccgtgcggacctttcaggacggcaacggcgacggcaagggcgattttcccggcctgacctcgcggctggactacctgaaaaacctcggcgtggactgcctgtggttgctgccctggtttcccagcccactgcgcgacgacgggtacgacgtggccgactaccgggggattcaccctgacctcggcacgctcgacgacttcaaggtctttctgcgcgaagcccacgcccggggcctgcgggtcatcggcgacctggtgaccaaccacacgtccagcgaccacccctggtttcaggcggcgcggcgcggcccgaccctgcccgacggctcgcccaacgagtaccacgactactacgtctggagcgacgagggcaaggaatacgccgacacccgcatcatcttcaccgacaccgaggtcagcaactggacgctcgacgagcaggcaggcaagtattactggcaccgctttttcgccagccagccggacctgaactacgacaacccgaaagtggtggaagaacttcacggcgccgcccgcttctggctcgacctcggcctcgacgggttccgggtggacgccgtgccctacctcatcgagcgcgagggcacgagctgcgagaatctgcccgaaacacacgagattctcaagggcttccgggcgatggtggaccgcgagtatccggggcggctgctgcttgccgaggcgaaccagtggcccgaggaagtcgtcgagtacttcggcaccgaagccgagcccgagttccacatgtgcttcaacttcccggtgatgccccggctgtacatgagcctgaaaagggaggacacctccagcatccgcgagatcatgggccgcctgccgaaaatcccgagtttcggccagtggtgcaccttcctgcgcaaccacgacgaactgacgctggaaatggtcaccgacgacgagcgcgccttcatgtatgccgcctacgcgcccgacgcccgcatgaaaatcaacgtgggcatccgccgtcgcctcgcgccgctgctcgacaacgaccggcgccgcatcgagctgctgaacactgtgctcctcgccctgcccggcagccccatcctgtactacggcgacgaaatcggcatgggcgacgacctcggcctgcccgaccgcaacggcgtgcgcaccccgatgcagtggaacgcgggcaccagcggcggtttttccactgcgcagccctccgactgctttttcccgccgattcaggacccggtgtacggcttcgggcgcgtcaacgtgcagagccagctccaagaccccagcagcctgctgaagtggaccgcccggcaactcgaactgcgccgcgcccaccccgcctttgcgcacggcgacctcaccttcatcgaaaccggcaaccccgccatcctcgcctttacccgccagtacgacggcgaaacgctgctcatcgtcagcaacttcgcgggcaacgcccaggccgggctgctcgatctcgcgcccttcgtgggccgcgccccggtcacactttccggggccagcccgctgccggtggtcactggaaacggccagtacccggtggtgatgggcaagtacgactattactggctgcggttgaattga

SEQ ID NO: 24336 - DNA, 2034 bp, Deinococcus radiodurans
atgcgccatttcgcgcattcaccgctcggccatcaggcgtatgctggcttgcttccacgtcagggcaatgcctccgcacctcacttccctgccgtgtgcttttttcgccgcctttcccttctttccttttcttttccttgcgtgaggttttccttggacagtttcagaaccctgtggccgtacctgaaaatgcaccagcggcagtacctgatcggcatcgtggccgtgatgatttccaacgccgtggtgctgctgccggcctatttcatccgcctgaccatcgacgggctgacccgcacgctcgacaacaacccggcgacccccggcatcacggtgacgcaggccgggtactacgcgctcgccatggtggcgtcttcgctggtgtcgggctcgttcatgctcctgatgcggcgcatgatcgtggtcgcgtcgcggcaaaccgagtacgaaatccggcgtgacctgttcgcgcacttgcagacgctcgacaagaactactacgaccgcgcccgcaccggggatttgatgaaccgcctgactggcgacctcagcgccgtgcgcgaaatgctggggttcggggcgtggcagatcgtgaacatcatttcgggcttcgtgacgtccttcgcggtgatgttcggcctgagctggcagctcaccctcatcgtggtcgcggtgattccgatcatcgtgggcctgctggcgtacatggcgcggctgatcaacgcccggcacaaggcggcgcaggagcagaacagcctgatcgctgccaaagcgcaggagaacttcagcggcgcgcgggtggtcaagggctacgccatcgaggaccgcgagatcgaggagtaccgtgccatgaacctcgaactgctgcggcgcaacattgcgctgatcaaggtggacgggccgctgcggtcgttcagcaacctgctgctaggcatcgccttcgggttgattctgctggtggcggggcggctgattttgcggcccgatgcgacctttacggtggggatgctgacgcagtttctgctgtacatcgagcgcctcgcttggccgatgctgatggtcggctggatcaccggggtcacgcagcgcggcctcgcttcgtggaaccgcttacaggaactgttcgacgcccgcccgctggtgcgcgacgaaccgggccgcaccgagccgcagctgtggccgacccagggcgacctgagcttcgagaacgtgtcgctgcgctacgggcatacgcaggtgctcgaccacatcaacctgcacattccggcgggcaccttcctggggattaccgggccgaccggcagcggcaagacggtgctgggccaactgatcacgcgcagcatggacccgaccgagggggtcatccgcatcgacgggcacgacctgcggaccgtaccgctcgagcacctgcgcagcgcgattgccgtggtgccgcaggaacctttcctcttcagcgacaccatcgccaacaacatcggctttgggctgaacaacgacgaactgccgcccgtgccgacgcgggtgagcgtggtgggtctgccgctgccgccgaacattccgcagcaccccgaccccgagcgggtgcgcgaggcggcgcggctggcgggtctcgccgacgacgtggagagttttccggaaggctacgataccgtgctgggcgagcgcggcgtgacgctctcgggcgggcagcgccagcgcactgcgattgcccgcgccatcgtgcgcgagccgatgattctgattctggacgacagcctctctgcagtggacaccgaaaccgagcgccggattattcagggcttgcggcaggtcgcgcagggccgcaccgtgatcttgatcgcccaccgcatcagcaccctgcggcacgccgatcagatcgtggtgctggaagaggggcgcatcaccgaacagggcacccatgacgaactgctcgcgctcggcggtcactacgccgaactcgaccacctgcaacggctggcgagcgacctcgacgaacatgggcagcagcccgcggcgcaggaggtgtccgcatga

SEQ ID NO: 24337 - DNA, 1860 bp, Deinococcus radiodurans
atgacccagaaggcttccgaatacgacaagggcttcgatgtgggcctcacgcgacgcatcatcggctacctcgggccgtacaagaccctggcggcggcgggcgtgctgctcgcgctgctcacggcggccttgcagcccttgcccacgttgctgcaacgctacgccatcgaccactacctcgtgccgtacaccaacggcagcaacacggacgccgccgcgctctaccaggggctgaccatggtggtgctcggctacgtggcgctgcgggtgctggaatttgtgctgacctacctctcgaccatcacggtggggtacctcggccagaacgtgctgcgcgacatccgcgccgacgtgttcggcaagttgcagcggctgcacctgcgctacttcgaccagaacccggtgggacgcctgattacccgcgtgacgagcgacgtggacgccatcaaccagttcatcaccggcggtctgatctcgatgatgacgagcaccttcctgatcatcgtgttcatgaccgtgatgctgacgatcaactggcgcctcgctttgatcgcctttacggtgctgccggtcctgttctacgcgaccaattttttccggggcaagctgcgcgaggcgttccgggaaacccgcacccagcaggccatcgtgaactccaagctcaacgagaacatcaccgggatgctgacggtgcagctcttcgggcgcgagcggcgcagcgccctcgacttcgaccattccaaccgggcgctgctcacgtcgctggaaaactcggtgaagtggttctcgctgttcatgcccaccgtggcggtgctggggcaggtcgccatcgcgctggtgctgtacttcgcggcgcggcagattctgggcgtagacgtggtcgggaccggcacggcggcggccatttcggtgggcacgctcttcgccttcgtgcagtggacgcagcaactctttcagccgattcaggacctcgccgacgtgttcaacaacctccaggccgccaccgcgagcagcgagcgcatcttcggggtgctcgacaccgaggaagaaatcaccgacaagcctgatgccaagaccctggtgaactttcgcggtcaggtggatttcgaccgggtgtggttcgcctacagcgaggacgtgacggcgcagacgcccgacgaagacgaccgctggattctgcgcgacttcgacctgcacattcagcccggcgagagcgtggcgctggtgggcgcgacgggggcgggcaagacgagcgtgaccgcgctggtgagccgcttttacgacgtgcagcgcggcgcagtgagggtggacggcaccgacgtgcgcgacctccaacaacacgacctgcggcggcatgtcggcgtggtgcttcaggacgtgttcctgttcgccggcaccatcgagagcaacctgacgctcgacaaccccgccattccccacgaccgcgtggtggaggcgtgccagtacgtgggcgtacacgactacatcctctcgctggagaacggctaccagaccgaggtgcgcgagcgcggcgccaccctctccaccgggcaaaagcagctgctcgccttcgcccgcgccctgattcagaatcccgacatcttgctcgtgctcgacgaagcgaccgccaacgtggacactgagaccgagctgcggattcaggacgcgctgaaaaaggtgatgcagggccgcacgtccatcatcatcgcccaccgtctctcgaccatcgagcactgcgaccgcatcatcgtgatgcgccggggccgcatcgtggaacagggcacgcacgcccagctcatcgcgcagggcggctactacgccaagctcaacgccttgcagtacgcgggggcagcagactga

SEQ ID NO: 24338 - DNA, 1335 bp, Deinococcus radiodurans
atgacagaacgcaagtatttcgggacggacggcgtgcgggccgtcgccggtgaatttccactgacccccgcctgggtgatggccctcggcgcggcggcgggcgaggtcttcaagcgccgcaacccgcgcgccagcgtggtcatcggcaaggacacccgccagagcggcgacatgctcgaagccgcgctcgcggcgggcctgaccagccggggcgtgaatgtcgtgcacctcggcgtgctgcccacccccggcgtcagttacctcacccggcacctcggcgccgaggcgggcgtggtcatcagcgcctcgcacaacccttacgaggacaacggcatcaagttttttggccccggcggcggcaagctcagcgacgccaccgaactcgaaatcgaagcggccattgacgaggcggccaccctcgccccggtgaccggcgtgaatctcggcagcgtgaccaactatacggaggccgagcggctctacacggcgttcctgagttcgcacgcgcccgacctctcggggatgcggattgcgctcgactgtgccaacggtgcggcgtaccgggtggcccccaaggtgtttcagcaggcgggtgccgacgtgttcgccgtctacaccacccccgacgggcgcaacatcaaccggggctgcggctccacccacatggaccacctgcgcctgatcgtgcgtgagggcgactatgacctcggcatcgccttcgacggagacgccgaccgcgccctgttcgtggactcgcgcggcaacatgattcacggcgaccacatgctgctgctcagcgcccgcgcgcgcggcgagaaagccgtggtggcgaccatcatgaccaacatggcgctcgaagtgaagctgcaagaagcgggcctgacgctggagcgcaccgctgtgggtgaccgttacgtgcacgagcgcctgcacgccaagggcctgaacctcggcggcgagcagagcggtcacgtcctctttctcgacgtttcgcccaccggcgacggcgtactgaccgcgctgctgacgctgagcagcatgaaaaagctcggcaccacgctcgacgccctgtacgacgaactggtgatgtttccgcaaacgctggtcaatgtccgggtgaaggacaagaaagccatcgccagtgaccccgccgtgcagcacgccgttgccgacgctgagaagcaacttgcgggcaagggccggatcaacctgcggccctcaggcaccgaaaacctcatccgggtgatggtcgaaggccaggacgagggcgaaatccacgacatcgccgccgccgtcgccaaagtggtggaggagcggggagcagcgggcgcctga

SEQ ID NO: 24339 - DNA, 573 bp, Deinococcus radiodurans
gtgcgccttgcccgcgagctgctcggaggcacgctggtccgcgtaaccccggacggccaccgcctgagcgggcgagtggtggaagtggaagcctacgactgcccgcgtgacccggcctgcaccgccgggcgctttcacgccgcccgcagcgcggaaatggcgattgcgcccggtcactggctgttctggttcgcgcacgggcacccgctgttgcaggtcgcctgccgtcaggaaggggtgagcgccagcgtgctgatccgggcgcttgagccgctggaaggggcgggcaaaatgctcgattaccgccctgtgacccgccagcgcgacctgacgagcggcccggcgaaactggtctacgcgctcggccttgaccccatgcagatcagccaccgcccggtgaacagccccgaactgcacctgctcgcgccggagactccgctggccgacgatgaagtcaccgtcaccgcccgcgtaggcatccgcgaagggcgcaacctgccctggcgctttctgattcggggcaacggctgggtgtcgcccgcgcagccgagcatggagctggccgcgccgtga

SEQ ID NO: 24340 - DNA, 1083 bp, Deinococcus radiodurans
atgcgggccatgaacgctgccccagctccgcttctgcgctctctggtgacagggactccgccctacagcgcgcttcagagcgaggtgcaggccgccgcccgcaccctctttccgcgcatgagcgagcgccggcacatgctcgacgtgtttaccaacgcgcagatcgagcgccgcgccctttcgcgcccgctggcgtggtacctcgaaccacacggttttgccgagaaaaacggggtgtttctggaagaagcccgcgccctgatcgtccggctcgcccgcgaagcgctggataaggccgagctcgcccccgccgacgtggacgccgtggtggtcgtcaacacctcgggcctcagcacgccgagcctggacgcctacctgattggggcgctgggcctcaacccccacgccgcccgcttgccggtctggggtctgggctgcgcgggcggggcaagcggactggcgcgcgccgccgacctggtgcgcgccgggttcaagcgggtgctgtacgtggccgtcgaactgtgcagcctgacgctggtcaagggcgacgagtccaagagcaatttcgtgggcacggctctctttgccgacggcggcgccgcgctggtcgtcacggcgcccgacgttcctggcccccgacccctgctggcgctgcacggcggcttttcgacgctgatcgaggacagcgaggacatcatgggctgggacgtggtggacgacgggctcaaggtccgcttctcgcgcgacattccgacgctggtgaattccatgatgcaggagaacgtggcacaggccctcgccgcacagggctgggcgcgggacgacgtgcagaccttcgtggtgcatcccggcggcgtgaaggtggtcgccgcctacgagcaggcgctgggcctgccggacggcacgctggatagcagccgcgcggtgctgcgagagtacggcaacatgagcagcgcgaccgtgctgttcgtgcttgaagaggtgctgaggagtcggccccagggacgcggcctgctgagcgcgatgggccctggcttcagcgccgagcatgtgctgctcgactttggcggcggggaagcgtga

SEQ ID NO: 24341 - DNA, 1311 bp, Deinococcus radiodurans
atgcaagtgcttcaaggggccgaggcccgcgccgccctgacccgaaccttttcccagattcccgtgccggacgcggtgctctcgcgcatcgaacagacctttggcgaacggctgacgcccgagcaggtggtggaacgcatcctgctcgatgtccgtgcacgcggcgacgacgccctgcgcgactggaccgagcggctcgacggcccgcggcccgcagagctggaggtccccgccgccgaactggaggccgcgcaggtggcccccgaattgcacgctgccatccgcctcgccgccgagcgggtgcgggctttttacaggcagcagcccgcgcacggctttctggagcacgggccggacggcgcgctgggccagctcgtgcgtccgctggggcgggtgggcgtgtacgtgccggggggcctcgcgccgctgatttccaccctgatgcacacggcggtgcccgcgcaggtggcgggcgtgccggacatcgtggtgacgaccccgccgggcaaggacggacaggttcaccccgcgattctggtcgccgcccgcgaactgggtctttcccgcgtgttcaaagtgggcggcgcgcaggccatcgctgcgctggcctacggcaccgcgagtgtgccggcggtggacaagatcgccgggccgggcaacctcttcgtggtcatcgccaagcggctggtgtacgggcaaacgggcatcgagagcctgccggggccgaccgagacgctggtggtcgccgacgactccgccagcccgcgttacgtggccgccgacctgctcgcccaggccgaacacaacggcgccgagccggtgctggtgtcggtgagccgagaactgctgctggcggtgcaggccgagctgaatgagcaactggaaaacctgcccgaacccaaccgcagctgggcgcgtgacagcgtaggggcgcggatgaaagtcgtgctggccgactcgctggacgaggcgctggacctcgccaacctgtacgcccccgagcacctgtgcctgctgacccgcgacccctggagcctgctggggcaggtgcggcgcgcgggcggcgtgttcgtgggcgaggcgagcatggaagcgctcggcgactacgtggccggccccagccatgtgatgcccaccggcggcaccgcccgcttcatgagtccggtcaacgtgcgcgactttcagaacatcatcagcgtggtgggcgtgaatgaggaaacgctgcgccgcatcggcccggcggcggcgaccctggcccgcgccgaggggctggaggcccacgcccgcgccgtggaaagtcggctgaaatga

SEQ ID NO: 24342 - DNA, 1005 bp, Deinococcus radiodurans
atgctctcccccatgacgcctctgcccacccagcgcccccgccgcctgcgccgcacccccggcttgcgggcgctgacccgcgaaacccgcctcagccccgagcagttcatcttcccgatgttcgtgcacgagggccagagcgattccgagatttcgaccatgcccggcgtgctgcgccactccattcccagcgcggtggaaaaggcccgtgagacacaggggctcgacatccccgcagtcattttgttcggcattcccgacgtgaaagacgaggtgggcacccaggcgtatgccgatgagggcgtggtgcagcgggcgacgcgggcgatcaaggaggcgctgcccgacctcgtggtcattgccgacacctgcctgtgcgagtacaccagccacggccactgcgggcacctgcacgaggtgagcgggcagtggacagtggacaacgacccgacgctggagctgctggcgcagaccgccgtgtcgcaggcccgcgcgggggccgacatcatcgccccgagcgccatgatggacgggcaggtggcggccattcgcgccgcgctcgacggggcaggcttcgcacacattccggtcatgagctacgcggtgaagtacgccagcgcctactacggccccttccgcgaggcggcgggcagcgccccgagcaagggcgaccgcgccagctaccagatggacccggcgggcggctaccgcgaggccctgcgcgaagcccggctcgacgtggagcagggcgccgactacctgatggtcaagcccaccctcgcctacctggacgtgatgcggacggtccgcgacgccttcgacctgccgatgattgcctacaacgtcagcggcgaatactcgctcatcaaggccgccgctcagctcggctacatagacgagcgccgcaccgtgctcgaaaccctgaccgggatggtccgcgccggggccgacgccatcatcacctatcacgcgctggacgcggcgcgctggctgcgggaaagctga

SEQ ID NO: 24343 - DNA, 555 bp, Deinococcus radiodurans
atgattcctatgaaactcgtcgtctccggcccggttggggcgggcaagaccacctttgtccagaccctgtccgaaaccccggtcgtcagcaccgaggccgatgccagcgaggacatcggcaaggccaccaccaccgtcgccttcgacttcggcacgctcattctcgacggcaccgagctgcacctctacggcacgccgggccaagaccgcttcgacttcatgtgggacgtgctgtgtgaaggcgcgctggggctggttcttctggtcgccggcaaccgcccgcaggactttttgcacgcccggcacattctcgaattcatcaccagccggaacccggtgcccttcgtggtcggcgtcacccgccaggacctcgaggacgtctggagcccgcaggacattgccagctactttgacctgccgaccgaacaggtgattggccttcaggccaccgaacccgacagcgcccggcaggtgctgatccacctgctcgaatcgcaactcacccccgagactcagtccgaatccggaacccagactgaaaaggagaccgcatga

SEQ ID NO: 24344 - DNA, 1257 bp, Deinococcus radiodurans
atgaccaacaccccttcttcccccaatgacgcgtcctggagctacgacacggcggcggtgcagagcgggattccgcgcggcctgggcgaaaccatcggctttccgattcacgcggcggcggcctttcagttcgacacgctggagcaggcgcaagacgagtttcaatacaacggaggcctgagctacgcccgcattcagaaccccaccgtgcgggcgctggaggagcgtctcacggtgctcgaaggcggcgcggcgacggtggccctcgccagcgggcaggccgccagcctcaccgccattctgagcgtgtgccgggccggggaccacgtggtgtcgagtgccagcctgtttggcggcagcaccgggatgctgaccaatattttgccgctgatgggcatcacggcgacgctggtggagggccaccccgagcagattcgcgctgctatgcaggacaatacccggctggtgtgggccgagatgatttccaacccctcgggcgcggtggccgatgtcgaggcgctggctggggttgcccacgagcgcggcgccctgctcgccatcgacaacacctgcggcggcgtggggtacctgtgtcggcccctcgaccacggcgccgacatcgtgagccagtcgctcaccaagtgggcgggcgggcacggcagcgtcatgggcggcagcgtgacggtgggcacgcagcacgacctgagccgcaacccgatttatgcgggcggcgaaaacagcctgctcgagcagcgcggcgcggacgccctcgcgtggcggcagcggtggtttggggcgcatcagctcggcatgacgctcgcgccgcacagcgcgttcctgatcgcgcagggcctggaaaccctggggctgcggctgcaacgcgaatccgactcggcgctggcgctggcgcgctggctggggcagcatccccgcgtcggcggcgtgagctacgcgggcctgccggggcacccgagcttcccactggttcagaagtacctgccgcgcggcgcgggcgcggtcctcaccttcgaggtggacgacccctcgcgcttcctctcgcggttgcgggtgctgcgcatggcccccaacctcggcgacgtgcggaccctcgtcgtccacccctggaccaccacccacgggcgggtgcccgaggcggcccggcacgcggcgggcgtgacccccggcaccattcgcatgagcgtgggcgtggaagacgtgatggacttgcaggccgacatcgagcaagcgctgaattga

SEQ ID NO: 24345 - DNA, 1296 bp, Deinococcus radiodurans
gtgggcgaacgaaaatgcggaggctggccgccgaaagtgtttcttcattccctctcccccggcggcgcaggaggcagcacgaaagcagtcgtatggcacggcatcggcgacattcgcctggacgacgttcccgaacccaagatcgaggcccccactgacgccatcgtgcggctcaccgccagcgcgatttgcggcaccgacctgcatttcattcgcgggacgatgagcgacatggtgcccggcacgattctgggccacgagggcgtgggcatcgtggaggcggtcggccccgaggtccgcaacttcgtgcccggcgaccgggtggtcattccttcctcggcgtcgtgcgggtactgccccccctgccgcgagggcaacacctcgcagtgcgacaacgccaaccccaacggcccttcggcgggcaccgcgttttacggcggccccaagagcagcggcccgctcaacgggatgcaggccgagaaggtgcgcgtggtgtacgccaactccagcctcgtcaagctgcccgacaacgtgtccgacgaccaagccatcatgatttccgacatcttcccgacggcctacttcggcgccgaaattgcgggcgtcaagaccggcagcgtggtcgtggtgctgggctgcgggccggtgggccagttctcgatcatcagcgccaagctgctcggcgcgacccgcgtcatcgcggtggatcggctggatgaccgcctggacatggcccgtaagaacggcgccgaggtcatcaacttcgagaaggaagacccggtggaagcggtcaagaagctgacgggtggcctgctcgccgactgcgtgattgacgcggtgggggtggacgcccagcacgcgcacgctggccccgccaagcccgacgccgaaaaagagcagaagttcgagcaggaagtgcaggaagtcgccccagatgccaagccggaaaaagacggccagtggacccccggcgacgcgccttcgcaggccagcgagtgggccatcgagatgaccaagaaggccggtcagatcggcatcatcggcgtgtactcaccccagatgaccacctaccccatcggcaaggccatgaataagaacctcaccatccgcatgggcaactgcaaccaccgcgccatcattccgggtctggtggacctcgtcgcggcgggcgtggtggacccggcccgcgtcctgaccgagcacgagcacctcggcagcgcgattgaggctttcgaagccttcgacaagcggcagccgggctggatcaaggtcgagttggagccgcaagcaggctaa

SEQ ID NO: 24346 - DNA, 1275 bp, Deinococcus radiodurans
ttggagtctgggcgatttataaccccgactcagggaaaggaaacgtctagactgcccggcatgaccaccacgacagacgtacccgcttcgggcgtcagcctgagcgaacggctccggcaggacctcgccggcctgcgcgaaagcggcctgctgatttcaccgcgtgttctcgacgcgccgcaacgggcccgcacgcgggtagacgggcgcgaggtcgtgaacctggcgagcaacaattatctgggttttgccgaccacccccgcctcaaggaacgcgccgcgcagtacctccagcagtggggcgtgggcgccggagcggtgcggaccatcgccgggacgctgcggattcacgaggactttgagcgccaacttgcggacttcaagcacaccggcagcgcgctggtgctgcacagcggcttttccaccaaccagggggtgctcggcggcctgctgcgcgagggcgacctcgtggtgagcgacgaactcaaccacgccagcatcatcgacgggctgcggctgacgaaggcgaccaagaaaatctacaagcacgccgaccccgccgacctcgaccgggtgctgcgcgaaaatcccagcgagggcctgaaactcgtcgtcaccgacggcgtgttcagcatggacggcgacgtggctccgctcgacaagctggtggaagttgcccgccgttacggcgccgtcacttacgtggacgacgcccacggctcaggcgtgatgggcgaggcggggcgcggcacggtgcaccacttcggcttcgagtacgccgacgacgtgattcaggtgggcaccctctccaaggcctggggcggcgtgggcggctacgcggcgggacaccccgacctgcgcgaactgctgatcaaccgcgcccggccctacctcttttccaccgcgcagcccccggcagtggtgggcgcgctggcggcggccctcgacgaggtgcaacgcgaccccagtttgatggagcggctgtgggacaacacccgctttttcaaggccgagctgggccgcctgggcttcgacaccctgggcagcgtcacgccgattacccccgtcgtcttcggggaggcgagcgcggcgttcgaggccagccgccgcctgttcgacctgggcatcttcgccgtcgggctgggctttcccaccgtgccgcgcgacctcgcccgcatccgcaacatcgtgaccgccgagcacacccgcgatgatctggaacaggccctgagcgcctatcagcaggtgggacgcgacctcggcgtgatcgcctga

SEQ ID NO: 24347 - DNA, 930 bp, Deinococcus radiodurans
atgcgtaccgtgacggttggcacgcgaggcagcaccctggccctcgcacagacgcgctgggtggtcgcccgcctgaaagaagagtggcctgaaaccgatttcaggattcagaccatttcgaccaagggggaccgcaaccgcgagagcctggagcaactggcgcaaaaaggcgacaagggcttctgggtcaaggaaatcgaggaagcgctgctcgccaagaaaatagacatcgcggtgcattcgctcaaagacctgcccaccgagcagcccgagggcctggaaatttccagcattcccaagcgggtggacgggcgcgacgccctgattggccgcgaagggatgaaaaagctggccgagctgcccgagggcgcacgcatcggcacgagcagcgtgcggcgcaaggcgtttttgcgcgcctaccgccccgacctgattgtcaaggatctgcgcggcaacatcgacacccggctcgcggcgctgggcagcggcgagtacgacgccatcatcctggcggcggcgggcctgattcgcaccgagcagcgccaccgcatcgatgagttcgtggaccccgacattctgctgcccgcccccggccagggcgccctggcgctcgaaacccgcacggaggacgacctgaccatcgaggtcgcctacgccattcacgaccacgccaccgacgaccgcatcaccgccgagcgcgagtttctggccgggctgggcgccgggtgcatggcgccggtcggggcgcacgccgtcatcaagaacgggctgctcacgctcgaaggctgggtgggcgcgctcgacggcacgcaggtcatccgcgccacctcgcagggcgacgttgccgaatgcgccgatatcggggccgagctcgccgccgacatgctggaacggggcgcggcggagctgatcgaagccgtgcgcgagtaa

SEQ ID NO: 24348 - DNA, 1020 bp, Deinococcus radiodurans
atgcaagacaccgcgattcaggaaattcagggggccgagacgcttgaggcgctgcaggccgtcaagacgaagtacgtcggcaagtccggcctggtgacgaaagaacttgggagcctcggcaagctgccgcccgaggaacgcaaggcgtgcggcgccgaaatcaacgtggtgcgcgccgcgattcaggccgcgctggacgagaaagagtcagccctcaagcgcgcggcactcgacgctaaacttgccagcgaagccatcgacgtgacgctgccgggcctgcccctgccggcgggcgggctgcatcccatttcccgcgtgctcgacgacctgatcggcatctaccgccagatgggctacgcggtgatcgaggggccggaagtcgaggaagagcactacaacttcgaggcgctcaacgtgccgtggtatcaccccgcgcgcgacctgcaagacaccttctggctggaagacggacgcctgctgcgcacccacacctcgcccatgcagattcgctacatggtggaccacgagccgcccttcaagatcgtggtgcgcggcaaggtctaccgctacgaagccaccgacgccacccacgaggcgatgtttcaccaactggaagggctggtggtgggcgacggcatcagcatgagcgacctcaaggggaccattgccgaaatggcgcgcgggctgtacggcgcgagcgccaaggcgcgctttcagcccagctattaccccttcgtggaacccggcgccgacttcgccgtgtactgggaaaacccgcgcggcgagagcaagtggctggaactgggcggctgcggcatggtgcatcccaacgtgttcaaggcggtggacgacctgcgcgaggcggcgggcaaggaccgcgtgtacgagggcaaaaccggcttcgcgttcgggctggggctggagcgcatcgccatgctgaagtacgggattcccgacatccgctacttctacgccaacgacccgcgcgtcatcgggcagttccggggggaactgggatga

SEQ ID NO: 24349 - DNA, 1839 bp, Deinococcus radiodurans
atgcccagctacaaagcccccacccgcgacatgaagttcgtcatgcaggaactgctcggcgccggcgaccagctcgccgccatgcccttttaccgggacaacgagaccgccgacttcgacctgctgtcccaggtgctcgacgaggccgcccgctttgtcgaaaccgaaatccagccgctgaaccaggtcggcgaccaggaaggctgcaagcgcgacgagcagggcaacgtgaccacgcccgcaggcttcaaggctgcctacaagaagttctgcgacgccggctggaccgcgctggacgccgaccccgagtacggcggtcagggtatgccccacactgtcagcatcgccatgaacgaaatgatctgctcggcgaacgtggcctggggcatgtaccccggcctgtcgcacggcgcctacgcggccctgcacgccgtgggcagcgacgagctgaagaagctctacctgccgcacatcgtggacggcagctggaccggcaccatgggcctgaccgagccgcacgccggcaccgacctgggcatcatccgcaccaaggcgagcgacaacggcgacggcacctacagcgtgaccggcaccaagatcttcatctccgccggtgagcacgacatgtccgagaacatcgtgcacctcgtgctggcgcgcctcgaaggtagccccaagggcaccaagggcatcagcctgttcctcgtgcccaagttcatccccaacgccgacggcagcctgggtgagcgcaacggcgtggtctgcggcagcctcgagcacaagatgggcattcacggcaacgcgaccgccgtgctgaacttcgacggcgccaagggctggctggtcggcgaagtcaacaagggcatgaaccacatgttcatcatgatgaacgccgcccgtctcggcaccggtatgcagggtctgggcctcggcgaagtcgcctaccagaacgcgctggcctacgccaaggaccgcatccagatgcgccacgaaccccgcgtgagcagcgaggaagccgaccccatcctggtgcaccccgacgtgcgccgcatgctgctgaccggcaaggcctacagcgaagcgggccgggccctggccctgtggctggcgctgaatctcgacatcgagtcgcaccacgccgacgaagcccagcgcaaggaagccggcgacatggtggccctgctgacccccatcgccaaggccttcatgaccgacaacggcttcaacgtggctgtgcagagccagcaggtcttcggtggtcacggctacatccaggaatggggcatggagcagttcgtgcgtgacgcccgcatcgggcagatctacgaaggcaccaacggcatccaggcgctcgacctgctgggccgcaaggtcctgatggacggcggcaagaagctccagaagctcgccggcaccctgcaagcctttgccgaagaaaacgaaggcgacgaaaacatcggcgactacgtcaaccagctcggcaaggccgcccagcagctcggctccatcaccatggtgatcggccagaaggcgatgaccggccccgaaggtgcggatgaagtgaacgccgccgccgtggattacctgcgcttcttcggccacgtggtgtacggctacctgtgggcccgcatggcgaagatcgcccacgaccagatcgacgcgggcaacgacaaggacggcttctacctcgccaagacgcagaccgccaagttctacttcaccaagctgttccccgaaaccaaggcgctcgccgcgaccatcaaggccggcaacgaagcgctggcggtggacgacaaggccgtcttcggctgggaacacgccgaactcgtgaacgcctga

SEQ ID NO: 24350 - DNA, 915 bp, Deinococcus radiodurans
atgaaagtcggcgtggtcggcaccggcttcgtcggttcgacggcggccttcgcgctggtgctgcgcggtagttgcagcgaactggtgctggtcgaccgcgacgaggaccgcgcccaggccgaggccgaggacatcgcccacgccgccccggtcagccacggcacccgcgtctggcacgggggacacagcgagcttgccgacgcccaggtggtgattctgaccgccggggccaaccagaaaccgggcgaaagccgcctggacctgctggaaaagaatgccgacatcttccgcgaactcgtgccgcagattacccgcgccgcgccggacgccgtcctgctggtcaccagcaacccggtggacctgctgaccgatctggcgacgcagctcgcgccggggcaaccggtgatcggttcgggaaccgtgctcgacagtgcgcgctttcggcacctgatggcgcagcatgcgggggtagacggcacgcacgcgcacggctatgtgctgggcgaacacggcgactcggaagtgctggcgtggagcagcgccatggtcgccggaatgccggtggccgacttcatgcaggcccagaacctcccctggaacgagcaggtgcgcgccaaaatcgatgagggcacccgcaacgccgccgccagcatcatcgagggcaagcgggccacctactacggcatcggcgcggcgctcgcccgcatcaccgaggccgtgctgcgtgaccgccgcgccgtcctgaccgtcagtgcgccgacccccgaatacggcgtgagcctcagcctgccgcgtgtcgtgggccgtcagggggtgctgtccaccctgcaccccaagctgaccggcgacgagcaacagaagctggaacagagtgccggggtgctgcgcggcttcaagcagcagctcggcctgtga

SEQ ID NO: 24351 - DNA, 1404 bp, Deinococcus radiodurans
atgacgaacaactttgactatgacgtgctggtcatcggcgcgggtcccggcggctatcacgcggccattcgcgcctcgcagctcgggctgaaaacggcctgcgtggagcgcggcgcggtgggcggcgtctgtctcaatatcggctgcattccgaccaaggcgctgctacacgccgccgaaaccatgcaggcgagcaagcacgccgccgagttcgggctgaccttcagcgggcaggcccttgacatcgcccgactcaacggctggaaagacagcatcgtgaagaagctgacgggcggcgtctcggggctgttcaaggccaacaaggtcacgctgctcaccggacaggccagcttcgtggacgaccacaccgtgcaggtgggcgacaagacctacacggcggccaacatcatcatcgccaccggctccgacccggccaaactgccggggctggaagtggaccagcagcagatcgtggactcgaccggcgcgctggtcatgcccgacccggtgccggcccggatgctgtgcgtgggcggcggcgtgatcggcttcgagttcgcgcaggtctacaacaacctcggcagccaggtcaaaatcatcgagtttctgcccagcgtgattcccggcgccgacgccgacgcggtcaaggaattttccaagatcatgagccggcagggcatcgaaatcgtgacccagatgaaggccaaccgcgcagagaaaaagagcgacggcgtgcatgtggaactcgaaaacgtgaagaccggcgagaagaccaccgaagtctttgaccgggtgctcgtcgccgtgggccgccgcccgcgcaccgacggcctgaacccggaacaagccggcgtgaccgtgaccgagcgcggcttcattcccgccgacaagcagcagcgcaccaacgtgccgcacatcttctccatcggggacgtggccggcaaccccatgctggcgcacaaggcgatgaaggaggggctggtggccgccgaggtcatcgccggtaaacccgccgagcaggacgccgtcgccattcccggcgtggtctacaccaaccccgagctcgcctgggtgggtctgaccgaagccgaggcgcaggagaagggctacgaggtcaagaccggcgtgttccccatgagcgcctcaggccgcgccatgacgctgcaagccaccgaaggctttgtcaagatggtcgtggagaaagacaccgacctgctgctgggcgtgcacatcgtggcgccgcacgcctcagacatgctcgccgaagcggggctggcgctcgaaatggccgccaccgccaccgacatttcgctgaccatccacgcgcaccccacgctgggcgagtccatcttggaagcggcggaagcgagccacaagcaggcgattcatatcgtgaaccgctga

SEQ ID NO: 24352 - DNA, 4257 bp, Deinococcus radiodurans
ttgccggtctcccagcacggtggtaaagtcgggcaccgaagcacctccagctgcttgactcgtgaccaccagcgtaccccctgctgtccctttcggcgaagagacggcttcccgtgttgtgccggggcgctggcggccagtccctcttccccgtccccgccgccatccgcaaggagttccatgaccactgcccccgaccgctcggctccggcccgcaccgacaagaccacccagcacttcgacgagaacgcgcagcacatcgccaaacggcagtacttgcaggggaacgacggcgacatcagcgggatgttctggcgcattgccgattgggtggcgggcgccgaggccccggaggcgcggcagggctgggcgcagcagtactacgacctgatggcggagaagaagttctgccccggcgggcgcgtcctggcgggcgcgggcacgcagcacggcaacgttctgaactgctttgtgcagggcgccaccgagcacgaccccagctcctttgaaggcgtgatggaagtcgccaagaagctggcgctggtcaccaaagtcggcggcggcaacggcgtgaacctcgacgtgtaccgcccccgtgcccagagcagccggagcgacaacggcgtgcgcggctgggtctacatgagcgccgagcacgccgacgtgcaggactttatcgagggtctgatgcgcccacccacccagcccgacggcgagaagcagccggtgtcggtacgcaactggacgcgggtggtctacggtcaggcgatcagccccgagctggtggcgagtgcccgcgccaacggcgtgcagattgtgcgcacgctgcccgagggcgtgacggcggtggccgacgacatgggcggcatcatcgacgcggcgcggcaggtggccgaaatcgccaagctgaacatcgagccgcgcatcgacctcagcgccatgcggccggagggcgcgcccatcaaggggtcgggcggcaccagcagcgggccggtcagcttcctgatggagattttcgacaacttcatcgagtgggccaatcggggcgccgaagacagcggccccatcaacaccctgcgctacgtgtacgcgccggtgctgcgcgtggtcaggcagggcgggacgcggcgcggcgcgggcatggcgaccatctccatcggtcaccccgatgtgctggacttcttgaccgccaaggacctcgaccgcgaggccgccgagggtgacatctcaaccttcaacatctcgattctggtggacacgaagttctgggacaccttgcaggccgacggtgtgtggaccatcgacgcgcaggacgtgcccggcaagtatttcccggtgccgcaggaaggcgagtacgcgggcactttccccgagctgcccacccgtgccgaggacggcgccaagggcgttccggtttacggcagcggcattcccgcgcgctggctgtgggatcagattgcccagcacgcctggagcaccggcgaaccgggattgattttcaacgaccgggtgaacgagtactcggcgctgaagaacttgggcgagcggtacgagattcgctccaccaatccctgcgtgacggcggacacctgggtcagcacggccttcggggcgcggcaggtgcaggacctgatcggcaaggatttctgcgccaccgtgaacggcgagagcttcagtgcgcgcgggggcttttggctaactggagttaagtcggtcctgaaggtcacgacccgccggggctacgagctgcgcctgaccgggaaccaccagctgctcaaagtgactcaccagacccgcaaggtgcagcagaccgcctgggtggaaaccgcaaccctggcggcgggcgaccgcatcatgctcaatgatcaccgtacggtgaagccctgggccggcgcggggaacttttcggaaggctggctgctggggtctctcatcggcgacggcacctttctcaccgacaaggcccgcccgatggccgcgctgggcttctggggcgaggagagacaggcgcaggctgatagcgcacaggcccggctgagcaagctgggcgcggtcaagaagctgtggcgtagcaacgatgagcagcgccagcgcgtgcgcctgagcagtgaagccctggccgaactgggggccaagtacggcgtcgtgcacgggcacaagacgctgaccgacaaggtggaacagggcggctacgagttctaccggggcgtcctacagggcctgttcgacgccgacggcagcgtgcagggcacccagagcaagggcgtgagcgtgcgcctcgcgcaatcggatctgagcctgctgaagcgtgcccagcggatgctttcgcgcctcggcatcatgagcagcctctacgccgagcgtcgcctcgctggaacctctaccctgcccgacggcaagggcggcagcgccgaataccccacccaggcccagcacgaactgatcatcagcggcagcaacctcgccgtctttgcagagcgtgtgggtttcagtgaggccgggaaggctgcccgcctggccgagaaactcgccgggtacgcccgcaacctcaaccgcgagcgcttcagcgacgagatcgtaagcatcgtgcccgacggcgaggaagccgtgtatgacgtgaccgtggaacaggttcacgctttcgacgccaacggtgttctggcgcataattgcggtgaaatccccctcactgtcggcgagccctgcgacctgggcgccatcaacctcgccgcctatgtccggggcagcgacttcgacttcgccgccttccgcgccgatgtccgcacctgcgtgcgcttcctcgacgacgtgctggacgtgaacgtgttcgcgctggaagacaaccgggtggcctcgcaggacctgcggcgcctgggcctgggcgtgatgggcctggccgacgccctgatcaagatggggctgcgctacgacaacgaatccgggcggcaggccatctacgacatcatgtcggcgctgcgcgaggaagcggtggccgagagcgagcgcctgggccaggaacgcggcttttaccccgtctacgagcgcaaccgcgagcaggtgccgcacgacccgcgccgcaacgtggcggtgctgacggtggccccgaccggcaccacgtccatgctgatgggcgtgagcagcggcatcgagcccgtgttctcaccgttcatctggcgcaagatcggcagcgagtaccgcgccctgctcgcgccgctgtttgtcgaactgctcgaaagctaccccgcacccaaagggatggaaaaagacggcggctgggactgggacaaagtgaccgaagccgtctccgaaaaccacggcagcgtggtgggcctgagctttattcctgacgccttgcagcaggtgttcgtgtgcgcccacgacatctcgccggtggaccacgtgcggatgcagggcaccgtgcagcgcgccttcgatgacggtgggcagctcgccgccaactcgctgagcaagaccatcaacctgcccaactcggccagcgtggacgacgtgaaatcggcctacgaggaagcgtacaggaccggctgcaagggcatcacggtgtaccgcgacggctcgcgccagttccaggtgctctcgacgagcaagaagaaggccaagacggaagagaggggcagcgccgagccgctcgccgacagcaagcccgccgaggctccggcagtcacggccccggtcagcgcccccgctgctgcggcccagccccaaccgcactacgagcgtccgggccgcctgcacggcatcaccgacatggtcaagctcaccgaccccaccagcggacaccgccgctcgttcctggtcacggtcaaccacctcaacggcaacccggtcgaagtcatggtcatctcgggccgcgcgggcgacgaagccaacgccgactccgaggcgctcgggcgcgtggtgagcatcgcgctgcaacacggcgtgccggccagcgccctgattcacaccctgcgcggcatcaacggcgggctgtacggcagctacaacggccgtctggtgggctccaaggccgacctgatcgccgtcgccctcgacaccttccagaaggacatggccgccgcgccgctcccgcccctggccgggggaagcggcgaagtggccccgagcgccccggccagcaccggggtcagcgtggacgggctggggcaggagcgctgcccggtgtgcgaggaaaaagccgtcatccgcgaggaaggctgcctgaaatgccaggcgtgcggctacagcaagtgcgggtga
